United States Patent 7,745,391 (HUMAN THROMBOSPONDIN POLYPEPTIDE) - sequence listing, part 193

SEQ ID NO: 459448 - DNA, 5867 bp, Homo sapiens
  misc_feature (1472)..(1472): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttaggagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459449 - DNA, 5726 bp, Homo sapiens
  misc_feature (1472)..(1472): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459450 - DNA, 5556 bp, Homo sapiens
  misc_feature (1472)..(1472): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaaaaaaaaaaaaaaaaactgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459451 - DNA, 7747 bp, Homo sapiens
tggtgtagcttgactcctagaaggtctggcccctctgagatttgcttttgggcgatccaaaggacatgtagagaagtcaagctggtacatggtattgaaacacttcagggccctcaggttgtcccctggacctgcgggtaggaaaccgggagagtgggttcagcactactgctcactcccctaaagatcaaagaggatgccgctcctttgcataatgaaaatgaagtctttgtactttgatttggaggggccgattttagggcaaagtgtctcatctaaacagcctccctcaacctatgggagtgatcactcagtacccctgggaacatttatttatgttccccaaacccagagaaacagagtccaggacgagaattgaggtgatgagcaccttctcccaccacccccaactttggctggggtggggtgggatgaaaattagccaggtgtggtggtagatacgtgtaatctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459452 - DNA, 8215 bp, Homo sapiens
  misc_feature (1472)..(1472): n is a, c, g, or t
  misc_feature (8144)..(8144): n is a, c, g, or t
  misc_feature (8215)..(8215): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtccctgaatnttgaggggaggaatcccggaaaatgggtccccatatgtaatggtgtgccgaagtaaaaggccaacccgaan

SEQ ID NO: 459453 - DNA, 8255 bp, Homo sapiens
  misc_feature (1472)..(1472): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgcgtgagccaccacgcccggccaggaattcttaataactgtttcatcactcttatgtctgagacagttgagcaattacaaggtatttgcaaagaagacacctctatggcaagatgatgatatccattcccagcacaaaggagaatgcaggagtgcagcagttgagcagcttttcctttcttcctgaactataccttacagtgtggttttagtattttgtttttcattacaaattcaatagggaaggtcaaatcaagtaaaaaggattattgagcatcatgccatttcatcatccccaagttcattggtagaagttatcaagagttgtctgtattttaaaaaagcatacaaccatcatgaaattttacctctgcaatcttttctgatagaggaacattttgaatatccatctctgatgcatttactatggcttttgtttttaagagatagctagataggaaaaaaaaaa

SEQ ID NO: 459454 - DNA, 5524 bp, Homo sapiens
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggcaaatcacctgaggttgggagtttgagaccagcctgaccaacatggagaaaccccatctctactaaaaatagaaaattagctgggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459455 - DNA, 7844 bp, Homo sapiens
  misc_feature (1472)..(1472): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctctactaaaaatacaaaaaattagctgggcattgtggtgggcgcctgtaatcccagctacctgggaggctgagacaggagaatcgcttgaacctgggagatggaggttgctgtgagccgagattgcaccattgcactccagcctgggcaacaagagtaaaactccgtctcaaaaaaaaa

SEQ ID NO: 459456 - DNA, 7796 bp, Homo sapiens
  misc_feature (1472)..(1472): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctccctcccagctactcgggaggctgaggcagaagaatcgcttgaaccgggaggccgaggttgcaatgagctgagatagcaccactgcactccagcctgggtgacagagcaagactcagtcttaaaaaaaaaaaaaaaaaaagaaaaagaaatattccataatacaaaat

SEQ ID NO: 459457 - DNA, 5560 bp, Homo sapiens
  misc_feature (50)..(50): n is a, c, g, or t
cgccaaatgtgaaacaccataaagtcagatggcactgcatgagggatttntgcttctttttcttaaggaaaaggagttacatggaaaattctctcatcctcccccctctgcccccaactcctctatgtccaaagttgttttttatttttctgagacggagtctcactctgtcgcccaggcgggagtgcagtggtgcaatctcagttcactgcaacctccgcctcccggattcaagcaattactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459458 - DNA, 7609 bp, Homo sapiens
  misc_feature (1472)..(1472): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtgagctgagatcacaccactgtactccagcctggtgacagtaagactccacctcaaacaaacaaaaaatgcac

SEQ ID NO: 459459 - DNA, 4529 bp, Homo sapiens
  misc_feature (1472)..(1472): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaaaaaaaaaaaaaaaaaccccgagagggcatcatatgccggggcgcggggaaacaacgggcgtcatcagaaaaggggccacatgggccaaagcgctgtggttctcctggcacccaaggcttcccttgcgcaccacgggcggaaagatcggcgacgggtcccccatataggggaggggccgatataaaatttcgaataagcccagggtaacccggctttgg

SEQ ID NO: 459460 - DNA, 2552 bp, Homo sapiens
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggcaaatcacctgaggttgggagtttgagaccagcctgaccaacatggagaaaccccatctctactaaaaatagaaaattagctgggtgcggtggcttacacctataatcccagcactttgggaggccaaggtgggcggatcacaaggtcaagagatcaggaccatcctggccaacatggtgaaatgccatctctactaaaaatacaaaacttaggagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459461 - DNA, 4268 bp, Homo sapiens
ctagacagatacgattgagctcgtacccattcttcgctcaattctctccactggtgacagtaagactccacctcaaaccaaccaaaaaatgcacaaaaggaaaaaatgttctggataaagagaatatgaaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459462 - DNA, 2620 bp, Homo sapiens
atccggccgtcgtatctcatgcgcggcagatagtattgtggtcatgtatatcgggtagaaagtccgcagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459463 - DNA, 4299 bp, Homo sapiens
  misc_feature (1472)..(1472): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatcttaaggagcaaacacctatcccccattctcctcgtatccctcaacaccgacatcattaccgggttttcctttt

SEQ ID NO: 459464 - DNA, 1823 bp, Homo sapiens
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtaagtaattgtgggctaatcgttccaaatactgtttaagtagcttgaaaacaggtacatagaagtggaacaataagccgttagcttcagcagaagacgaacatgaaaaatgactgtaagctattgaaatttaagttaaatcttttatttttcaacaaaagaaatgtattaaataaaaaggagtaatcttgatcatttgctcaaactaccaataattttcactgtctaaagaaaacagacacatatttaattagattgaaggaaatcaaatgattaaaaaataggcctggcccggtggctcacgcctgtaatcccagcagtttgggaggccgaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459465 - DNA, 3541 bp, Homo sapiens
  misc_feature (1472)..(1472): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagctactcgggaggctgaggcaggagaatggcgtgaacccgggaggcggagcttgcagtgagccgagatcccgccactgcactccagcctgggcgacagagcgagactccttctcaaaaaaaaaaa

SEQ ID NO: 459466 - DNA, 1113 bp, Homo sapiens
tgggaacggcccaccgcagggttggccaccttgagaagctgcgaagatggcggagtaaggcgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459467 - DNA, 1501 bp, Homo sapiens
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagtcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaatt

SEQ ID NO: 459468 - DNA, 979 bp, Homo sapiens
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaaaccaccgctgaaacttcacttctacacagaggctttctttcccagaaacccagaccagatggagtttcactctgtcgcccaggctggagtgcagtggcacgatctcggctgactgcagcctctacctgctgggttcaagcaattcttctgcctcaggttcctgagtagctgggattacaggtgcgcaccaccatgcctggctaatttttgtatttttagtagagacgaggtttcaccacgttggcgaggctggtcttgaactcctgacctcaagtgatccactgcctcggcctccgaaaatctggaattatagatgtgagccactgcgccaggcctgtaattttatgtatctttatgtgattatttgaatgtccctctctgactagattataaattctaaggatagtgtgtctatttttgcttaccttttatccccagcacctagtctaacactttacaaatatatattaaattaatattttgataagttactcaaagtgctacataaaacaaaattatagaaaatagtactttggtaactgtttcgttttatcattgctttcattatttctctgttaacctcagtttacaactgaaaaagacaaattgtat

SEQ ID NO: 459469 - DNA, 857 bp, Homo sapiens
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagaggtgcaagcgaagatgcag[450 bp omitted]tttctactaaaaatacaaa

SEQ ID NO: 459470 - DNA, 550 bp, Homo sapiens
ctgcctacctctgagtctctgtcaaatgcaagtgatggtggctaacttccttcctatagcaagctctgaataaataccttttgtttgttctcatttaggttgtcttcattcatttccacagtttctctggaggttccaacaagatacggtctccattgcccattgctctggaccccagccatcacccagtgcagcagtgatgccttatgacaagtcagcacctggtctgaactctgctctctttgcactgaattctttgagtttttattccaagttcagtcattggttttagtattggttcccatctgcttggcatccttggtggaattgggcttcttttttcaatttctttttgctgtctttttgttttactgtgttgagtagtgctatctaaatgtgtttatcataaaagaagcagcacatgatcataggcccatgagcctgtttttcaagccagccaaacagcacatttagtttgacattcacactggacctctgtccatttttataaacttcgctttgggtcatcaataaaactaaatgaagttct

SEQ ID NO: 459471 - DNA, 1866 bp, Homo sapiens
agtttcccgtgggtgtgttcacagaacactgggcccctttccatagttcacagacgtggacaatgagcagatgaggctttctccctctggtcctgaagtagcatcatttcatctgaaatggccacaagcaattttggtttatttttcataacagaatcaaagacatcaccaaaaactccatcccacttcttgcaggggaggaatttgttattttcccttggatcctgttgaacacatgtggcatcctgcctgaacccctcccgcagctgccatgcgatccagagctccatccacttgcccacctaagtggaaagggccttcgagggccatcagtttgcagacgacactgtgcattcctttttctctttcggacgctggctccacaatccgggctccaggaggtggaatcgctgttcacttactgccccctagtggtccgcatttctgaaagttctttatccctgtttcctttgagatttttctccgtagatttataggtgtttaggatggggttagtaatgtggccaaggaggtggttgttttctcaagggtgagacctcgtctccgatctccgtctcttggagctagcattcccctctatccacagacaccacgtctgtcgtcatttttattttctgcaatcatttcttctcttggtagcttggagaagagttcatccttgttgatgagacaatcagtataaaccagaggttctcatttaggggcaattttgctcccccttccccagggacattggacaatgtctgggtctggagacattctggtttgtcacaagctggggtaggcaaggtttctactggcatccagtagatgaaggccaggggcgctgctaaacatcgtaccgtgcagtttccccacaccacagcgaagaattacacagcccaaaatgtcaaatgctgaagttgaaaagcctgatattaaccactgtgggcttcttgttttactgcaccgcaggtcggtctccctctctctctctttctctctttctccctctctctcctaccccaccctcccacctatccctccttctgtccctctgttggcatcagcaccactgaataaaaagactcggtcctctgttagccaggcacaatcgtccctttggccaatgtagaacattccctggaaaaccctccttgtacctgcctcacaccactgcaaaatgttcccagccactgttaaaagatgagcgacccccctccaccaccaccacacgaaaggcaggggggaggagctggggctctacacaaaatcagaggctgagacgggcactcggcccctcctcttcctctgtgaggcctcgtgttcagctctatgtgctggtgtccttgctcccgcagcgagttggaagactttgttgaagacttgaagaaggactccacggcagccagccgattggttactctgaaagacgtggaagacggggctttcctcctgcgtcaagtgggagaggctgtagctaccctgaaaggtaaactttctgctgggtcgggggaggagtctgagctgtctttcctgcggtgtttaaaaatctgccacatagaggattcattcatgtatgcaagtatttattaaacgtctacatgtgccaggcattgttctggacacttgggataccccacagcacaaagtaggtgcacatccccctcttcttggagctggtattagagtgggtgctgtaagatttcacactaaatgattccagtaacactttctatttgctaggctcttacagtgcaccgggatgcatgtgccaaacccgttaaaaacacaaggtgggaggatcacttgatcccaggagttcaagaccagcctgggcaatatagagagactcacatctctacc

SEQ ID NO: 459472 - DNA, 5385 bp, Homo sapiens
taatttttttttttccaaagagatgggatcttgctacattgcccaggtgggtctcgaactcctggcctcaagcaatcctcttgccatggcctcccaaagcactgggattacaggcataagccattgcacccagcccttgaatttttgaaaattaggctctttaacacctgcttggacttcaaagaacgaaggtgagtacttacacaataaccaaacagtgcattccttggaaattccaaacctagatctcttgttacatgcttgccaagcttgtcctgaacgttcctaagtgcagcaggaaagaagtggctcagcttgtgctgtgtgtcccctgagtcttgacctgtgactaataactgtttcctttgtgtgcaggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgcacgatggcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 459473 - DNA, 2531 bp, Homo sapiens
aagcgaccagattgcccagcgcctggagaatgggctgcagccagagagagcataggaggatgttgttctctgtacactgtctctaaaaatggtgctttttggctgggcacggtggctcatgcctgtaatcccagcactttggaaggctgcggcgggcagatcacttgcggtcaggagttcgagacctgcctgatgatcatggagaaaccccatctctactaaaaattcaaaattagccgggtgtggtggtgtggtgggcacctgtaatcccagctacttgggaggctgaggcagaagaatcgtttgaacccgggaggcagaggttgcagtgaactgagatcgtgccattgcactccagcctgggcaacaagagtgaaactccatctcaaaaaaaacaaacaagcaaaaaaatgatgccttttagcaaaatagtgactgactggcttttaataccacaataaaaagacattagcaaaagtggtgtgagagcatgatcatgagtcctgtagagaaagtaaccaaaagtgatacatttctatgtggttccctcccagacaaaatgccaggctccacccactagttcaccctccctgttagcaatggctggtacgtgttcaggtttagattggtgccagacactttattttattgtctcaccgagtctccatgaccaacctacgagctatgagatattactaccccttttttggatagacacagaggtgaatagcttgcccatggacacacatctactaagtggtaaaactggaaatcgaacccaggcagtctttccccagaggccagttcatcaccatgcagtgctgatgttgggacctaatggtggttctgcttgtggcctgtgttgaaatgttttatctttattcagagaaaacagaaggcatgatgtggctttaagcaggtggtgacatggtcagattgcatttcccctcaatttacatggataatggacagttgacaaagacatcatcacccccatgagatgataaaccagtccatgaaaccggaaaacaggaaaccattgaaatttgttaaatgatatttcagtggaactttggggataatatactaggcataatatcattattgtgatggaggctgattgagtgaattcactcgatggagctgctgttagaaaattgtcctgctccagggactcaagtgctcaaccagactcctgcgaagcctgaataaagctcccacctcctatattctctgggatgagaaacaagaatgttctcggaactgtttggaaattgtgagttctgtatacaggtagcctacctccaatctagagaaattcataaattgccaaaagccctggactcatccagaatcattatcattgccaacattaaagtcctatgttttaagcatctgtgatttcatggtacttggtacatggaaccatgtgaacgaaaaggacacagatcctctttgaactgatactgacgtatttcatagccaaatcaccacgtgttgagttcccattctacaccatgcggtatttcatgtaaccctcaagaatggccaaggaaagtggattccccatcattagaggtaaggaaatgaagaccaagggagtctaaataatgggcccaaagtctcacagtgggctagagagagagtatgggattagacccaaagtcttcttggctccaaagcaggtgccctgtgctgctccctctaaagatacatcagtgagagtttacgcctgttgtccatgatgcattgaccagagtagaaaaaggatcctttgtcttgcaggcagtctggttgccagttggctgccaaaattcagatgttggtggaagaagccacattatgtacagtctttgctccctttcctttctcattgaaataagtaaagattcagccgcagggctgtctacccaaagtgctccgaagacttcaaggcattcactcgcctccatttcaggcaggcagagcccactgaggttgatttttttgtgttcacagctgcagaaccaggagttgctgagggcaatgatgaagaaggccgagctggaaatcagtggcaaagtgatggaaacaatgaagagactggaggatcccgtgcagcgcacgatggcgcgtcctagtggagcaagagagacaaaaatatcttcatgaggaagagaagatcgtcaagaagttgtggtgagtgccagtcacttgcatgttgagctgtttcacctgcaaaggaaaattatcattactaagaaggaggtccttcccagttggtggtcttgccctctctttattgagcacctactgtgtaaaagttagagttctgctgatgctggtatatgtggacacttcagcacctgtccatggaggcccaggaaattcagtggccctcaggtgactgaatttctttaaaagttgcggcattgctgggcatggtagttcacacctgtagtcccagttactcatgaggctgaggcgggaggattgcttgagtccaggagttcgagaccagcctgggtaacacagggagatcctgtctctta

SEQ ID NO: 459474 - DNA, 5588 bp, Homo sapiens
catggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctaggtaaaaaagaagaaagccaatgaaaaaaataattcaatctgtttctcttttaatcattaagataattcattcattcaaatctgttttcttgtaatcatttcaaggctgaaaatattcacatctctatggatcatgggcgttatttttttgttttggggggtttggttgctttttttctttcctccttctggtaattcttggtcgaaagtaacactttggcccaagaaggtaaatgggcttcccagtgcatgtggcttcatggaccactcaccgtgcagtgcctgcaaccaccacccttgcgtgtccacgtcgccatcatctgaaagtcacaagtgagcctggctgcattccacccccagtgtcaggtgcacacctgggaagccttttccatcctggccaattgtgatgctgatgctaaaataccttcattgcttaatcccatcactgccaattgcttcaaatagtggatggaatgggctttaaaaaaaaaaaaaaaggcattttggaaactgcatagctgactctctttttcttttattcagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgcacgatggcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 459475 - DNA, 5560 bp, Homo sapiens
aagcgaccagattgcccagcgcctggagaatgggctgcagccagagagagcataggaggatgttgttctctgtacactgtctctaaaaatggtgctttttggctgggcacggtggctcatgcctgtaatcccagcactttggaaggctgcggcgggcagatcacttgcggtcaggagttcgagacctgcctgatgatcatggagaaaccccatctctactaaaaattcaaaattagccgggtgtggtggtgtggtgggcacctgtaatcccagctacttgggaggctgaggcagaagaatcgtttgaacccgggaggcagaggttgcagtgaactgagatcgtgccattgcactccagcctgggcaacaagagtgaaactccatctcaaaaaaaacaaacaagcaaaaaaatgatgccttttagcaaaatagtgactgactggcttttaataccacaataaaaagacattagcaaaagtggtgtgagagcatgatcatgagtcctgtagagaaagtaaccaaaagtgatacatttctatgtggttccctcccagacaaaatgccaggctccacccactagttcaccctccctgttagcaatggctggtacgtgttcaggtttagattggtgccagacactttattttattgtctcaccgagtctccatgaccaacctacgagctatgagatattactaccccttttttggatagacacagaggtgaatagcttgcccatggacacacatctactaagtggtaaaactggaaatcgaacccaggcagtctttccccagaggccagttcatcaccatgcagtgctgatgttgggacctaatggtggttctgcttgtggcctgtgttgaaatgttttatctttattcagagaaaacagaaggcatgatgtggctttaagcaggtggtgacatggtcagattgcatttcccctcaatttacatggataatggacagttgacaaagacatcatcacccccatgagatgataaaccagtccatgaaaccggaaaacaggaaaccattgaaatttgttaaatgatatttcagtggaactttggggataatatactaggcataatatcattattgtgatggaggctgattgagtgaattcactcgatggagctgctgttagaaaattgtcctgctccagggactcaagtgctcaaccagactcctgcgaagcctgaataaagctcccacctcctatattctctgggatgagaaacaagaatgttctcggaactgtttggaaattgtgagttctgtatacaggtagcctacctccaatctagagaaattcataaattgccaaaagccctggactcatccagaatcattatcattgccaacattaaagtcctatgttttaagcatctgtgatttcatggtacttggtacatggaaccatgtgaacgaaaaggacacagatcctctttgaactgatactgacgtatttcatagccaaatcaccacgtgttgagttcccattctacaccatgcggtatttcatgtaaccctcaagaatggccaaggaaagtggattccccatcattagaggtaaggaaatgaagaccaagggagtctaaataatgggcccaaagtctcacagtgggctagagagagagtatgggattagacccaaagtcttcttggctccaaagcaggtgccctgtgctgctccctctaaagatacatcagtgagagtttacgcctgttgtccatgatgcattgaccagagtagaaaaaggatcctttgtcttgcaggcagtctggttgccagttggctgccaaaattcagatgttggtggaagaagccacattatgtacagtctttgctccctttcctttctcattgaaataagtaaagattcagccgcagggctgtctacccaaagtgctccgaagacttcaaggcattcactcgcctccatttcaggcaggcagagcccactgaggttgatttttttgtgttcacagctgcagaaccaggagttgctgagggcaatgatgaagaaggccgagctggaaatcagtggcaaagtgatggaaacaatgaagagactggaggatcccgtgcagcgcacgatggcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 459476 - DNA, 4941 bp, Homo sapiens
catggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgcacgatggcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 459477 - DNA, 5492 bp, Homo sapiens
ctgggtaatacgaaatggtctttattggttgtgaacactcgagctgagaaacattttaggatctttgtgtcttttgtgatgattttgtttctgaagaggaagctgtctaaaatattcaagtgtgcaaccaaggatttagatgaagccagcaaacaaaggaatcatgtaatcaggacctgagcgaatgtgcttactcacggcgttagttacacaggtgatttccttaagaaaaaatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctaggtaaaaaagaagaaagccaatgaaaaaaataattcaatctgtttctcttttaatcattaagataattcattcattcaaatctgttttcttgtaatcatttcaaggctgaaaatattcacatctctatggatcatgggcgttatttttttgttttggggggtttggttgctttttttctttcctccttctggtaattcttggtcgaaagtaacactttggcccaagaaggtaaatgggcttcccagtgcatgtggcttcatggaccactcaccgtgcagtgcctgcaaccaccacccttgcgtgtccacgtcgccatcatctgaaagtcacaagtgagcctggctgcattccacccccagtgtcaggtgcacacctgggaagccttttccatcctggccaattgtgatgctgatgctaaaataccttcattgcttaatcccatcactgccaattgcttcaaatagtggatggaatgggctttaaaaaaaaaaaaaaaggcattttggaaactgcatagctgactctctttttcttttattcagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgcacgatggcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 459478 - DNA, 4546 bp, Homo sapiens
tgggtgaacttccacggccttctaggtggtaccttttataaccctcaggtggtgcattcacccggacaaactggtttgaaagtccataaagctttaacaaacaattctcttgttttacagagagaggatgcaagccatggagaaacagattgccagtttaactggccttgttcagtctgcgctttttaaagggcccattacaagttatagcaaagatgcgtctaggtaaaaaagaagaaagccaatgaaaaaaataattcaatctgtttctcttttaatcattaagataattcattcattcaaatctgttttcttgtaatcatttcaaggctgaaaatattcacatctctatggatcatgggcgttatttttttgttttggggggtttggttgctttttttctttcctccttctggtaattcttggtcgaaagtaacactttggcccaagaaggtaaatgggcttcccagtgcatgtggcttcatggaccactcaccgtgcagtgcctgcaaccaccacccttgcgtgtccacgtcgccatcatctgaaagtcacaagtgagcctggctgcattccacccccagtgtcaggtgcacacctgggaagccttttccatcctggccaattgtgatgctgatgctaaaataccttcattgcttaatcccatcactgccaattgcttcaaatagtggatggaatgggctttaaaaaaaaaaaaaaaggcattttggaaactgcatagctgactctctttttcttttattcagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgcacgatggcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 459479 - DNA, 4743 bp, Homo sapiens
agtttcccgtgggtgtgttcacagaacactgggcccctttccatagttcacagacgtggacaatgagcagatgaggctttctccctctggtcctgaagtagcatcatttcatctgaaatggccacaagcaattttggtttatttttcataacagaatcaaagacatcaccaaaaactccatcccacttcttgcaggggaggaatttgttattttcccttggatcctgttgaacacatgtggcatcctgcctgaacccctcccgcagctgccatgcgatccagagctccatccacttgcccacctaagtggaaagggccttcgagggccatcagtttgcagacgacactgtgcattcctttttctctttcggacgctggctccacaatccgggctccaggaggtggaatcgctgttcacttactgccccctagtggtccgcatttctgaaagttctttatccctgtttcctttgagatttttctccgtagatttataggtgtttaggatggggttagtaatgtggccaaggaggtggttgttttctcaagggtgagacctcgtctccgatctccgtctcttggagctagcattcccctctatccacagacaccacgtctgtcgtcatttttattttctgcaatcatttcttctcttggtagcttggagaagagttcatccttgttgatgagacaatcagtataaaccagaggttctcatttaggggcaattttgctcccccttccccagggacattggacaatgtctgggtctggagacattctggtttgtcacaagctggggtaggcaaggtttctactggcatccagtagatgaaggccaggggcgctgctaaacatcgtaccgtgcagtttccccacaccacagcgaagaattacacagcccaaaatgtcaaatgctgaagttgaaaagcctgatattaaccactgtgggcttcttgttttactgcaccgcaggtcggtctccctctctctctctttctctctttctccctctctctcctaccccaccctcccacctatccctccttctgtccctctgttggcatcagcaccactgaataaaaagactcggtcctctgttagccaggcacaatcgtccctttggccaatgtagaacattccctggaaaaccctccttgtacctgcctcacaccactgcaaaatgttcccagccactgttaaaagatgagcgacccccctccaccaccaccacacgaaaggcaggggggaggagctggggctctacacaaaatcagaggctgagacgggcactcggcccctcctcttcctctgtgaggcctcgtgttcagctctatgtgctggtgtccttgctcccgcagcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 459480 - DNA, 3573 bp, Homo sapiens
tcatgccactgcactccagcctggatgacagagtgagaccctgtcagccagtcaaattaaaaagtaataataataaccctaatggtcaattggctttatcccaaatacacagacaggaaacaggcctagaggagctttacccttgcccaaggtgagtttctccaatgctcctctgtgctcttaacccactgccacctgaagatgtgtgagccaccctgtggcttgtgaactctgcacttctctgtccagtatcggagtgcgggatgagggttgtcgttctggctttttctcctccaattcacctgctggtttgggcctgcaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 459481 - DNA, 6311 bp, Homo sapiens
catggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctaggtaaaaaagaagaaagccaatgaaaaaaataattcaatctgtttctcttttaatcattaagataattcattcattcaaatctgttttcttgtaatcatttcaaggctgaaaatattcacatctctatggatcatgggcgttatttttttgttttggggggtttggttgctttttttctttcctccttctggtaattcttggtcgaaagtaacactttggcccaagaaggtaaatgggcttcccagtgcatgtggcttcatggaccactcaccgtgcagtgcctgcaaccaccacccttgcgtgtccacgtcgccatcatctgaaagtcacaagtgagcctggctgcattccacccccagtgtcaggtgcacacctgggaagccttttccatcctggccaattgtgatgctgatgctaaaataccttcattgcttaatcccatcactgccaattgcttcaaatagtggatggaatgggctttaaaaaaaaaaaaaaaggcattttggaaactgcatagctgactctctttttcttttattcagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgcacgatggcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaattttaactgttaacacacggtgccagaccaggtggcttttctttggtgaatgtagtgtttcatctgaacacctcgggaagcagagacaaaccaacctgtggttgaactgcccttaacgtcaccactactaacgtctatgttgactgtattgtgttagaagcacattaacactccgtcacaatgcccgacccccaccccagtaattatccagacgcatggcccacctggcacacaggaaatggtagagctggaatgatgggactcctctcacaaatgtattcttcctttcctcctttcccgtccatcctttgctatgtacatggggggtttctaccaggtccagtagagcacaacaagacttagctcaggccttgaactgtgtttggttggttttctttgattgaattattctcagaagggctgtgttgccaggccctgtgggttgatcatgtgaccgcctttctgacaaaatgtctcccgccatctttatttgcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 459482 - DNA, 4818 bp, Homo sapiens
ccctttattttcttcaccactcccctacaaaattttaaattcttgaaatcttttgctaattgagattttcatcttgtgcaaacacagggcatttttggcagttggagaacaaagcaatccaaggtaaacagctgtaggctttggattggtgtgtaagaaatatgcgtggcccgcatgtcttagaaatgtaattaaaggaacgatttagttatagtccacttttttggggggatgtggttttgtggagtaacatgtcctacactattctaccagaatttggaatttttccatgaagatgtacggaaatctgatgttgaatatgaaaatggcccccaaatggaattccaaaaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaattttaactgttaacacacggtgccagaccaggtggcttttctttggtgaatgtagtgtttcatctgaacacctcgggaagcagagacaaaccaacctgtggttgaactgcccttaacgtcaccactactaacgtctatgttgactgtattgtgttagaagcacattaacactccgtcacaatgcccgacccccaccccagtaattatccagacgcatggcccacctggcacacaggaaatggtagagctggaatgatgggactcctctcacaaatgtattcttcctttcctcctttcccgtccatcctttgctatgtacatggggggtttctaccaggtccagtagagcacaacaagacttagctcaggccttgaactgtgtttggttggttttctttgattgaattattctcagaagggctgtgttgccaggccctgtgggttgatcatgtgaccgcctttctgacaaaatgtctcccgccatctttatttgcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 459483 - DNA, 6025 bp, Homo sapiens
catggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctaggtaaaaaagaagaaagccaatgaaaaaaataattcaatctgtttctcttttaatcattaagataattcattcattcaaatctgttttcttgtaatcatttcaaggctgaaaatattcacatctctatggatcatgggcgttatttttttgttttggggggtttggttgctttttttctttcctccttctggtaattcttggtcgaaagtaacactttggcccaagaaggtaaatgggcttcccagtgcatgtggcttcatggaccactcaccgtgcagtgcctgcaaccaccacccttgcgtgtccacgtcgccatcatctgaaagtcacaagtgagcctggctgcattccacccccagtgtcaggtgcacacctgggaagccttttccatcctggccaattgtgatgctgatgctaaaataccttcattgcttaatcccatcactgccaattgcttcaaatagtggatggaatgggctttaaaaaaaaaaaaaaaggcattttggaaactgcatagctgactctctttttcttttattcagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgcacgatggcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaattttaactgttaacacacggtgccagaccaggtggcttttctttggtgaatgtagtgtttcatctgaacacctcgggaagcagagacaaaccaacctgtggttgaactgcccttaacgtcaccactactaacgtctatgttgactgtattgtgttagaagcacattaacactccgtcacaatgcccgacccccaccccagtaattatccagacgcatggcccacctggcacacaggaaatggtagagctggaatgatgggactcctctcacaaatgtattcttcctttcctcctttcccgtccatcctttgctatgtacatggggggtttctaccaggtccagtagagcacaacaagacttagctcaggccttgaactgtgtttggttggttttctttgattgaattattctcagaagggctgtgttgccaggccctgtgggttgatcatgtgaccgcctttctgacaaaatgtctcccgccatctttatttgcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattaaaaaaaaagtcgacgcggccgcgaatttagtagtagtagtcgacccgggaatttcgggaccgtaccttgcggcg

SEQ ID NO: 459484 - DNA, 4095 bp, Homo sapiens
ccctttattttcttcaccactcccctacaaaattttaaattcttgaaatcttttgctaattgagattttcatcttgtgcaaacacagggcatttttggcagttggagaacaaagcaatccaaggtaaacagctgtaggctttggattggtgtgtaagaaatatgcgtggcccgcatgtcttagaaatgtaattaaaggaacgatttagttatagtccacttttttggggggatgtggttttgtggagtaacatgtcctacactattctaccagaatttggaatttttccatgaagatgtacggaaatctgatgttgaatatgaaaatggcccccaaatggaattccaaaaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 459485 - DNA, 5608 bp, Homo sapiens
catggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctaggtaaaaaagaagaaagccaatgaaaaaaataattcaatctgtttctcttttaatcattaagataattcattcattcaaatctgttttcttgtaatcatttcaaggctgaaaatattcacatctctatggatcatgggcgttatttttttgttttggggggtttggttgctttttttctttcctccttctggtaattcttggtcgaaagtaacactttggcccaagaaggtaaatgggcttcccagtgcatgtggcttcatggaccactcaccgtgcagtgcctgcaaccaccacccttgcgtgtccacgtcgccatcatctgaaagtcacaagtgagcctggctgcattccacccccagtgtcaggtgcacacctgggaagccttttccatcctggccaattgtgatgctgatgctaaaataccttcattgcttaatcccatcactgccaattgcttcaaatagtggatggaatgggctttaaaaaaaaaaaaaaaggcattttggaaactgcatagctgactctctttttcttttattcagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgcacgatggcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaattttaactgttaacacacggtgccagaccaggtggcttttctttggtgaatgtagtgtttcatctgaacacctcgggaagcagagacaaaccaacctgtggttgaactgcccttaacgtcaccactactaacgtctatgttgactgtattgtgttagaagcacattaacactccgtcacaatgcccgacccccaccccagtaattatccagacgcatggcccacctggcacacaggaaatggtagagctggaatgatgggactcctctcacaaatgtattcttcctttcctcctttcccgtccatcctttgctatgtacatggggggtttctaccaggtccagtagagcacaacaagacttagctcaggccttgaactgtgtttggttggttttctttgattgaattattctcagaagggctgtgttgccaggccctgtgggttgatcatgtgaccgcctttctgacaaaatgtctcccgccatctttatttgcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatagacagggtctcactatgttgcccaggctggcctcaaactcctgggctgatgttatcctcc

SEQ ID NO: 459486 - DNA, 3283 bp, Homo sapiens
gaatttagaggattccctggaactttccggggagaagtgtagaaaaaataactattgagtactagggggagcacctgactgacaaaataatctgtacgacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaattttaactgttaacacacggtgccagaccaggtggcttttctttggtgaatgtagtgtttcatctgaacacctcgggaagcagagacaaaccaacctgtggttgaactgcccttaacgtcaccactactaacgtctatgttgactgtattgtgttagaagcacattaacactccgtcacaatgcccgacccccaccccagtaattatccagacgcatggcccacctggcacacaggaaatggtagagctggaatgatgggactcctctcacaaatgtattcttcctttcctcctttcccgtccatcctttgctatgtacatggggggtttctaccaggtccagtagagcacaacaagacttagctcaggccttgaactgtgtttggttggttttctttgattgaattattctcagaagggctgtgttgccaggccctgtgggttgatcatgtgaccgcctttctgacaaaatgtctcccgccatctttatttgcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 459487 - DNA, 3284 bp, Homo sapiens
tttctttcaggtggcttttttttttttgtctgttcgccatgaaacccttctttcatactttctccctcaccttccaaacaacaacaactaggtatctaacagctaatcagttctgtttttgcctctgttgctgactggtgttgggtaaacacgaggctgctgggtcagccatgtgctgttgaaagctgttgaaatggttgctctgatactcacattaaaatccgtttgatcagtagtgagcagttgattctgtttgattcttctgattaaccccagttggtgtctcctagatctgtcctgcatgtagggctgtggcttctcaccttgagcttctctgcacatcgtggggcagcctcacagatgacctactcatgcgcttctccttctcttccccctctcactggtccttcccacagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaattttaactgttaacacacggtgccagaccaggtggcttttctttggtgaatgtagtgtttcatctgaacacctcgggaagcagagacaaaccaacctgtggttgaactgcccttaacgtcaccactactaacgtctatgttgactgtattgtgttagaagcacattaacactccgtcacaatgcccgacccccaccccagtaattatccagacgcatggcccacctggcacacaggaaatggtagagctggaatgatgggactcctctcacaaatgtattcttcctttcctcctttcccgtccatcctttgctatgtacatggggggtttctaccaggtccagtagagcacaacaagacttagctcaggccttgaactgtgtttggttggttttctttgattgaattattctcagaagggctgtgttgccaggccctgtgggttgatcatgtgaccgcctttctgacaaaatgtctcccgccatctttatttgcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 459488 - DNA, 5196 bp, Homo sapiens
catggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctaggtaaaaaagaagaaagccaatgaaaaaaataattcaatctgtttctcttttaatcattaagataattcattcattcaaatctgttttcttgtaatcatttcaaggctgaaaatattcacatctctatggatcatgggcgttatttttttgttttggggggtttggttgctttttttctttcctccttctggtaattcttggtcgaaagtaacactttggcccaagaaggtaaatgggcttcccagtgcatgtggcttcatggaccactcaccgtgcagtgcctgcaaccaccacccttgcgtgtccacgtcgccatcatctgaaagtcacaagtgagcctggctgcattccacccccagtgtcaggtgcacacctgggaagccttttccatcctggccaattgtgatgctgatgctaaaataccttcattgcttaatcccatcactgccaattgcttcaaatagtggatggaatgggctttaaaaaaaaaaaaaaaggcattttggaaactgcatagctgactctctttttcttttattcagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgcacgatggcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaattttaactgttaacacacggtgccagaccaggtggcttttctttggtgaatgtagtgtttcatctgaacacctcgggaagcagagacaaaccaacctgtggttgaactgcccttaacgtcaccactactaacgtctatgttgactgtattgtgttagaagcacattaacactccgtcacaatgcccgacccccaccccagtaattatccagacgcatggcccacctggcacacaggaaatggtagagctggaatgatgggactcctctcacaaatgtattcttcctttcctcctttcccgtccatcctttgctatgtacatggggggtttctaccaggtccagtagagcacaacaagacttagctcaggccttgaactgtgtttggttggttttctttgattgaattattctcagaagggctgtgttgccaggccctgtgggttgatcatgtgaccgcctttctgacaaaatgtctcccgccatctttatttgcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaaggctctaaaaaaaaaaaaaaaaaaaaaaaaaaaaccagatgtgttggagccgcccatcgggccctatgaaaaacgccttttcctacgaacccaccttcggttggggcgaccgggggaccccaaagtagtgatcacgtgcacccagtgccgcataagcgtgtccccacaggagaccccgggcaagaccatgcggggggcttcctcacacaatataaacccccgggggaaacgcgacggtgctggacaactccgat

SEQ ID NO: 459489 - DNA, 2641 bp, Homo sapiens
catggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctaggtaaaaaagaagaaagccaatgaaaaaaataattcaatctgtttctcttttaatcattaagataattcattcattcaaatctgttttcttgtaatcatttcaaggctgaaaatattcacatctctatggatcatgggcgttatttttttgttttggggggtttggttgctttttttctttcctccttctggtaattcttggtcgaaagtaacactttggcccaagaaggtaaatgggcttcccagtgcatgtggcttcatggaccactcaccgtgcagtgcctgcaaccaccacccttgcgtgtccacgtcgccatcatctgaaagtcacaagtgagcctggctgcattccacccccagtgtcaggtgcacacctgggaagccttttccatcctggccaattgtgatgctgatgctaaaataccttcattgcttaatcccatcactgccaattgcttcaaatagtggatggaatgggctttaaaaaaaaaaaaaaaggcattttggaaactgcatagctgactctctttttcttttattcagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgcacgatggcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcgccatcgtgcgcaggatggctcgcatcttgttttgtaaggttggaaattctcctttcagggtagctacagcctctcccacttgacgcaggaggaaagccccgtcttccacgtctttcaga

SEQ ID NO: 459490 - DNA, 2982 bp, Homo sapiens
catggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctaggtaaaaaagaagaaagccaatgaaaaaaataattcaatctgtttctcttttaatcattaagataattcattcattcaaatctgttttcttgtaatcatttcaaggctgaaaatattcacatctctatggatcatgggcgttatttttttgttttggggggtttggttgctttttttctttcctccttctggtaattcttggtcgaaagtaacactttggcccaagaaggtaaatgggcttcccagtgcatgtggcttcatggaccactcaccgtgcagtgcctgcaaccaccacccttgcgtgtccacgtcgccatcatctgaaagtcacaagtgagcctggctgcattccacccccagtgtcaggtgcacacctgggaagccttttccatcctggccaattgtgatgctgatgctaaaataccttcattgcttaatcccatcactgccaattgcttcaaatagtggatggaatgggctttaaaaaaaaaaaaaaaggcattttggaaactgcatagctgactctctttttcttttattcagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgcacgatggcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggaggtgaccgggccctcatcgtgctgggggtggcctgcggaggggtgcactgggaaaccgagagtggacgtttgggacttcagccttccaccatgctcccaggacacatccagtgtcctgaggaaaagccccaagtccttctcacccttgaacttttattgcaatatggcttgaggttctaattcttcaacacaggattgctaggtggagcccatcctagggtttaaaattaatagacacagtaaacattgttttaaaatcatctgaaaggccaggtgtggtggccactcaggaggtacaggcagaaggatcccttgagcccaggagtatgaggctgcagtgagctatgactgagccactgcactccagcctgggcaacagagaaagactccatttcttttaaaaaaatcatcggaaggtgggttttttaaaataacattttgaagttgaaaaattgattgaaatagtttattagcctccttcacttcaggggcatagat

SEQ ID NO: 459491 - DNA, 1493 bp, Homo sapiens
catggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccaggattgaagaaaagcagtaaagtggtacatctcaaggtagccctgaatgcacctctgctcttactgtcattcattttactccagcaccactgcggatagagtccctgtgggacgaatgaggacactgggcaactttcacctggggctgagcattcttccgaggaagtcattcatttcccaagagtgtgtgcaagtctgtgccccccatgtggcaggaagagtgaccaaccaccactcccattttttctgagatgctactgtgacttgggtcaataagcttgacattgctgatggatgttcactaacctgctttccttatttgaatttcttac

SEQ ID NO: 459492 - DNA, 718 bp, Homo sapiens
caatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccaggtaaggtgcagtgagggtgaccgagggtggtacctgggcccatgtgtcactgtgggcagctctacaggggtcaaaccgacagaataaatgtctgagcacccatctctgcagcatgtcctgtggatgctgcaggagtcacagagtggtgtcaaagccaccattgtctgcaaatagtttctaaattggcaggggttacagtcattaagccatgttcaagaagacaggtgcagcaacaatagtaatcagtcccttgtgcctctggagcatggatctaagagcattatcatttgtataaatctgaataatttggaagaaaattgtcattagcagaagacagatgaaaagatcaaaaggtcataataattgatctgctactgctg

SEQ ID NO: 459493 - DNA, 431 bp, Homo sapiens
attcatatatatgcatattttttgtaatgagagaattaggcctttttagaattaccagtcatctgcattgggatgggatgcatagcttagactttcctttgtggccttctgagttctctgatgcacttttctcataggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccaggtattcctcatgcacggcggcctctgtctcggttgccctgagctcttcctaccttccttttcctaggggctccgtgaagacctagagaatgtagaaccatagaaacagcatggcttcctctctcaca

SEQ ID NO: 459494 - DNA, 2061 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggcaggagaggagaggatcaggga

SEQ ID NO: 459495 - DNA, 1222 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttggtaagtgatgcctccgccctccagcagctctccccaccccagcctggccggcgctggcagacgcctatggggtaggagggcttgggcccccattaactacccttctctttttcttagcaaccaagacttagatgttcagaaaaagctctatgactgccttgagtgagtctggggttgggctcgggggccacgtgttgtttggtgaggggatggtgtatc

SEQ ID NO: 459496 - DNA, 1298 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtgagcccccattcagggcccggagaccgaggcggaggcccggggtggtgggattgacgccgctcgccgccgtcaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttggtaagtgatgcctccgccctccagcagctctccccaccccagcctggccggcgctggcagacgcctatggggtaggagggcttgggcccccattaactacccttctctttttcttagcaaccaagacttagatgttcagaaaaagctctatgactgccttgagtgagtctggggttgggctcgggggccacgtgttgtttggtgaggggatggtgtatc

SEQ ID NO: 459497 - DNA, 2041 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggca

SEQ ID NO: 459498 - DNA, 2394 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggcaaaaaaaaaaaaaaaaaaaaaaaaaaaatttgggggccgcctggccccaaaaattttaagacacacttccgctgttgtggggcggcggcggccccccagtgtaggttatcgtcgacccacgtgggcccatacagctggttcccccagaggagaatccgcgggcacaggacactagcgtggtctggtgttttcctcccccatattaaaaaaacgccccggggggcaaaccacgaagcctgttccggataaccattatcccaaatagggactcccgggaggccactctgcggggatcttattccacagggtgtccccaagcgagactcggatttatcaatttagcccgcccgtgga

SEQ ID NO: 459499 - DNA, 2118 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggaacccccaaagaggcatcgtgatggttctgccttccagtatgagtatgagccaccctgcacgtccctctgtgctcgggtccaagctgtcaggtgagtgcctgggtctgccccaactcttggtcactagtcccaggctccattgacctgcagcggtggtttctttccaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggca

SEQ ID NO: 459500 - DNA, 2250 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggtgagcatagcccctctgcagctggagggtagaacaaggaaggcctgaggtagagctgggagggagcatgggtagccttggatggggttggggtccttgttagctcttccccagacaccatacccctttcaggaacccccaaagaggcatcgtgatggttctgccttccagtatgagtatgagccaccctgcacgtccctctgtgctcgggtccaagctgtcaggtgagtgcctgggtctgccccaactcttggtcactagtcccaggctccattgacctgcagcggtggtttctttccaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggca

SEQ ID NO: 459501 - DNA, 2193 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggtgagcatagcccctctgcagctggagggtagaacaaggaaggcctgaggtagagctgggagggagcatgggtagccttggatggggttggggtccttgttagctcttccccagacaccatacccctttcaggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggcaggagaggagaggatcaggga

SEQ ID NO: 459502 - DNA, 2002 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctggtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggca

SEQ ID NO: 459503 - DNA, 2117 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtgagcccccattcagggcccggagaccgaggcggaggcccggggtggtgggattgacgccgctcgccgccgtcaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggca

SEQ ID NO: 459504 - DNA, 1463 bp, Homo sapiens
actagttccagagtcgggagcgtgctgcccttcttggaattcgagagagactgattctgaaggtcagagacaccctccagataccacagagaccgagcagactgcattgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggca

SEQ ID NO: 459505 - DNA, 2015 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgagggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttggtaagtgatgcctccgccctccagcagctctccccaccccagcctggccggcgctggcagacgcctatggggtaggagggcttgggcccccattaactacccttctctttttcttagcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggca

SEQ ID NO: 459506 - DNA, 1707 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggca

SEQ ID NO: 459507 - DNA, 400 bp, Homo sapiens
tcagggtgaggagttgggcaagggtcatatcccacaggacatgagagtaaacgggcctgtcctacagagttcatgtcccacagggagaagctgtgtacactgtccccagctcaatgctgtgcatctctgagaatgaccagctaattctgagctctctaggcccctgtcagaggacacagggtaagggggactggagaggttggggggatacctggggcccaggtccacagtgctgataagacttcctgaaccccccaggccctgagctgcccccaccagacccggctctgcaggacctatctctgaccctcatagcctctcctccttcctcacccagttcctcaggtgaggtgatgcacaggtcacaggcactcactgccgcctgtcagtcaggttcccg

SEQ ID NO: 459508 - DNA, 336 bp, Homo sapiens
  misc_feature (258)..(258): n is a, c, g, or t
tgacataaagtgccttttgacatcaactattcaatacctttgagactcacttagacaactggactcattgtaggttccacagaaaaacacggacaacattctagttgtcactccaaccagccacactaggagggcacagcctctggtaccctttctgttcctgaaggcatgtacagcggcttctacagcaagcttgcttacctcccaggattcacctcatggtttggacactgattcctgagagagccttgagacacncaaagtgaaaaaaatgtcaagcaggaatgaggcagctctaggatctatactgtagctaataaaatgtaaaaacacctg

SEQ ID NO: 459509 - DNA, 900 bp, Homo sapiens
  misc_feature (51)..(52): n is a, c, g, or t
ggtttattactactgaaggaagaacgtgagtaggttaggatttcggcacgnngagaggcttggggtcttgcgtttcgcccaccatctcctggggacagggtggagtcgatatccgggacgggggggaggttgcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctgaaaaaaaaaaaaaaaaaaaaaaaaaaaaaaaaaaaaatcgggggctttttttggggggggggaaaaaagggggtttaaaagtggggctcgggcataggggtttttcggaacccattttttttttacaaggtgggtaaaatgcgggggcccccaaaggg

SEQ ID NO: 459510 - DNA, 742 bp, Homo sapiens
  misc_feature (51)..(52): n is a, c, g, or t
ggtttattactactgaaggaagaacgtgagtaggttaggatttcggcacgnngagaggcttggggtcttgcgtttcgcccaccatctcctggggacagggtggagtcgatatccgggacgggggggaggttgcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctg

SEQ ID NO: 459511 - DNA, 1237 bp, Homo sapiens
  misc_feature (51)..(52): n is a, c, g, or t
ggtttattactactgaaggaagaacgtgagtaggttaggatttcggcacgnngagaggcttggggtcttgcgtttcgcccaccatctcctggggacagggtggagtcgatatccgggacgggggggaggttgcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctggctctgtttcctgaccaggcacttctgtcatatccccacagccccttccaccttaacacacaccacctgtattaccccctcaggttcaaactcttgcacttggaatctctttgtggcacagtgttctttcttgaaagtgaaatcctaaatgtcttcaaacctacttcttgcctgtatatacaacccttaactctccctcatcttggttggcatgattcttttggaagggcatttgcaacataccatattgctaggaatgtcggtttaattgaaaaagaatacacagttctctaacctgaggccccaggatgaaatgtggttaccctccttgccaacagccctggcatctctattagtacttttcagcctctgtcttcctagaatttgcttgaatgtagctttaaactgacttaaaatcccagcatgtaatgctttatggtattataagtcctcccaagtttatatgttgtccataaagttgttctgcccaattcc

SEQ ID NO: 459512 - DNA, 1163 bp, Homo sapiens
  misc_feature (51)..(52): n is a, c, g, or t
ggtttattactactgaaggaagaacgtgagtaggttaggatttcggcacgnngagaggcttggggtcttgcgtttcgcccaccatctcctggggacagggtggagtcgatatccgggacgggggggaggttgcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaatc

SEQ ID NO: 459513 - DNA, 862 bp, Homo sapiens
ggtttattactactgaaggaagaacgtgagtaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaatgtgagtttttattccaccaccgtgtgctgcaccctgtgatgcaagtgaaccattggagtagaggtgttgaaccattgcagaacagctctccatagtggcccctagtcctccagttcctccaaccctttccttcccttttaaccccccttcttctccctcccctggatctcaagttttccacctatctctttcttgcgtttagcactctccatagtgagtcctactaatttctccctttctgcttgtctcccttgtctctccttagtaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctg

SEQ ID NO: 459514 - DNA, 1357 bp, Homo sapiens
ggtttattactactgaaggaagaacgtgagtaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaatgtgagtttttattccaccaccgtgtgctgcaccctgtgatgcaagtgaaccattggagtagaggtgttgaaccattgcagaacagctctccatagtggcccctagtcctccagttcctccaaccctttccttcccttttaaccccccttcttctccctcccctggatctcaagttttccacctatctctttcttgcgtttagcactctccatagtgagtcctactaatttctccctttctgcttgtctcccttgtctctccttagtaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctggctctgtttcctgaccaggcacttctgtcatatccccacagccccttccaccttaacacacaccacctgtattaccccctcaggttcaaactcttgcacttggaatctctttgtggcacagtgttctttcttgaaagtgaaatcctaaatgtcttcaaacctacttcttgcctgtatatacaacccttaactctccctcatcttggttggcatgattcttttggaagggcatttgcaacataccatattgctaggaatgtcggtttaattgaaaaagaatacacagttctctaacctgaggccccaggatgaaatgtggttaccctccttgccaacagccctggcatctctattagtacttttcagcctctgtcttcctagaatttgcttgaatgtagctttaaactgacttaaaatcccagcatgtaatgctttatggtattataagtcctcccaagtttatatgttgtccataaagttgttctgcccaattcc

SEQ ID NO: 459515 - DNA, 973 bp, Homo sapiens
  misc_feature (51)..(52): n is a, c, g, or t
ggtttattactactgaaggaagaacgtgagtaggttaggatttcggcacgnngagaggcttggggtcttgcgtttcgcccaccatctcctggggacagggtggagtcgatatccgggacgggggggaggttgcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagagttaaacttctgggtccggtgctagtcaaacaggagctgggggaggctcgggccacagtagggaagaggctggactatatcacagctgaaatgtgagtttttattccaccaccgtgtgctgcaccctgtgatgcaagtgaaccattggagtagaggtgttgaaccattgcagaacagctctccatagtggcccctagtcctccagttcctccaaccctttccttcccttttaaccccccttcttctccctcccctggatctcaagttttccacctatctctttcttgcgtttagcactctccatagtgagtcctactaatttctccctttctgcttgtctcccttgtctctccttagtaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctg

SEQ ID NO: 459516 - DNA, 1094 bp, Homo sapiens
  misc_feature (51)..(52): n is a, c, g, or t
ggtttattactactgaaggaagaacgtgagtaggttaggatttcggcacgnngagaggcttggggtcttgcgtttcgcccaccatctcctggggacagggtggagtcgatatccgggacgggggggaggttgcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagagaaagaggtgagggactgggatttgtggggcgaggagggacctgtactagccatggttctgatcacatatgtcccatccctccatcaggaactggccctgctggatgggtccaacgtggtctttaaacttctgggtccggtgctagtcaaacaggagctgggggaggctcgggccacagtagggaagaggctggactatatcacagctgaaatgtgagtttttattccaccaccgtgtgctgcaccctgtgatgcaagtgaaccattggagtagaggtgttgaaccattgcagaacagctctccatagtggcccctagtcctccagttcctccaaccctttccttcccttttaaccccccttcttctccctcccctggatctcaagttttccacctatctctttcttgcgtttagcactctccatagtgagtcctactaatttctccctttctgcttgtctcccttgtctctccttagtaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctg

SEQ ID NO: 459517 - DNA, 860 bp, Homo sapiens
ttttctgcttcctcagatccatatccacctgactaggattgtggggataggtggcacatttgatgtttctaaattgcctttcctctcatccccagacttaagtaaatccatgtcggggaggcagaaacttgaagcacaactaacagaaaataatatcgtgaaagagaaagaggtgagggactgggatttgtggggcgaggagggacctgtactagccatggttctgatcacatatgtcccatccctccatcaggaactggccctgctggatgggtccaacgtggtctttaaacttctgggtccggtgctagtcaaacaggagctgggggaggctcgggccacagtagggaagaggctggactatatcacagctgaaatgtgagtttttattccaccaccgtgtgctgcaccctgtgatgcaagtgaaccattggagtagaggtgttgaaccattgcagaacagctctccatagtggcccctagtcctccagttcctccaaccctttccttcccttttaaccccccttcttctccctcccctggatctcaagttttccacctatctctttcttgcgtttagcactctccatagtgagtcctactaatttctccctttctgcttgtctcccttgtctctccttagtaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctg

SEQ ID NO: 459518 - DNA, 893 bp, Homo sapiens
  misc_feature (51)..(52): n is a, c, g, or t
ggtttattactactgaaggaagaacgtgagtaggttaggatttcggcacgnngagaggcttggggtcttgcgtttcgcccaccatctcctggggacagggtggagtcgatatccgggacgggggggaggttgcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagagaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaataaaaaaaaaaaaaaaaaaaaaaaaaccttgtggcccccttggcccaaaggacttttaaactgggcaaactttttgaatgcgccccaatttgggcctaattgggccaattccccttatggggaggggtttaaaaattaatgggccgatgtttacaacaactgggcttggaaaacccttgggttcccccatctaaaccgcttgaaccaaatccccttttccacagtggccaattgccaaaggcgccgacttatgccctttcaaaaatttgccccctcaaatggataatggaatttaagggtaaaattttttaaaaaatccgcgaaaatttttgtaaaaccggctatttttaacccatgggcccaattggaaaaacccttttaactaaaaaatttcccccg

SEQ ID NO: 459519 - DNA, 415 bp, Homo sapiens
  misc_feature (51)..(52): n is a, c, g, or t
ggtttattactactgaaggaagaacgtgagtaggttaggatttcggcacgnngagaggcttggggtcttgcgtttcgcccaccatctcctggggacagggtggagtcgatatccgggacgggggggaggttgcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaagggggtaagggaacagggtcggtatggtctcgcccaatgcacttacaacccaaagccattaccgagataaggtttgttgccccatctg

SEQ ID NO: 459520 - DNA, 486 bp, Homo sapiens
  misc_feature (51)..(52): n is a, c, g, or t
ggtttattactactgaaggaagaacgtgagtaggttaggatttcggcacgnngagaggcttggggtcttgcgtttcgcccaccatctcctggggacagggtggagtcgatatccgggacgggggggaggttgcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggccctggcatctctattagtacttttcagcctctgtcttcctagaatttgcttgaatgtagctttaaactgacttaaaatcccagcatgtaatgctttatggtattataagtcctcccaagtttatatgttgtccataaagttgttctgcccaattcc

SEQ ID NO: 459521 - DNA, 417 bp, Homo sapiens
atctgagtggcaactgcctgaagcagtaggggaaggactggaggaagggagtgcaattgaagtgagtggtgacaacctgcaagtgataagggggtgggtatggtagatacatgagagaagagtacacaaggtttagtgattatgctgtgggaaggggaggaaccagaggtgattctgaagtttggaactgagcgactgagagaatgataaaaatagggaaatcaaaattggaagtcagtagggtatgggatagggtaggtcagtgagtagcgtagttgatggacatgaacaggaagagtagaacagtgtcaggaggctgaggccggagaatcacttgaacctgggaagcagaggttgcagtcagctgaggtggcgccagtggactctggcctgggggacagagcaagattctgtctc

SEQ ID NO: 459522 - DNA, 1872 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatg

SEQ ID NO: 459523 - DNA, 1193 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcag

SEQ ID NO: 459524 - DNA, 3405 bp, Homo sapiens
  misc_feature (1323)..(1323): n is a, c, g, or t
  misc_feature (1418)..(1419): n is a, c, g, or t
  misc_feature (1587)..(1587): n is a, c, g, or t
  misc_feature (2614)..(2614): n is a, c, g, or t
  misc_feature (2689)..(2689): n is a, c, g, or t
  misc_feature (2997)..(2997): n is a, c, g, or t
gtgatttttatgaacgcctgtcttagtagcagcattgtagagtggctggagcactggactgactaggaacctgatgacttcagctgtagtccagctttgccaccacttcaagtcatttaaccagtctgctcctccgtttctccatctgtcaaatgggagctttagacaagatgatctcaaatttccttcccactctaacagttacgatttctacagcaaatcttgtgagaaggaaatgccagcccagtaccatttcataaaaagcagctcaaaggaaatagatctgtgcttgtttctaccaatcttggcagaaatacattagcttgtcccaattttgctttggtgattggatcctgcccttccctcctttctattttccctatacttttctaatcattaggtaaactggcagttgaggatacaatttccacatcacagagaggaactagtcaggtgataaatgattaaagtgacagtggttccctgtgtgattgtgatgtaatccctcctggtgagtctccatcctgccggttgatgctcaagtctgtttcactactcttttgtgtgtctcacagcccatagctcagctgtgagctgcaatgactctgcacatctttttttccctttgggaatgcataacatccatgaaagccacatgctttgcatatagtggaggcccagtgatggttgttggaattcaaagtagtaaaggctctagaattgttggaagaatctggaaagcagattcttcccaggaaataggcatgatggggtgtgaaaggaaggttgccacaagggaaaatggctagacttgtgcaaaagaatgaatggacaaaagatcaccaaggggttttggtcccattacgaagtgagtgtttaactagtagagccactgagatggaagatacaccttacttcttgggaagtagtgagttcccatcgccagtggtttgtagataacagaccctgtttcagtccacttggaagagatactgtagcaggaattcttaagcaggattgaacgtataataagcaagatctcttccacctctaaaattctctggttgtgggtattgagagctacataataataatagcacctgacatttttcacatttctggagcatttactatgcaccaggaactgttcaagactttccatttaatcctcacaacagttgcataggtaggtgctgttattattcctccctcatatatgaggagactgcagcacagcacctaagattgcatggctgtgggtagtggaggtagaattggaacccaggctttggctgtcaggctacactctcaccctgtgtactnccgcccgagcagagcagtgtaccatcagcctcggcatccatggatttcaccaaccatggaccaaagatatttggaaaaaaaaaatgcaacaatannaacaataatacaaaatatatatatatatgtgtatatatatagcatatatatatattttgtattattgtttttataatatatatagcatatatattatatatgctaaaatatatatatagcatatatatacacacacatatatatatatacacatatatatatatatanacacatatatatatatatatatatatacacatatatatatatatatggccaggcacagtggctcatacctgtaatcccagcactttggaaggccgaggagggaggatcacttgaggccaggggctcaagaccagcctggtcaacatagcaagaaaataaaaaataaattctacaaaaaaatttttttaaatagagtataataactatttatatagtgtttacattgtcttagatattataagtaatttagagatgatttaaagtatacaggaggatgtgcataggttatttgtaaatactataccattttatatcagagatttgagcacctgcagatttcagtgtccatggacagtcctggaaccggtaccctgtggatactgcaggaggtctgtacttttttataggaaggtcaaaatctcaaactgagatggcactcctttattctgctgtagaactgtaatttgggatgtcagtgtgggattcaggaagtatcatgaatgactgctatgtaatttttctttatattcctatccttctagataatttttcattattttctagtcatggaactatatctttgttaaacttattggaaataaaatacccaagaatttttgctctctttctctctttatcagattaatagaactgaatctctgacattccaaattaatcctgctctttaaagaaattttcttttaggctcttcattacaaactattcttgctgatcaaattccacgtaatgtctgaggaaaacagattccactggcagttgcttttgttacatttgagtggagaaatttccttggtcattacaccaaaatattgaccagaaaggtcctgttgctcctcaacttcaggggaaacaatagggttcaggtctgaaactcagacttgtttgagaaagataatgtgctttctttccttcttagggtgtgagatgaactagaacatttcaatatcttgagcgtccaacaaaatgctacttgggcaatctgagccaatgattatgccaagttctntgtaggagaggaattggcttgaaaactttatcttctttctcagtgtatctatggtggaagaacactggatcaagnaactctaaataataattcttggagcagctatttcaaatcttattcttacatgctaatagaaaaaagataggattattatttcctccctcactcagaatgcagtgataactaccaaataaaccaatgtgaaagagtcagttgtcttggacaccatctctacttcagataaatctgggtgcatagcttgagccagtaatttgggctaaagtgtgtttcggacttagaaatttgtgcaatagtcaactgtctaaagcagtgttgttcaaatagaactataatgtgagacacacaagtattttaaaattttntagtagctaccttaaaaaagtaaaaagaaatgtgaaattaattttaaggacttaacccaatatgttgcaaaatataatttcaacatgtattcaatataaaaattattagatattttaggctgggcacggtgactcacgccagcactttcggagtaatcccagcactttcggaggccaaggcgggcggatcacaaggtcaggagatcgagaccatcctggctaacacggtgaaaccccgtttctactaaaaatacaaaaattagctgggcatggtggccggtgcctgtagtcccagctatttgggacgctgaggcaggagaatggcgtgaacccggagggcagagcttgcagtgagccgagatcgcgccactgcactccagcctgggcaacagagcgagactccatctc

SEQ ID NO: 459525 - DNA, 477 bp, Homo sapiens
gatggctgcaattttttttctttggagtgttctattgatacaatgtttttatttttcagctgaccatctgcctcttgagagagagagaagtgggcatccttcctttaaattcaggaaccactgttgttttatttgactttttctgttacttgcatcccttatataagttgttttggatttgggactatgttttgggggagaaaaactccagttagttctgttttttgtattggttattcagcttacttttggtatcaaaattatgccagttttaagctcacttgagtgaagtttaagtcacaagattctgtttaacatgctttccttgttttggaaacaaccaaaaacttcccttttttgttacgggattttgacctacaaatcctaatcatgtttaaaatgtgccggtgttgggtagatgacttttctgcctctggggttcaatttatatttaaagataccttaaaataaaaaaat

SEQ ID NO: 459526 - DNA, 469 bp, Homo sapiens
tttaaactttataatcatgactaataaaaaatactgatgaattgaactgatgtctgagagacattgacacattctctgatttttcttttgtggttatgtggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacaggtacatcttgggattttggggggacatgaatggatgaggagatagcaggatccatcccaggtaaatttaaaggccaaatgttttggggattttttagttgtggggcttggtcctctattgcctaaaaggtgtgatattcttgtcctctgagaatttttctgagaatattcttc

SEQ ID NO: 459527 - DNA, 5581 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttgggggttgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacatta

SEQ ID NO: 459528 - DNA, 5864 bp, Homo sapiens
  misc_feature (5645)..(5646): n is a, c, g, or t
  misc_feature (5649)..(5650): n is a, c, g, or t
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttgggggttgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacattaaaaaaaaaaaaaaaaaaaaaaaaaaaaaaaaaaaaaaaaaaaaaaaaaaaaaaaaaaaataaannggnnaaaatttagggttgcggcccttttgccccttttttttttttttttaacaattttttgtgcggggcctaaatgggccttattgggaaaacccgccttttggggggtttattcacattccaacgcggcccgttttccaaggggaggtgaggaaaaaccgggggttccccaattaatattccttagagaaaatctcctttttgggagtgggatataa

SEQ ID NO: 459529 - DNA, 5866 bp, Homo sapiens
  misc_feature (5785)..(5785): n is a, c, g, or t
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttgggggttgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacattaaaaaaaaaaaaaaaaaaaaaaaaggggggggcgaaaaattcccccggagggccccaggttgtcggttacccgctttcttggtcacagggggccccatatgggggggcgatttaattaaggctgaggcggggccgcgtcttttcaccacgtcgtgcccgggacacatgtgcatcctggcaccttggggagagacctttactcggnggggggccactattggccacgtttcctcggaatttaaggccgaggcattttactttcacgtgttcgcggttcacgcacgtt

SEQ ID NO: 459530 - DNA, 6614 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttgggggttgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacattatttgtgtgcccttttttgtgagttctttttagtcactgcttggtttgcatatgtacacgtgcttactggataaaagaaatagggataagagtctcatgctttcctgcctcgtgtggtagacttcaaatggctgccgtctgggttacaccagtttctcaaagatacgtgccatgtggtgtcctgtacttcacatatcatgttatcaccctttttcccccatgcctgtccctgtccaccctgccaattcatgtgccttggtgcccagctgaggcatcgtcttcttcactggcctcctcttccctgctgctgctcaccctcccgtcgagctcgaggaagtcaccccattaactgacacactgctgttctttcacagcttgttgtagagaagctccttttcttttcttaagccattaagaatcaaatttgaatctgaacctttcttttttctcttctgtagcttcttctttatgtaaccatcctgttgacaagccctactctctcctaatggacatagagcattagaagagcaggagctgtctgttcacacgtgttggggaagagttacctcatttccaccatcgcctcctgttcttttaaagtctgggtcaaatattgcactgctgtttgtacttgtcaatgtctgcccatagtggatactgaagtgacttaccactaccaaaaatagtcatattcaataatattaattaaaaaggaaaaaggaaattgactgaaacagaaaacgtgggccaagacccaaggtcttgtgctgggatccccttgcttagaactatcatgttcttgaagctgctgatccaagaactgatggactgaagacagcgtgtaccctaacctgagggggccaccacacccagggcccacaaacttgatctcatggtaactcctgtcctttctgtcccatgagccacattctgaacagcctgatcaggatcctcaaccgtcaggtcataagatccgagcaacattttccttccttttgttagttttatgggttgttttggtgtttggggttttt

SEQ ID NO: 459531 - DNA, 5527 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttgggggttgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccattatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacatta

SEQ ID NO: 459532 - DNA, 5442 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttgggggttgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttttcccatcctcgtgttatccactctccatggtattatattttggccatttaggcaatctgtttgttggcccctagccgcagtcctcttcattttatcgttattcggagggcaacccgttttttcccc

SEQ ID NO: 459533 - DNA, 5464 bp, Homo sapiens
ggaagatcaagcgcatggcaggcatgaaggaatcgcagatcagcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttgggggttgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacatta

SEQ ID NO: 459534 - DNA, 5351 bp, Homo sapiens
tttaaactttataatcatgactaataaaaaatactgatgaattgaactgatgtctgagagacattgacacattctctgatttttcttttgtggttatgtggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttgggggttgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacatta

SEQ ID NO: 459535 - DNA, 5485 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttgggggttgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacatta

SEQ ID NO: 459536 - DNA, 4221 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatctgaccatctgcctcttgagagagagagaagtgggcatccttcctttaaattcaggaaccactgttgttttatttgactttttctgttacttgcatcccttatataagttgttttggatttgggactatgttttgggggagaaaaactccagttagttctgttttttgtattggttattcagcttacttttggtatcaaaattatgccagttttaagctcacttgagtgaagtttaagtcacaagattctgtttaacatgctttccttgttttggaaacaaccaaaaacttcccttttttgttacgggattttgacctacaaatcctaatcatgtttaaaatgtgccggtgttgggtagatgacttttctgcctctggggttcaatttatatttaaagataccttaaaataaaaaaat

SEQ ID NO: 459537 - DNA, 3853 bp, Homo sapiens
  misc_feature (3843)..(3843): n is a, c, g, or t
  misc_feature (3848)..(3848): n is a, c, g, or t
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaaaaaaaaaaaaaaaaaaaaaaaaaaaacaaaaaaaaaaaaaaaaaaaaaaaaaaaaaaaaaaaanaaaanaaaaa

SEQ ID NO: 459538 - DNA, 2626 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaac

SEQ ID NO: 459539 - DNA, 2700 bp, Homo sapiens
  misc_feature (2690)..(2690): n is a, c, g, or t
  misc_feature (2695)..(2695): n is a, c, g, or t
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacaaaaaaaaaaaaaaaaaaaaaaaaaacaaaaaaaaaaaaaaaaaaaaaaaaaaaaaaaaaaaanaaaanaaaaa

SEQ ID NO: 459540 - DNA, 2404 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactgctgaccatctgcctcttgagagagagagaagtgggcatccttcctttaaattcaggaaccactgttgttttatttgactttttctgttacttgcatcccttatataagttgttttggatttgggactatgttttgggggagaaaaactccagttagttctgttttttgtattggttattcagcttacttttggtatcaaaattatgccagttttaagctcacttgagtgaagtttaagtcacaagattctgtttaacatgctttccttgttttggaaacaaccaaaaacttcccttttttgttacgggattttgacctacaaatcctaatcatgtttaaaatgtgccggtgttgggtagatgacttttctgcctctggggttcaatttatatttaaagataccttaaaataaaaaaat

SEQ ID NO: 459541 - DNA, 1880 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaactgaccatctgcctcttgagagagagagaagtgggcatccttcctttaaattcaggaaccactgttgttttatttgactttttctgttacttgcatcccttatataagttgttttggatttgggactatgttttgggggagaaaaactccagttagttctgttttttgtattggttattcagcttacttttggtatcaaaattatgccagttttaagctcacttgagtgaagtttaagtcacaagattctgtttaacatgctttccttgttttggaaacaaccaaaaacttcccttttttgttacgggattttgacctacaaatcctaatcatgtttaaaatgtgccggtgttgggtagatgacttttctgcctctggggttcaatttatatttaaagataccttaaaataaaaaaat

SEQ ID NO: 459542 - DNA, 1948 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatagtccttggctctgcacggaataaatgataccctcaaatctaattggatgtgctttcgcctttgcatctgaccatctgcctcttgagagagagagaagtgggcatccttcctttaaattcaggaaccactgttgttttatttgactttttctgttacttgcatcccttatataagttgttttggatttgggactatgttttgggggagaaaaactccagttagttctgttttttgtattggttattcagcttacttttggtatcaaaattatgccagttttaagctcacttgagtgaagtttaagtcacaagattctgtttaacatgctttccttgttttggaaacaaccaaaaacttcccttttttgttacgggattttgacctacaaatcctaatcatgtttaaaatgtgccggtgttgggtagatgacttttctgcctctggggttcaatttatatttaaagataccttaaaataaaaaaat

SEQ ID NO: 459543 - DNA, 2038 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaacttcttctttatgtaaccatcctgttgacaagccctactctctcctaatggacatagagcattagaagagcaggagctgtctgttcacacgtgttggggaagagttacctcatttccaccatcgcctcctgttcttttaaagtctgggtcaaatattgcactgctgtttgtacttgtcaatgtctgcccatagtggatactgaagtgacttaccactaccaaaaatagtcatattcaataatattaattaaaaaggaaaaaggaaattgactgaaacagaaaacgtgggccaagacccaaggtcttgtgctgggatccccttgcttagaactatcatgttcttgaagctgctgatccaagaactgatggactgaagacagcgtgtaccctaacctgagggggccaccacacccagggcccacaaacttgatctcatggtaactcctgtcctttctgtcccatgagccacattctgaacagcctgatcaggatcctcaaccgtcaggtcataagatccgagcaacattttccttccttttgttagttttatgggttgttttggtgtttggggttttt

SEQ ID NO: 459544 - DNA, 1778 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaagaagaagaagaagaagaagaagaagaagaagaagaagaagaagaagaagaagaagaagaagaaagaacgaagaagaaagaagaacgaagaacgaagacagaacgaagaagaagaacgaaaaaaaaacaaggggggcggccgcaccatcatcaccttaatcaagcaacaacgtaaggtatacaaaagaaacagaagagataccaacaaacaagagaaccagaaaagcgcggacaacgtacgacaaagtacgaccgcacaacgcaactagatggaaaaaaccagccaccgacaaggagactgaggggcaccaagaagcacaacgaacgaagaacaagacccgagacaggagatgaggaacacccagcacagcagaaacacaaaagcaaaaaaaacagacaacacacaaacaaagaggtggggaaataaaaacccg

SEQ ID NO: 459545 - DNA, 647 bp, Homo sapiens
aaggagtggttggtcattcaaagaataagttcctttgttatcactatttgtcatagaagagtaacacttcctttactctgtaaagaaaaatgaggtagcataggagaggaaattacaagtatactttcagtgcaggatgggaggaagtaaaagtgtttgaatatggaactaaaagtttatctcaggtcttcttaatttttcacctaggtagaaagtctgattttcattatcatctctaccccaaaaaaaaaaaaattgtaggtacataggaggcgtatatatttatggggtacaatgagatgttttgatataagtaggaaacatctttattttttacagtaaggttttgcaatttttatttgtttgctatgttttattcacttgtctatttttcttatgttggaattgtgtaaaaatggacgtgtctgttttacaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtaagtcctcaagtcaaatgggaacaagtgatttttatgaacgcctgtc

SEQ ID NO: 459546 - DNA, 3659 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaagtaagcaggtgtcacccccctgtatcggggacctctaacaatttattcctcttgcatgtctctacttttcccatttacagactggaaactggtcctttaccagaaagataaaagcaagtattttctctacagtgcagggaagatgatgaaggtttttaaatttttttaaaaggtacacaaagattaatttataaaactttaccacaattgaccaagcaatcaggcctggaggaacctgttgtctccagtagcatcttccacaccaacactaggagtctcaaagaagacaggttgatgtctcttcagcaccctctgaagacaattctcatgactcttgatagagagcatcctaaaatcacaattgttaaaattattttcctattctgtgttgtaagacttcgtaagccagtcactgaaattctcgttcccaaaatgaaacatttggaagagctgctagtggccactagtttcctcaaaattcaatatgatgaattgttttattgtgaaatgggatccaaatgcctatccagttgacacctctgccaacctcaagccaaacctaaacccattcataaaaggttttttttaaatagggtcttaatgtcatgtgccaaagggtcagattctgctcttgagttggtcacttcctgtgatactccagtagcagctgcctgaaaccagtgggagatttaggcctcccttgacattctcctgtgatttgaagctctcctttgaatcatcataaagcctagttttatgtcaatgctatcggttttgacaggaagcacgatggtaagaataccactaacgaaaacctttgtggtgtctcaatgacaaatatgcagatgccaccctcctttgtctaatgtacggtgctttagggcagctatttaatataaagcaactcagaacttgtttcaggaagtgttgctctttcgccttacatgccaaggttctagggaaaaagctgaccatatgtaaaaacattgatgctcaagcacataaagaattacattctttaaacatagagtacataggatcaagtctctgcacaataattgagatgtgttatagggaaaagtgagcacagtgctattgtccacttagtcttggtgaatgtgcagtaggctcacccctaaggaatctcatgttgcctgcagtaaaaataaaaatggactgctacaatgacatactgagagagttttaaatcatgctttacaaactgacattctgagctctgagacagcagaaaatgtatcaccagagcaagggaggaggcaaatgttctgaacaataattgaaatggttgtgattttatttggagttggcacagatccaagtgaccaaaggagttcaaggcccaaaatttagttatgctggattaattctgagagtaacaagcacatagattataatctaagaaaaccctttgtagctatgcatgtcgggagagcatctaacactaatggtgatgtttcccatgcagagactcagattacagtgactcttccagtgaagacagatgaaagccattgggcattgtacctttgttaatccaagctaaactaaccaaggatataggggtgtgtatgtgtctgtgtgtgtgtgtttgtgtgtgtgtacacatacatctataggtatgaatgagacaaaaagctgctgacttacagcttaggaaatgcaaagtcaagtttttcttttcaccctgaggcactcagtgcataaaggttcaagttttaaaactaagaatgtttccaaaagaccagcaatgttaaaagagtatttcgtgtatactagacgtgcctttaagcaataaaaattccaagagctgatcattattgtgcttccattttagaaaagtttatttagtaacaaacttcccagtgtagggaggtttttccttgcccttttgaacatgttaggttattttcttcctatcctggggccttaccaatgtgtaatgctttcaaagtttctatgaagcctgtgtggattctattttagcttatttatatattctcatttattttgaaggatattatacttaatttggttcagagtagtcgccaggttttgcacctgacaatggcacatattttttgtataactttttctaggtccttacccttttccacactttacatttgtacagtgaaagcaactgccagtggaggcctgaaatgtccaagaaaaaaaa

SEQ ID NO: 459547 - DNA, 3294 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaagtaagcaggtgtcacccccctgtatcggggacctctaacaatttattcctcttgcatgtctctacttttcccatttacagactggaaactggtcctttaccagaaagataaaagcaagtattttctctacagtgcagggaagatgatgaaggtttttaaatttttttaaaaggtacacaaagattaatttataaaactttaccacaattgaccaagcaatcaggcctggaggaacctgttgtctccagtagcatcttccacaccaacactaggagtctcaaagaagacaggttgatgtctcttcagcaccctctgaagacaattctcatgactcttgatagagagcatcctaaaatcacaattgttaaaattattttcctattctgtgttgtaagacttcgtaagccagtcactgaaattctcgttcccaaaatgaaacatttggaagagctgctagtggccactagtttcctcaaaattcaatatgatgaattgttttattgtgaaatgggatccaaatgcctatccagttgacacctctgccaacctcaagccaaacctaaacccattcataaaaggttttttttaaatagggtcttaatgtcatgtgccaaagggtcagattctgctcttgagttggtcacttcctgtgatactccagtagcagctgcctgaaaccagtgggagatttaggcctcccttgacattctcctgtgatttgaagctctcctttgaatcatcataaagcctagttttatgtcaatgctatcggttttgacaggaagcacgatggtaagaataccactaacgaaaacctttgtggtgtctcaatgacaaatatgcagatgccaccctcctttgtctaatgtacggtgctttagggcagctatttaatataaagcaactcagaacttgtttcaggaagtgttgctctttcgccttacatgccaaggttctagggaaaaagctgaccatatgtaaaaacattgatgctcaagcacataaagaattacattctttaaacatagagtacataggatcaagtctctgcacaataattgagatgtgttatagggaaaagtgagcacagtgctattgtccacttagtcttggtgaatgtgcagtaggctcacccctaaggaatctcatgttgcctgcagtaaaaataaaaatggactgctacaatgacatactgagagagttttaaatcatgctttacaaactgacattctgagctctgagacagcagaaaatgtatcaccagagcaagggaggaggcaaatgttctgaacaataattgaaatggttgtgattttatttggagttggcacagatccaagtgaccaaaggagttcaaggcccaaaatttagttatgctggattaattctgagagtaacaagcacatagattataatctaagaaaaccctttgtagctatgcatgtcgggagagcatctaacactaatggtgatgtttcccatgcagagactcagattacagtgactcttccagtgaagacagatgaaagccattgggcattgtacctttgttaatccaagctaaactaaccaaggatataggggtgtgtatgtgtctgtgtgtgtgtgtttgtgtgtgtgtacacatacatctataggtatgaatgagacaaaaagctgctgacttacagcttaggaaatgcaaagtcaagtttttcttttcaccctgaggcactcagtgcataaaggttcaagttttaaaactaagaatgtttccaaaagaccagcaatgttaaaagagtatttcgtgtatactagacgtgcctttaagcaataaaaattccaagagctga

SEQ ID NO: 459548 - DNA, 2857 bp, Homo sapiens
tgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaagtaagcaggtgtcacccccctgtatcggggacctctaacaatttattcctcttgcatgtctctacttttcccatttacagactggaaactggtcctttaccagaaagataaaagcaagtattttctctacagtgcagggaagatgatgaaggtttttaaatttttttaaaaggtacacaaagattaatttataaaactttaccacaattgaccaagcaatcaggcctggaggaacctgttgtctccagtagcatcttccacaccaacactaggagtctcaaagaagacaggttgatgtctcttcagcaccctctgaagacaattctcatgactcttgatagagagcatcctaaaatcacaattgttaaaattattttcctattctgtgttgtaagacttcgtaagccagtcactgaaattctcgttcccaaaatgaaacatttggaagagctgctagtggccactagtttcctcaaaattcaatatgatgaattgttttattgtgaaatgggatccaaatgcctatccagttgacacctctgccaacctcaagccaaacctaaacccattcataaaaggttttttttaaatagggtcttaatgtcatgtgccaaagggtcagattctgctcttgagttggtcacttcctgtgatactccagtagcagctgcctgaaaccagtgggagatttaggcctcccttgacattctcctgtgatttgaagctctcctttgaatcatcataaagcctagttttatgtcaatgctatcggttttgacaggaagcacgatggtaagaataccactaacgaaaacctttgtggtgtctcaatgacaaatatgcagatgccaccctcctttgtctaatgtacggtgctttagggcagctatttaatataaagcaactcagaacttgtttcaggaagtgttgctctttcgccttacatgccaaggttctagggaaaaagctgaccatatgtaaaaacattgatgctcaagcacataaagaattacattctttaaacatagagtacataggatcaagtctctgcacaataattgagatgtgttatagggaaaagtgagcacagtgctattgtccacttagtcttggtgaatgtgcagtaggctcacccctaaggaatctcatgttgcctgcagtaaaaataaaaatggactgctacaatgacatactgagagagttttaaatcatgctttacaaactgacttacagcttaggaaatgcaaagtcaagtttttcttttcaccctgaggcactcagtgcataaaggttcaagttttaaaactaagaatgtttccaaaagaccagcaatgttaaaagagtatttcgtgtatactagacgtgcctttaagcaataaaaattccaagagctga

SEQ ID NO: 459549 - DNA, 1272 bp, Homo sapiens
aggcaaggggaagctgcgcaggcgcagtgtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgagaaggcaattctcaagttcaactactcagtgcaggaggagagcgacacttgtctgggaggcaaatggtcttttgatgacgtaccaatgacgcccttgcgaactgtgatgttaattccaggcgacaagatgaacgaaatcatggataaactgaaagaatatctatctgtctaacccatttccaatggacagtgatgggcttgtttttgtaaaattaccagaaaactcagtggagatttactgaaaaactcagactttattcagattaagttcctctacaaaaagtagggttctgtcccatgtgtctctgacacatttacaaaataccagttttttaaaattttggtcaaattatgagtggttgatttaaaaacttttccaagaagaagaaaagcatggagtagtaatttaaagaactcaataaaaacttctattttttattttaaaataataaaaaaaat

SEQ ID NO: 459550 - DNA, 1287 bp, Homo sapiens
aggcaaggggaagctgcgcaggcgcagtgtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgaggagcagggaaaacctgaggtgcttggaggtccagacacaagaagaggattggaaccagttccgatacagcacaatggtggttcacgggggcaagtgacagccctggtttctctgaaggctggactaattcaatcaagatcaactctaagtgatttccagggaaccttcatgactgttggaattgctctgtcataataagtcagggatatttaggaggctcatagtctcctggagggataaaacatctcggcacctagtaatggtaaattagtcaatatttgttagtttcgtttgagatctcaaatgttaggattttctgaagtctcagtgtctttcagagtttgagataccttgttttcattttttctaatttttaatttaaaagtaataaagaatattttgtaatgattaggatgaaaattttatcgtcaattataagccaaaatttgctaaaattaaagtcagtatacttg

SEQ ID NO: 459551 - DNA, 670 bp, Homo sapiens
  misc_feature (162)..(162): n is a, c, g, or t
  misc_feature (603)..(603): n is a, c, g, or t
  misc_feature (637)..(637): n is a, c, g, or t
  misc_feature (669)..(669): n is a, c, g, or t
ttgtaggcttaatataaaataaccacgttagtgaacattatatctcttagaagaaaggccatattttgctcctgcttctgtaaaaatattatttgtttgaaggggaaataatggtagtgtgacctttcacttaattcctactcccttaatgtgagagagacnaaatgagctgaagaaggaaaattctggagttacactccacaaccttgaacatactgacggacatctctgttttgacaacaatttctcatcctaggatgaggaattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtggagggacattaatgaatctttcacttaggagaagnccacaggcttggtggtgtcatttaaaaacttgtncagctgttcaaccatgctcttttcacgtcganc

SEQ ID NO: 459552 - DNA, 1466 bp, Homo sapiens
aggcaaggggaagctgcgcaggcgcagtgtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgaggagcagggaaaacctgaggtgcttggaggtccagacacaagaagaggattggaaccagttccgatacagcacaatggtggttcacgggggcaagtgacagccctggtttctctgaaggctggactaattcaatcaagatcaactctaagtgatttccagggaaccttcatgactgttggaattgctctgtcataataagtcagggatatttaggaggctcatagtctcctggagggataaaacatctcggcacctagtaatggtaaattagtcaatatttgttagtttcgtttgagatctcaaatgttaggattttctgaagtctcagtgtctttcagagtttgagataccttgttttcattttttctaatttttaatttaaaagtaataaagaatattttgtaatgattaggatgaaaattttatcgtcaattataagccaaaatttgctaaaattaaagtcagtatacttgaaacaagtttctagtaagttctctggggtaagatactaattactctgataaaggggctatcaaaaaaatccagtaaattgttcataagaagagatcagtttaagagtcaaacaatttgctttgctagtaccttagctaaagaaaaaatactattaaagatgactatcacctttaaaaac

SEQ ID NO: 459553 - DNA, 1276 bp, Homo sapiens
aggcaaggggaagctgcgcaggcgcagtgtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgaggagcagggaaaacctgaggtgcttggaggtccagacacaagaagaggattggaaccagttccgatacagcacaatggttggtctgttcccccagtattagaataaattaaaacatacaagccaggatgaatgaagccaataggaaataaaaaacaggcacacaacattatttggggaaaaacacctctagtgacacattttcttcatctgcactgattatttcagcaaaagaaatctagtatgttttcatacatctgatgtataaatttgctgaactttgagttagttttcttaagataatttttcatattaagaaaattttccttttctaacctattaaaatacctcactatcatttcaaaaggttaaatgagttgatcactatctctgctctgtgctcctcaaaatataatttcaaatggatccgatctaaatctatacctagtgcagatttgcaaaaaa

SEQ ID NO: 459554 - DNA, 1390 bp, Homo sapiens
aggcaaggggaagctgcgcaggcgcagtgtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgaggtggttcacgggggcaagtgacagccctggtttctctgaaggctggactaattcaatcaagatcaactctaagtgatttccagggaaccttcatgactgttggaattgctctgtcataataagtcagggatatttaggaggctcatagtctcctggagggataaaacatctcggcacctagtaatggtaaattagtcaatatttgttagtttcgtttgagatctcaaatgttaggattttctgaagtctcagtgtctttcagagtttgagataccttgttttcattttttctaatttttaatttaaaagtaataaagaatattttgtaatgattaggatgaaaattttatcgtcaattataagccaaaatttgctaaaattaaagtcagtatacttgaaacaagtttctagtaagttctctggggtaagatactaattactctgataaaggggctatcaaaaaaatccagtaaattgttcataagaagagatcagtttaagagtcaaacaatttgctttgctagtaccttagctaaagaaaaaatactattaaagatgactatcacctttaaaaac

SEQ ID NO: 459555 - DNA, 1340 bp, Homo sapiens
  misc_feature (162)..(162): n is a, c, g, or t
ttgtaggcttaatataaaataaccacgttagtgaacattatatctcttagaagaaaggccatattttgctcctgcttctgtaaaaatattatttgtttgaaggggaaataatggtagtgtgacctttcacttaattcctactcccttaatgtgagagagacnaaatgagctgaagaaggaaaattctggagttacactccacaaccttgaacatactgacggacatctctgttttgacaacaatttctcatcctaggatgaggaattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgagaaggcaattctcaagttcaactactcagtgcaggaggagagcgacacttgtctgggaggcaaatggtcttttgatgacgtaccaatgacgcccttgcgaactgtgatgttaattccaggcgacaagatgaacgaaatcatggataaactgaaagaatatctatctgtctaacccatttccaatggacagtgatgggcttgtttttgtaaaattaccagaaaactcagtggagatttactgaaaaactcagactttattcagattaagttcctctacaaaaagtagggttctgtcccatgtgtctctgacacatttacaaaataccagttttttaaaattttggtcaaattatgagtggttgatttaaaaacttttccaagaagaagaaaagcatggagtagtaatttaaagaactcaataaaaacttctattttttattttaaaataataaaaaaaat

SEQ ID NO: 459556 - DNA, 1218 bp, Homo sapiens
aggcaaggggaagctgcgcaggcgcagtgtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgagaaggcaattctcaagttcaactactcagtgcaggaggagagcgacacttgtctgggaggcaaatggtcttttgatgacgtaccaatgacgcccttgcgaactgtgatgttaattccaggcgacaagatgaacgaaatcatggataaactgaaagaatatctatctgtctaacccatttccaatggacagtgatgggcttgtttttgtaaaattaccagaaaactcagtggagatttactgaaaaactcagactttattcagattaagttcctctacaaaaagtagggttctgtcccatgtgtctctgacacatttacaaaataccagttttttaaaattttggtcaaattatgagtggttgatttaaaaacttttccaagaagaagaaaagcatggagtagtaatttaaagaactcaataaaaacttctattttttattttaaaataataaaaaaaat

SEQ ID NO: 459557 - DNA, 1165 bp, Homo sapiens
catggcaggtcgaggccgggggttaatcggacgagggaacatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgaggagcagggaaaacctgaggtgcttggaggtccagacacaagaagaggattggaaccagttccgatacagcacaatggtggttcacgggggcaagtgacagccctggtttctctgaaggctggactaattcaatcaagatcaactctaagtgatttccagggaaccttcatgactgttggaattgctctgtcataataagtcagggatatttaggaggctcatagtctcctggagggataaaacatctcggcacctagtaatggtaaattagtcaatatttgttagtttcgtttgagatctcaaatgttaggattttctgaagtctcagtgtctttcagagtttgagataccttgttttcattttttctaatttttaatttaaaagtaataaagaatattttgtaatgattaggatgaaaattttatcgtcaattataagccaaaatttgctaaaattaaagtcagtatacttgaaacaagtttctagtaagttctctggggtaagatactaattactctgataaaggggctatcaaaaaaatccagtaaattgttcataagaagagatcagtttaagagtcaaacaatttgctttgctagtaccttagctaaagaaaaaatactattaaagatgactatcacctttaaaaac

SEQ ID NO: 459558 - DNA, 1215 bp, Homo sapiens
aggcaaggggaagctgcgcaggcgcagtgtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagtggttcacgggggcaagtgacagccctggtttctctgaaggctggactaattcaatcaagatcaactctaagtgatttccagggaaccttcatgactgttggaattgctctgtcataataagtcagggatatttaggaggctcatagtctcctggagggataaaacatctcggcacctagtaatggtaaattagtcaatatttgttagtttcgtttgagatctcaaatgttaggattttctgaagtctcagtgtctttcagagtttgagataccttgttttcattttttctaatttttaatttaaaagtaataaagaatattttgtaatgattaggatgaaaattttatcgtcaattataagccaaaatttgctaaaattaaagtcagtatacttgaaacaagtttctagtaagttctctggggtaagatactaattactctgataaaggggctatcaaaaaaatccagtaaattgttcataagaagagatcagtttaagagtcaaacaatttgctttgctagtaccttagctaaagaaaaaatactattaaagatgactatcacctttaaaaac

SEQ ID NO: 459559 - DNA, 1036 bp, Homo sapiens
aggcaaggggaagctgcgcaggcgcagtgtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagtggttcacgggggcaagtgacagccctggtttctctgaaggctggactaattcaatcaagatcaactctaagtgatttccagggaaccttcatgactgttggaattgctctgtcataataagtcagggatatttaggaggctcatagtctcctggagggataaaacatctcggcacctagtaatggtaaattagtcaatatttgttagtttcgtttgagatctcaaatgttaggattttctgaagtctcagtgtctttcagagtttgagataccttgttttcattttttctaatttttaatttaaaagtaataaagaatattttgtaatgattaggatgaaaattttatcgtcaattataagccaaaatttgctaaaattaaagtcagtatacttg

SEQ ID NO: 459560 - DNA, 756 bp, Homo sapiens
tgtttcacaagattattttgacaattaaatgaaaataccacttagctgcttgttcacctcttagaaattgcacacctctatccctgttcctcatgtgggtttaaaatctacttggtttgtgttttataacttctgcctgaatgtcccatttgaactttttcaattctgagttttgcttttttttagctctcattcttatttaagcatatgccaaacgtaatattctttgccgtagatcaaatgggttttgtctttgggttgtcccgatttttaattcatggttacttatttggtttagaaggcaattctcaagttcaactactcagtgcaggaggagagcgacacttgtctgggaggcaaatggtcttttgatgacgtaccaatgacgcccttgcgaactgtgatgttaattccaggcgacaagatgaacgaaatcatggataaactgaaagaatatctatctgtctaacccatttccaatggacagtgatgggcttgtttttgtaaaattaccagaaaactcagtggagatttactgaaaaactcagactttattcagattaagttcctctacaaaaagtagggttctgtcccatgtgtctctgacacatttacaaaataccagttttttaaaattttggtcaaattatgagtggttgatttaaaaacttttccaagaagaagaaaagcatggagtagtaatttaaagaactcaataaaaacttctattttttattttaaaataataaaaaaaat

SEQ ID NO: 459561 - DNA, 755 bp, Homo sapiens
aggcaaggggaagctgcgcaggcgcagtgtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagtaagagattctgggaaaatatctttgaacagtaatttttttttcaaatagattcctaaatgtcatttaagtagaatatgtagatatagaaagagttctgtccttggtttaagtgggtttagtgtgaggggagtggaagaaacatcctgtgaagtacatacattattaacaactggctttttgaagagtttgtgacaataatcatg

SEQ ID NO: 459562 - DNA, 695 bp, Homo sapiens
aggcaaggggaagctgcgcaggcgcagtgtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaaggtaagtaggataattgtgtttattctgattaaatgagttctttattctgttcatgctgggcctcaccatgcttgtaatcccagcactttgggaagcaaaggtgggaggattgcttgaggccaggagttcaagaccatcctgggcaatatagcaatactctgtctctacaaaaaataacaaaaaattagccgggcatagtagcacatgcctgtagtctttttacccaggtggctgaggtaggaggatctcttgagccaagaagttgaaggccatggtgagctttgtgccgctgcactctagccgggcaacacagcaagaccctatatctgaaaaa

SEQ ID NO: 459563 - DNA, 391 bp, Homo sapiens
gcttattccctatcagataatgattatgacggaattaagaaattactgcagcaggtattgtcttttatttattatgcataaatttcctcttctaagaaaaatcaggggccgggtgcagtggttcatgcctataatctcagcattttggaaggccgaggtgagaggattgcttgagcccaggagtttgagaccagcctgggcaacataatgagaacctgtctctacaaaaaaattaaaaattagccaactgtggtagcacacaccgttagtcctaactcctcaggaggctgaggctggaggattacttgagtctaagagctcaaggctgcagctatgaatgtgccattgagctccagtctgggcaacagagtgagcctctgtctctaaaaaa

SEQ ID NO: 459564 - DNA, 5574 bp, Homo sapiens
  misc_feature (3407)..(3407): n is a, c, g, or t
gcaggcctttcaggtctctctggaggacctgacagggcatgaaggcaacgagaagggggctgggccggagcccccaggctcagaggaggaggaggaggagcaggaggagagcctggcggtggcggagcagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacccactatgtgtgaactccttcctaggcttggctggggtagggaaggttattcatgggccagggatgtcttagggagatggagacatggaggttgttccttccacactcaattgtcacttgggcttatgaaacataaggcacccgggtactggtgggggaggtggggcaggaggatgtgagggcgggctttttctttctgctgcctagactcccatgggcttctctgtctagcagcagcctgctgtcctgtctagggtagggggtcccgcatgccagccttttgctcttttccccaagggccagagttggaccaagaaaaagggaggtggtgaggtggatagactgtttttctcataagcagatgctcccagtatctggtgcnttttgcgtttctctccggtccccaggaaacatcctagaagacaaggatttttttttttttttttttgagacagagtcttattctgtcacccaggctggagtgcaatggcgtgatcttggcttactgcaacctccgcctcccaggttcaagcaattctcgttgtctcagcctcccaggtcgctgggactacaggcatgagccaccacacccagctaattttttgtatttttagtagagacggggtttcgccgtgttgaccaggctggtctcgaacttctgacctcaggtgatccacccacctcggcctcccaaagtgctgggattacaggggtgagccactgcatgcggctgaaggtaaggattctaaactcggagactagaaatgtcctaaaggtgtctgcaacattggatgaggagtacaagtgcatttttctgggatgattcctccctttttatcacattctcagaagtatctttgattcagaagagttaggaatgcctccctatttcagttgggttttctgccctttctccacagaggtccagactcattttgcttaattttttttctagctggggcctgggaggtagaggcttcagggcctgggtggtagagctgcctgacaagtgttcagcagggctgctgggtcagggccctgtgggccttctgacccaacctgaagatgggtctgctaagtctaacaaggtcaagggaagatcagagggacccagattcttttttatcccccacttgaaacggagtcttgctctgtcgcccaggctggagcgcagtggtgcaatcttggctcactgcaacctccgcctccctgaccctcacactgtccagtgcccttgtggttactcagcatcatatcttgagactggcctggcaggagccagtgactgtggaatgaccacagaagattcagggcagctgccagaccaggggctatctctgccctgcgctgcttctgctcaagagaggttgtcactagcctctgatcttcccttgaagaacccgactggggctcttcagagggtggggcccaggaagttgtagttaaccccttccccaggcagtccttacacggccatctaggtatgcctgggaaccttgcaccaggtcggtggttctcactggctgcccattggaattatctggggagccttctggaaacgcagtgcttacattccatctccctagaccaacagaaactgccctctggaggtgaatcccaggcttagagattctgatgattctgcggtccagtgagtgctgagatctgtcctgagctctgtggggaggggcctggactgatcactgcttggaaatgattttgccctacagtaggccttcaagttgatcaaatgcatgaatgagcaagcttttcttggagtttgtgatgaagcccaggaaccgggtgcttgcagtcgtcccataaggctcccagggacaagctagagaatctggctgtccctctgtctccatggtgccagccctcttaggctcagttcaaagggagaggaggctagttaaataagaaactgagagaaacatggagcattattgatttattagaaaaactagtaaatgggtttcctctggttggtggaagcacggttgagcaggtggaggacaggacccagctggccccagggccagccccagattgcatggtctgtgcccaacagggttgcattcctctgcagccgccgcctcctcatttcctccctgagcttgtttgtccaagccaccaagccatgtggtcccgctggcttcatcctcctctggattcctgcccccctcccatgaagggaggaagaggattcagggtcagcctaggggaccctggctccctccgataggcaggaaggaggagggatgcggaggagaggctgagccttccacgggcctcctgttaggggtgttggtggaggccaggttggggagggaagcctaaggaccctccacacctcccacagccagagtcagttgaggctgggacaaaggggaaggagagagggaaggaggaccgcctgaccttgcccagaaggagcttcctctaaactgccctgggaaggaagcctggtatgctggtgtggactggagctgtgtcaacctcgtttgggaatactgtcaaaagactgtagagtagaataaggagag

SEQ ID NO: 459565 - DNA, 4750 bp, Homo sapiens
  misc_feature (2877)..(2877): n is a, c, g, or t
gcaggcctttcaggtctctctggaggacctgacagggcatgaaggcaacgagaagggggctgggccggagcccccaggctcagaggaggaggaggaggagcaggaggagagcctggcggtggcggagcagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagactggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacccactatgtgtgaactccttcctaggcttggctggggtagggaaggttattcatgggccagggatgtcttagggagatggagacatggaggttgttccttccacactcaattgtcacttgggcttatgaaacataaggcacccgggtactggtgggggaggtggggcaggaggatgtgagggcgggctttttctttctgctgcctagactcccatgggcttctctgtctagcagcagcctgctgtcctgtctagggtagggggtcccgcatgccagccttttgctcttttccccaagggccagagttggaccaagaaaaagggaggtggtgaggtggatagactgtttttctcataagcagatgctcccagtatctggtgcnttttgcgtttctctccggtccccaggaaacatcctagaagacaaggatttttttttttttttttttgagacagagtcttattctgtcacccaggctggagtgcaatggcgtgatcttggcttactgcaacctccgcctcccaggttcaagcaattctcgttgtctcagcctcccaggtcgctgggactacaggcatgagccaccacacccagctaattttttgtatttttagtagagacggggtttcgccgtgttgaccaggctggtctcgaacttctgacctcaggtgatccacccacctcggcctcccaaagtgctgggattacaggggtgagccactgcatgcggctgaaggtaaggattctaaactcggagactagaaatgtcctaaaggtgtctgcaacattggatgaggagtacaagtgcatttttctgggatgattcctccctttttatcacattctcagaagtatctttgattcagaagagttaggaatgcctccctatttcagttgggttttctgccctttctccacagaggtccagactcattttgcttaattttttttctagctggggcctgggaggtagaggcttcagggcctgggtggtagagctgcctgacaagtgttcagcagggctgctgggtcagggccctgtgggccttctgacccaacctgaagatgggtctgctaagtctaacaaggtcaagggaagatcagagggacccagattcttttttatcccccacttgaaacggagtcttgctctgtcgcccaggctggagcgcagtggtgcaatcttggctcactgcaacctccgcctccctgaccctcacactgtccagtgcccttgtggttactcagcatcatatcttgagactggcctggcaggagccagtgactgtggaatgaccacagaagattcagggcagctgccagaccaggggctatctctgccctgcgctgcttctgctcaagagaggttgtcactagcctctgatcttcccttgaagaacccgactggggctcttcagagggtggggcccaggaagttgtagttaaccccttccccaggcagtccttacacggccatctaggtatgcctgggaaccttgcaccaggtcggtggttctcactggctgcccattggaattatctggggagccttctggaaacgcagtgcttacattccatctccctagaccaacagaaactgccctctggaggtgaatcccaggcttagagattctgatgattctgcggtccagtgagtgctgagatctgtcctgagctctgtggggaggggcctggactgatcactgcttggaaatgattttgccctacagtaggccttcaagttgatcaaatgcatgaatgagcaagcttttcttggagtttgtgatgaagcccaggaaccgggtgcttgcagtcgtcccataaggctcccagggacaagctagagaatctggctgtccctctgtctccatggtgccagccctcttaggctcagttcaaagggagaggaggctagttaaataagaaactgagagaaacatggagcattattgatttattagaaaaactagtaaatgggtttcctctggttggtggaagcacggttgagcaggtggaggacaggacccagctggccccagggccagccccagattgcatggtctgtgcccaacagggttgcattcctctgcagccgccgcctcctcatttcctccctgagcttgtttgtccaagccaccaagccatgtggtcccgctggcttcatcctcctctggattcctgcccccctcccatcacctgaacaccacccatcacctgaacaccacccatcacctgaacaccacccatcacctgaa

SEQ ID NO: 459566 - DNA, 3019 bp, Homo sapiens
gcaggcctttcaggtctctctggaggacctgacagggcatgaaggcaacgagaagggggctgggccggagcccccaggctcagaggaggaggaggaggagcaggaggagagcctggcggtggcggagcaggtagccgactttgccagctccctgctggccgccctccactgctggcactatcgggccaacgctttacttttctcccggggcgctatgggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggt

SEQ ID NO: 459567 - DNA, 3440 bp, Homo sapiens
  misc_feature (3254)..(3254): n is a, c, g, or t
  misc_feature (3263)..(3263): n is a, c, g, or t
gcaggcctttcaggtctctctggaggacctgacagggcatgaaggcaacgagaagggggctgggccggagcccccaggctcagaggaggaggaggaggagcaggaggagagcctggcggtggcggagcaggtagccgactttgccagctccctgctggccgccctccactgctggcactatcgggccaacgctttacttttctcccggggcgctatgggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcgtcttctcaggaaacaccatacaagcaccaacttcattttatgattcaaagctcaccatccccactaaaagaatgctattcctcatctcagagaaacaggcaggaaggacagaaggggttagttacagtgatcaattttagcgtttgctaaaactcacaaattctagtctttttatgttcaagttttggtacagaagtatacattcaactatgagtgccacgttttccgcatcaaacattggtctggcaacaaactgtttntgttggctntctgaacataatacttcttcagaagggaggggcatggtgagatgctgaagcctaaattatgttggtaagaaacaaaataccatcagttgaaggtttttttttatcatcttggcttagattatttaaatgaaatccaaagcctccgccatttcccttctgtcgtctttctacaggatc

SEQ ID NO: 459568 - DNA, 3902 bp, Homo sapiens
  misc_feature (1735)..(1735): n is a, c, g, or t
gcaggcctttcaggtctctctggaggacctgacagggcatgaaggcaacgagaagggggctgggccggagcccccaggctcagaggaggaggaggaggagcaggaggagagcctggcggtggcggagcaggtagccgactttgccagctccctgctggccgccctccactgctggcactatcgggccaacgctttacttttctcccggggcgctatgggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacccactatgtgtgaactccttcctaggcttggctggggtagggaaggttattcatgggccagggatgtcttagggagatggagacatggaggttgttccttccacactcaattgtcacttgggcttatgaaacataaggcacccgggtactggtgggggaggtggggcaggaggatgtgagggcgggctttttctttctgctgcctagactcccatgggcttctctgtctagcagcagcctgctgtcctgtctagggtagggggtcccgcatgccagccttttgctcttttccccaagggccagagttggaccaagaaaaagggaggtggtgaggtggatagactgtttttctcataagcagatgctcccagtatctggtgcnttttgcgtttctctccggtccccaggaaacatcctagaagacaaggatttttttttttttttttttgagacagagtcttattctgtcacccaggctggagtgcaatggcgtgatcttggcttactgcaacctccgcctcccaggttcaagcaattctcgttgtctcagcctcccaggtcgctgggactacaggcatgagccaccacacccagctaattttttgtatttttagtagagacggggtttcgccgtgttgaccaggctggtctcgaacttctgacctcaggtgatccacccacctcggcctcccaaagtgctgggattacaggggtgagccactgcatgcggctgaaggtaaggattctaaactcggagactagaaatgtcctaaaggtgtctgcaacattggatgaggagtacaagtgcatttttctgggatgattcctccctttttatcacattctcagaagtatctttgattcagaagagttaggaatgcctccctatttcagttgggttttctgccctttctccacagaggtccagactcattttgcttaattttttttctagctggggcctgggaggtagaggcttcagggcctgggtggtagagctgcctgacaagtgttcagcagggctgctgggtcagggccctgtgggccttctgacccaacctgaagatgggtctgctaagtctaacaaggtcaagggaagatcagagggacccagattcttttttatcccccacttgaaacggagtcttgctctgtcgcccaggctggagcgcagtggtgcaatcttggctcactgcaacctccgcctccctgaccctcacactgtccagtgcccttgtggttactcagcatcatatcttgagactggcctggcaggagccagtgactgtggaatgaccacagaagattcagggcagctgccagaccaggggctatctctgccctgcgctgcttctgctcaagagaggttgtcactagcctctgatcttcccttgaagaacccgactggggctcttcagagggtggggcccaggaagttgtagttaaccccttccccaggcagtccttacacggccatctaggtatgcctgggaaccttgcaccaggtcggtggttctcactggctgcccattggaattatctggggagccttctggaaacgcagtgcttacattccatctccctagaccaacagaaactgccctctggaggtgaatcccaggcttagagattctgatgattctgcggtccagtgagtgctgagatctgtcctgagctctgtggggaggggcctggactgatcactgcttggaaatgattttgccctacagtaggccttcaagttgatcaaatgcatgaatgagcaagcttttcttggagtttgtgatgaagcccaggaaccgggtgcttgcagtcgtcccataaggctcccagggacaagctagagaatctggctgtccctctgtctccatggtgccagccctcttaggctcagttcaaagggagaggaggctagttaaataagaaactgagagaaacatggagcattattgatttattagaaaaactagtaaatgggtttcctctggttggtggaagcacggttgagcaggtggaggacaggacccagctggccccagggccagccccagattgcatggtctgtgcccaacagggttgcattcctctgcagccgccgcctcctcatttcctccctgagcttgtttgtccaagccaccaagccatgtggtcccgctggcttcatcctcctctggattcctgcccccctcccatgaagggaggaagaggattcagggtcagcctaggggaccctggctccctccgataggcaggaaggaggagggatgcggaggagaggctgagccttccacgggcctcctgttaggggtgttggtggaggccaggttggggagggaagcctaaggaccctccacacctcccacagccagagtcagttgaggctgggacaaaggggaaggagagagggaaggaggaccgcctgaccttgcccagaaggagcttcctctaaactgccctgggaaggaagcctggtatgctggtgtggactggagctgtgtcaacctcgtttgggaatactgtcaaaagactgtagagtagaataaggagag

SEQ ID NO: 459569 - DNA, 5661 bp, Homo sapiens
  misc_feature (3494)..(3494): n is a, c, g, or t
gcaggcctttcaggtctctctggaggacctgacagggcatgaaggcaacgagaagggggctgggccggagcccccaggctcagaggaggaggaggaggagcaggaggagagcctggcggtggcggagcaggtagccgactttgccagctccctgctggccgccctccactgctggcactatcgggccaacgctttacttttctcccggggcgctatgggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacccactatgtgtgaactccttcctaggcttggctggggtagggaaggttattcatgggccagggatgtcttagggagatggagacatggaggttgttccttccacactcaattgtcacttgggcttatgaaacataaggcacccgggtactggtgggggaggtggggcaggaggatgtgagggcgggctttttctttctgctgcctagactcccatgggcttctctgtctagcagcagcctgctgtcctgtctagggtagggggtcccgcatgccagccttttgctcttttccccaagggccagagttggaccaagaaaaagggaggtggtgaggtggatagactgtttttctcataagcagatgctcccagtatctggtgcnttttgcgtttctctccggtccccaggaaacatcctagaagacaaggatttttttttttttttttttgagacagagtcttattctgtcacccaggctggagtgcaatggcgtgatcttggcttactgcaacctccgcctcccaggttcaagcaattctcgttgtctcagcctcccaggtcgctgggactacaggcatgagccaccacacccagctaattttttgtatttttagtagagacggggtttcgccgtgttgaccaggctggtctcgaacttctgacctcaggtgatccacccacctcggcctcccaaagtgctgggattacaggggtgagccactgcatgcggctgaaggtaaggattctaaactcggagactagaaatgtcctaaaggtgtctgcaacattggatgaggagtacaagtgcatttttctgggatgattcctccctttttatcacattctcagaagtatctttgattcagaagagttaggaatgcctccctatttcagttgggttttctgccctttctccacagaggtccagactcattttgcttaattttttttctagctggggcctgggaggtagaggcttcagggcctgggtggtagagctgcctgacaagtgttcagcagggctgctgggtcagggccctgtgggccttctgacccaacctgaagatgggtctgctaagtctaacaaggtcaagggaagatcagagggacccagattcttttttatcccccacttgaaacggagtcttgctctgtcgcccaggctggagcgcagtggtgcaatcttggctcactgcaacctccgcctccctgaccctcacactgtccagtgcccttgtggttactcagcatcatatcttgagactggcctggcaggagccagtgactgtggaatgaccacagaagattcagggcagctgccagaccaggggctatctctgccctgcgctgcttctgctcaagagaggttgtcactagcctctgatcttcccttgaagaacccgactggggctcttcagagggtggggcccaggaagttgtagttaaccccttccccaggcagtccttacacggccatctaggtatgcctgggaaccttgcaccaggtcggtggttctcactggctgcccattggaattatctggggagccttctggaaacgcagtgcttacattccatctccctagaccaacagaaactgccctctggaggtgaatcccaggcttagagattctgatgattctgcggtccagtgagtgctgagatctgtcctgagctctgtggggaggggcctggactgatcactgcttggaaatgattttgccctacagtaggccttcaagttgatcaaatgcatgaatgagcaagcttttcttggagtttgtgatgaagcccaggaaccgggtgcttgcagtcgtcccataaggctcccagggacaagctagagaatctggctgtccctctgtctccatggtgccagccctcttaggctcagttcaaagggagaggaggctagttaaataagaaactgagagaaacatggagcattattgatttattagaaaaactagtaaatgggtttcctctggttggtggaagcacggttgagcaggtggaggacaggacccagctggccccagggccagccccagattgcatggtctgtgcccaacagggttgcattcctctgcagccgccgcctcctcatttcctccctgagcttgtttgtccaagccaccaagccatgtggtcccgctggcttcatcctcctctggattcctgcccccctcccatgaagggaggaagaggattcagggtcagcctaggggaccctggctccctccgataggcaggaaggaggagggatgcggaggagaggctgagccttccacgggcctcctgttaggggtgttggtggaggccaggttggggagggaagcctaaggaccctccacacctcccacagccagagtcagttgaggctgggacaaaggggaaggagagagggaaggaggaccgcctgaccttgcccagaaggagcttcctctaaactgccctgggaaggaagcctggtatgctggtgtggactggagctgtgtcaacctcgtttgggaatactgtcaaaagactgtagagtagaataaggagag

SEQ ID NO: 459570 - DNA, 5044 bp, Homo sapiens
  misc_feature (2877)..(2877): n is a, c, g, or t
gcaggcctttcaggtctctctggaggacctgacagggcatgaaggcaacgagaagggggctgggccggagcccccaggctcagaggaggaggaggaggagcaggaggagagcctggcggtggcggagcagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagactggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacccactatgtgtgaactccttcctaggcttggctggggtagggaaggttattcatgggccagggatgtcttagggagatggagacatggaggttgttccttccacactcaattgtcacttgggcttatgaaacataaggcacccgggtactggtgggggaggtggggcaggaggatgtgagggcgggctttttctttctgctgcctagactcccatgggcttctctgtctagcagcagcctgctgtcctgtctagggtagggggtcccgcatgccagccttttgctcttttccccaagggccagagttggaccaagaaaaagggaggtggtgaggtggatagactgtttttctcataagcagatgctcccagtatctggtgcnttttgcgtttctctccggtccccaggaaacatcctagaagacaaggatttttttttttttttttttgagacagagtcttattctgtcacccaggctggagtgcaatggcgtgatcttggcttactgcaacctccgcctcccaggttcaagcaattctcgttgtctcagcctcccaggtcgctgggactacaggcatgagccaccacacccagctaattttttgtatttttagtagagacggggtttcgccgtgttgaccaggctggtctcgaacttctgacctcaggtgatccacccacctcggcctcccaaagtgctgggattacaggggtgagccactgcatgcggctgaaggtaaggattctaaactcggagactagaaatgtcctaaaggtgtctgcaacattggatgaggagtacaagtgcatttttctgggatgattcctccctttttatcacattctcagaagtatctttgattcagaagagttaggaatgcctccctatttcagttgggttttctgccctttctccacagaggtccagactcattttgcttaattttttttctagctggggcctgggaggtagaggcttcagggcctgggtggtagagctgcctgacaagtgttcagcagggctgctgggtcagggccctgtgggccttctgacccaacctgaagatgggtctgctaagtctaacaaggtcaagggaagatcagagggacccagattcttttttatcccccacttgaaacggagtcttgctctgtcgcccaggctggagcgcagtggtgcaatcttggctcactgcaacctccgcctccctgaccctcacactgtccagtgcccttgtggttactcagcatcatatcttgagactggcctggcaggagccagtgactgtggaatgaccacagaagattcagggcagctgccagaccaggggctatctctgccctgcgctgcttctgctcaagagaggttgtcactagcctctgatcttcccttgaagaacccgactggggctcttcagagggtggggcccaggaagttgtagttaaccccttccccaggcagtccttacacggccatctaggtatgcctgggaaccttgcaccaggtcggtggttctcactggctgcccattggaattatctggggagccttctggaaacgcagtgcttacattccatctccctagaccaacagaaactgccctctggaggtgaatcccaggcttagagattctgatgattctgcggtccagtgagtgctgagatctgtcctgagctctgtggggaggggcctggactgatcactgcttggaaatgattttgccctacagtaggccttcaagttgatcaaatgcatgaatgagcaagcttttcttggagtttgtgatgaagcccaggaaccgggtgcttgcagtcgtcccataaggctcccagggacaagctagagaatctggctgtccctctgtctccatggtgccagccctcttaggctcagttcaaagggagaggaggctagttaaataagaaactgagagaaacatggagcattattgatttattagaaaaactagtaaatgggtttcctctggttggtggaagcacggttgagcaggtggaggacaggacccagctggccccagggccagccccagattgcatggtctgtgcccaacagggttgcattcctctgcagccgccgcctcctcatttcctccctgagcttgtttgtccaagccaccaagccatgtggtcccgctggcttcatcctcctctggattcctgcccccctcccatgaagggaggaagaggattcagggtcagcctaggggaccctggctccctccgataggcaggaaggaggagggatgcggaggagaggctgagccttccacgggcctcctgttaggggtgttggtggaggccaggttggggagggaagcctaaggaccctccacacctcccacagccagagtcagttgaggctgggacaaaggggaaggagagagggaaggaggaccgcctgaccttgcccagaaggagcttcctctaaactgccctgggaaggaagcctggtatgctggtgtggactggagctgtgtcaacctcgtttgggaatactgtcaaaagactgtagagtagaataaggagag

SEQ ID NO: 459571 - DNA, 4983 bp, Homo sapiens
  misc_feature (2816)..(2816): n is a, c, g, or t
gtgctgatgtcgatctaaggatcccagtcactgaagcctggttcagccgtgagtcacgtctgactgggaagaaagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacccactatgtgtgaactccttcctaggcttggctggggtagggaaggttattcatgggccagggatgtcttagggagatggagacatggaggttgttccttccacactcaattgtcacttgggcttatgaaacataaggcacccgggtactggtgggggaggtggggcaggaggatgtgagggcgggctttttctttctgctgcctagactcccatgggcttctctgtctagcagcagcctgctgtcctgtctagggtagggggtcccgcatgccagccttttgctcttttccccaagggccagagttggaccaagaaaaagggaggtggtgaggtggatagactgtttttctcataagcagatgctcccagtatctggtgcnttttgcgtttctctccggtccccaggaaacatcctagaagacaaggatttttttttttttttttttgagacagagtcttattctgtcacccaggctggagtgcaatggcgtgatcttggcttactgcaacctccgcctcccaggttcaagcaattctcgttgtctcagcctcccaggtcgctgggactacaggcatgagccaccacacccagctaattttttgtatttttagtagagacggggtttcgccgtgttgaccaggctggtctcgaacttctgacctcaggtgatccacccacctcggcctcccaaagtgctgggattacaggggtgagccactgcatgcggctgaaggtaaggattctaaactcggagactagaaatgtcctaaaggtgtctgcaacattggatgaggagtacaagtgcatttttctgggatgattcctccctttttatcacattctcagaagtatctttgattcagaagagttaggaatgcctccctatttcagttgggttttctgccctttctccacagaggtccagactcattttgcttaattttttttctagctggggcctgggaggtagaggcttcagggcctgggtggtagagctgcctgacaagtgttcagcagggctgctgggtcagggccctgtgggccttctgacccaacctgaagatgggtctgctaagtctaacaaggtcaagggaagatcagagggacccagattcttttttatcccccacttgaaacggagtcttgctctgtcgcccaggctggagcgcagtggtgcaatcttggctcactgcaacctccgcctccctgaccctcacactgtccagtgcccttgtggttactcagcatcatatcttgagactggcctggcaggagccagtgactgtggaatgaccacagaagattcagggcagctgccagaccaggggctatctctgccctgcgctgcttctgctcaagagaggttgtcactagcctctgatcttcccttgaagaacccgactggggctcttcagagggtggggcccaggaagttgtagttaaccccttccccaggcagtccttacacggccatctaggtatgcctgggaaccttgcaccaggtcggtggttctcactggctgcccattggaattatctggggagccttctggaaacgcagtgcttacattccatctccctagaccaacagaaactgccctctggaggtgaatcccaggcttagagattctgatgattctgcggtccagtgagtgctgagatctgtcctgagctctgtggggaggggcctggactgatcactgcttggaaatgattttgccctacagtaggccttcaagttgatcaaatgcatgaatgagcaagcttttcttggagtttgtgatgaagcccaggaaccgggtgcttgcagtcgtcccataaggctcccagggacaagctagagaatctggctgtccctctgtctccatggtgccagccctcttaggctcagttcaaagggagaggaggctagttaaataagaaactgagagaaacatggagcattattgatttattagaaaaactagtaaatgggtttcctctggttggtggaagcacggttgagcaggtggaggacaggacccagctggccccagggccagccccagattgcatggtctgtgcccaacagggttgcattcctctgcagccgccgcctcctcatttcctccctgagcttgtttgtccaagccaccaagccatgtggtcccgctggcttcatcctcctctggattcctgcccccctcccatgaagggaggaagaggattcagggtcagcctaggggaccctggctccctccgataggcaggaaggaggagggatgcggaggagaggctgagccttccacgggcctcctgttaggggtgttggtggaggccaggttggggagggaagcctaaggaccctccacacctcccacagccagagtcagttgaggctgggacaaaggggaaggagagagggaaggaggaccgcctgaccttgcccagaaggagcttcctctaaactgccctgggaaggaagcctggtatgctggtgtggactggagctgtgtcaacctcgtttgggaatactgtcaaaagactgtagagtagaataaggagag

SEQ ID NO: 459572 - DNA, 2934 bp, Homo sapiens
gcaggcctttcaggtctctctggaggacctgacagggcatgaaggcaacgagaagggggctgggccggagcccccaggctcagaggaggaggaggaggagcaggaggagagcctggcggtggcggagcaggtagccgactttgccagctccctgctggccgccctccactgctggcactatcgggccaacgctttacttttctcccggggcgctatgggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttcca

SEQ ID NO: 459573 - DNA, 312 bp, Homo sapiens
tgcacaggcatttttctagtccccactgctccagtggagtctaagagtccagtaggagcacaaaatggacaaagtcacaaaggctttgaacgctcctgccatcctcctctctccttataatgtttctgagcaatgagtaaattaatttccctgggatgtgtctgtgcactcctgtggtgccacgaagacctgcacttcaccactgcccttgcatagagttaactgagtttattttattttatcttaatttattttgggacagagtctctctcttgtcacccaggctggagtacaatggcatgatctcggctc

SEQ ID NO: 459574 - DNA, 304 bp, Homo sapiens
aataattgagctactactatataaaaagcactgaatttggtactatgagtgattccaaaaagacttttgcctctgacactaccaaaaccactccagataaaattccaaatgacctaaaattgctaaatccaatttttatttttcagttctcctcttgacctatcggtagcatctgacgtaagtaaaacactcttccttgaaatattttccttctttcttttttttctttttctttttttttttgagacagagtctggctctgttgcccaggctggagtgcagtggcacgatctcgcctcactgc

SEQ ID NO: 459575 - DNA, 10508 bp, Homo sapiens
  misc_feature (7700)..(7700): n is a, c, g, or t
aagcgcgggggagggagtgtaaatagagcgaaggctgctctgtgtcagccccgtcaccgccgggcggcccgcgcggagtctgagggagatggaagttgagcaagagcagcggcgcagaaaggtggaggccgggaggacgaagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatggggcaggaggggcctttgcagctcagccggaggactgtgatggagagaagagagaggacttggaacagctgcagcagaagcaagtcaatgaccatcctccagagcagtgtgggatgttcacagtcagtgaccacccaccagaacagcatgggatgttcacagtcggtgaccacccaccagaacagcgtgggatgttcacagtcagtgaccacccaccagaacagcatgggatgttcacagtcagtgaccacccaccagaacagcgtgggatgttcacaatcagtgaccaccaaccggaacagcgtgggatgttcacagtcagtgaccacacaccagaacagcgtgggatcttcacaatcagtgaccacccagcagaacagcgtgggatgttcacaaaggagtgtgaacaagaatgtgaacttgccattactgacctggagagcggccgtgaagatgaggctggcctgcatcagagtcaggccgtgcatggccttgagctggaggcgctgcgcctgagtctgagcaacatgcacacggcgcagctggagctgacacaggccaacctccagaaggagaaggagacggcattgacggagctgcgggagatgctcaacagccggcgtgcccaggagctggccctgctacagagcaggcagcagcacgagctggagctcctcagggagcagcacgcacgggagaaggaggaggtggtgctcaggtgtggacaggaagcagctgagctgaaggagaagttacaatcagaaatggagaaaaacgcccagatagtaaagaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgggcccttaggaacctggagagtcatcatcaagcagccattgagaagttacgtgaagacctgcagtccgagcacggccggtgtttagaagacttggagttcaagttcaaagagagcgagaaagaaaaacagctggagttagagaatcttcaagcatcatatgaagacctgaaggcacaatcacaagaagagatcaggcgcttgtggtcccagcttgattctgccaggaccagtagacaggaattgagtgagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggttgtcctgtgtgggtttagaagagaaacctgagaaaggaagaaaagatcacgttgatgaactcgagcctgagcgacataaggagagcctgccacgcttccaggcggagttagaagaaagccacaggcaccagctggaagcgctggagtctcccctctgcatccagcacgaggggcatgtctcagacagatgctgcgtagagacttcagcattgggacacgagtggcgtctggaaccctctgaagggcacagccaagagcttccctgggtgcatctccagggtgtgcaggacggggacttggaggccgacacagagcgggcagccagagtcttgggtctggaaactgagcacaaggtgcaactttcgcttcttcagactgagctcaaagaagaaattgaactcctaaaaatagaaaatagaaatttgtttgagaagttgcagcatgaaactcgtctgaaggacgatttggagaaggtaaaacacaatctaattgaagaccaccagaaggaactaaataatgctaagcaaaagactgagctgatgaaacaggaattccaaagaaaagaaacggactggaaagttatgaaggaggagctacagcgggaagctgaggagaagttaacattgatgctacttgaactgagagaaaaggctgaatccgagaaacagaccatcataaacaagttggagcttcgagaagctgaaatgaggcagcttcaggaccaacaggcagcgcagatcctggatctggagaggtccttgacggagcagcaggcccgcctgcagcagctggaacaggacctcacttcagacgacgccctgcattgcagccagtgtgggcgggagccgcccacagcccaggacggggagcttgccgcgctccacgtgaaggaagactgcgccctgcagctgatgctggcccggagcaggtttttagaggaacgtaaagagatcgccgagaaattcagtgcggaacaagatgccttcctgcagctcctccaggagagacaccagcagcagctcctgtcagtgacggcggagctcgaggccagacaccaggccgcgttgggcgagctgacagcctccttagagagcaagcagggggctctgctggctgcacgtgtggccgaactgcagaccaaacacgctgccgacctcggcgctctggagaccagacatctgtccagccttgattctttggaatcctgttacctgtctgaatttcagaccatccgtgaggagcacaggcaggccctagagctcttacgagcagactttgaggaacaactgtggaaaaaggactctcttcaccaaacgattttgactcaagagttggagaaactgaagcggaaacacgaaggggagctacagtctgtgcgggaccacctgcgaaccgaagcgagcacagagctcgccggaaccgtggctcacgagctgcagggagtgcaccagggtgaatttggaagtgaaaagaaaactgctttgcatgaaaaagaggagacacttcggcttcagagtgcacaggcacagccttttcaccaagaggagaaagagtctttgtctctgcagcttcaaaagaagaatcaccaagtccagcagctgaaagaccaggttttatccttaagtcacgagatagaagagtgccgctccgagttggaggtgctgcagcagaggcgggagcgggagaaccgggaaggcgcaaacctcctctccatgctcaaggccgacgtcaacctgtcccacagcgaaagaggggccctccaggacgccctgcgcaggctgctgggtttgtttggagagacgctgagggcagccgtcaccctgaggagccggatcggggagcgcgtggggctctgcctggatgacgcgggcgcaggcctggccctgtcgacagctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcagctggaagaagcacgccaacttcattctcgttttgaaaaagaatttagttttaagaatgaggagacagcacaggttgtcaggaagcaccaggagctgctggagtgtttgacggaggagagcgcagcaaaggcagagctggcgctggagctgcacaagactcagggtacccttgagggattcaaggtggagacagcagatctgaaggaggtgctggccgggaaggaggattccgagcaccgtctggtgctggagctggagagcctgagacggcagctgcagcaggcggcccaggagcaggcggcgctgagggaggagtgcacccgtctgtggagtcggggggaggccacagccacggacgccgaggccagagaagctgctctccggaaggaagtggaggatctgaccaaagaacagtcggagaccaggaagcaggctgagaaggaccgctcagccctgctctcccagatgaagattttggagtctgagttagaagaacagctgtctcagcatcgcgggtgtgccaagcaggcggaggccgtcactgccctggaacagcaggtggcatctctggacaagcatttgcgcaaccagcggcaattcatggatgagcaggcagccgagcgggagcacgagcgcgaggagttccagcaggagattcagaggctggaggggcagctccgccaggcggccaagccgcagccctggggccctcgcgacagccagcaggcgccgctggatggagaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccaggaagaagtggaaaaacagaaaaacatcgtgaaagggctggaacaggataaagaggtgttaaagaaacagcagatgagtagcttgcttctggcgtccacgttgcagtctacactagatgcaggcagatgtcccgagcctccttcgggcagccctcctgagggtccagaaatacagttagaggtgacacagagagcactcctgcggcgcgagagcgaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtcatatataccagaagttctgagattgaagagctgaaagccactattgaaaatctgcaagagaatcagaaacgattacaaaaggagaaagcagaggaaattgaacaactccatgaagtcattgagaagctgcagcacgagctgtccctcatggggcctgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagagccacactgcagaggctgggccccggaagagcccggtcgggatgctggacctgtcttcctggagctcccctgaggtcctcaggaaggactggaccctggagccctggcccagcctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggagaaagatgtcgaagattttatcacaacatcctttgattctcaagaaacattaagttcacctcctcctggattagaaggaaaagctgatagaagtgagaaaagtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcagggagacctgcaggaaaagtccctggagcatcttcgcttgccggaccggagcagcctgctgtccgagatccaggcgctgcgtgcccagctgcgcatgacgcacctgcagaaccaggagaagctgcagcacttgcgcacggcgctgacaagcncagaggcgcgcgggagccagcaggagcaccagctgcgcaggcaggttgaactgctggcttataaagtagagcaggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggagctgcgggcgtctttggagacacagcgtgctcagagcagtcgactctgcgtggcactgaaacacgagcagacggccaaggacaacctgcagaaggagctgcgtatcgagcactcacgctgcgaggccttgctggctcaggagcggagccagctctctgagctccagaaggaccttgcggctgagaagagccgcaccctggagctgtcagaggccttgcggcacgagcggctcctgaccgagcagctgagccagaggacacaggaggcttgcgtgcaccaggacacacaggcccatcacgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggaggtaagtgccacactgaagtcgacggtggaagccctgcacacccaaaaacgagagctgagatgctctctggagagagagagggagaaaccagcgtggttgcaggcagaattagagcagtcacacccacggttgaaagagcaagaaggacgcaaggctgcgaggaggagcgcggaggccaggcagagcccagcggctgcggagcagtggaggaagtggcagagagacaaggagaagctgcgagaattagaactgcagcgtcagcgtgacttgcataagatcaagcagcttcagcagacggtgagagacctggagtcgaaggacgaggtgcctggcagccgcctccacctaggttctgcccgcagggctgccggctcggatgcggaccacctccgggaacagcagcgagagctggaggcgatgaggcagcggctgctctctgccgcccggcttctcaccagcttcaccagccaggccgtggacaggacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 459576 - DNA, 10253 bp, Homo sapiens
  misc_feature (7682)..(7682): n is a, c, g, or t
aagcgcgggggagggagtgtaaatagagcgaaggctgctctgtgtcagccccgtcaccgccgggcggcccgcgcggagtctgagggagatggaagttgagcaagagcagcggcgcagaaaggtggaggccgggaggacgaagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatggggcaggaggggcctttgcagctcagccggaggactgtgatggagagaagagagaggacttggaacagctgcagcagaagcaagtcaatgaccatcctccagagcagtgtgggatgttcacagtcagtgaccacccaccagaacagcatgggatgttcacagtcggtgaccacccaccagaacagcgtgggatgttcacaagtcagtgaccacccaccagaacagcgtgggatgttcacaatcagtgaccaccaaccggaacagcgtgggatgttcacagtcagtgaccacacaccagaacagcgtgggatcttcacaatcagtgaccacccagcagaacagcgtgggatgttcacaaaggagtgtgaacaagaatgtgaacttgccattactgacctggagagcggccgtgaagatgaggctggcctgcatcagagtcagaggccttttctccgccgcaggccgtgcatggccttgagctggaggcgctgcgcctgagtctgagcaacatgcacacggcgcagctggagctgacacaggccaacctccagaaggagaaggagacggcattgacggagctgcgggagatgctcaacagccggcgtgcccaggagctggccctgctacagagcaggcagcagcacgagctggagctcctcagggagcagcacgcacgggagaaggaggaggtggtgctcaggtgtggacaggaagcagctgagctgaaggagaagttacaatcagaaatggagaaaaacgcccagatagtaaagaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgggcccttaggaacctggagagtcatcatcaagcagccattgagaagttacgtgaagacctgcagtccgagcacggccggtgtttagaagacttggagttcaagttcaaagagagcgagaaagaaaaacagctggagttagagaatcttcaagcatcatatgaagacctgaaggcacaatcacaagaagagatcaggcgcttgtggtcccagcttgattctgccaggaccagtagacaggaattgagtgagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggttgtcctgtgtgggtttagaagagaaacctgagaaaggaagaaaagatcacgttgatgaactcgagcctgagcgacataaggagagcctgccacgcttccaggcggagttagaagaaagccacaggcaccagctggaagcgctggagtctcccctctgcatccagcacgaggggcatgtctcagacagatgctgcgtagagacttcagcattgggacacgagtggcgtctggaaccctctgaagggcacagccaagagcttccctgggtgcatctccagggtgtgcaggacggggacttggaggccgacacagagcgggcagccagagtcttgggtctggaaactgagcacaaggtgcaactttcgcttcttcagactgagctcaaagaagaaattgaactcctaaaaatagaaaatagaaatttgtttgagaagttgcagcatgaaactcgtctgaaggacgatttggagaaggtaaaacacaatctaattgaagaccaccagaaggaactaaataatgctaagcaaaagactgagctgatgaaacaggaattccaaagaaaagaaacggactggaaagttatgaaggaggagctacagcgggaagctgaggagaagttaacattgatgctacttgaactgagagaaaaggctgaatccgagaaacagaccatcataaacaagttggagcttcgagaagctgaaatgaggcagcttcaggaccaacaggcagcgcagatcctggatctggagaggtccttgacggagcagcaggcccgcctgcagcagctggaacaggacctcacttcagacgacgccctgcattgcagccagtgtgggcgggagccgcccacagcccaggacggggagcttgccgcgctccacgtgaaggaagactgcgccctgcagctgatgctggcccggagcaggtttttagaggaacgtaaagagatcgccgagaaattcagtgcggaacaagatgccttcctgcagctcctccaggagagacaccagcagcagctcctgtcagtgacggcggagctcgaggccagacaccaggccgcgttgggcgagctgacagcctccttagagagcaagcagggggctctgctggctgcacgtgtggccgaactgcagaccaaacacgctgccgacctcggcgctctggagaccagacatctgtccagccttgattctttggaatcctgttacctgtctgaatttcagaccatccgtgaggagcacaggcaggccctagagctcttacgagcagactttgaggaacaactgtggaaaaaggactctcttcaccaaacgattttgactcaagagttggagaaactgaagcggaaacacgaaggggagctacagtctgtgcgggaccacctgcgaaccgaagcgagcacagagctcgccggaaccgtggctcacgagctgcagggagtgcaccagggtgaatttggaagtgaaaagaaaactgctttgcatgaaaaagaggagacacttcggcttcagagtgcacaggcacagccttttcaccaagaggagaaagagtctttgtctctgcagcttcaaaagaagaatcaccaagtccagcagctgaaagaccaggttttatccttaagtcacgagatagaagagtgccgctccgagttggaggtgctgcagcagaggcgggagcgggagaaccgggaaggcgcaaacctcctctccatgctcaaggccgacgtcaacctgtcccacagcgaaagaggggccctccaggacgccctgcgcaggctgctgggtttgtttggagagacgctgagggcagccgtcaccctgaggagccggatcggggagcgcgtggggctctgcctggatgacgcgggcgcaggcctggccctgtcgacagctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcagctggaagaagcacgccaacttcattctcgttttgaaaaagaatttagttttaagaatgaggagacagcacaggttgtcaggaagcaccaggagctgctggagtgtttgacggaggagagcgcagcaaaggcagagctggcgctggagctgcacaagactcagggtacccttgagggattcaaggtggagacagcagatctgaaggaggtgctggccgggaaggaggattccgagcaccgtctggtgctggagctggagagcctgagacggcagctgcagcaggcggcccaggagcaggcggcgctgagggaggagtgcacccgtctgtggagtcggggggaggccacagccacggacgccgaggccagagaagctgctctccggaaggaagtggaggatctgaccaaagaacagtcggagaccaggaagcaggctgagaaggaccgctcagccctgctctcccagatgaagattttggagtctgagttagaagaacagctgtctcagcatcgcgggtgtgccaagcaggcggaggccgtcactgccctggaacagcaggtggcatctctggacaagcatttgcgcaaccagcggcaattcatggatgagcaggcagccgagcgggagcacgagcgcgaggagttccagcaggagattcagaggctggaggggcagctccgccaggcggccaagccgcagccctggggccctcgcgacagccagcaggcgccgctggatggagaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccaggaagaagtggaaaaacagaaaaacatcgtgaaagggctggaacaggataaagaggtgttaaagaaacagcagatgagtagcttgcttctggcgtccacgttgcagtctacactagatgcaggcagatgtcccgagcctccttcgggcagccctcctgagggtccagaaatacagttagaggtgacacagagagcactcctgcggcgcgagagcgaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtcatatataccagaagttctgagattgaagagctgaaagccactattgaaaatctgcaagagaatcagaaacgattacaaaaggagaaagcagaggaaattgaacaactccatgaagtcattgagaagctgcagcacgagctgtccctcatggggcctgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagagccacactgcagaggctgggccccggaagagcccggtcgggatgctggacctgtcttcctggagctcccctgaggtcctcaggaaggactggaccctggagccctggcccagcctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggagaaagatgtcgaagattttatcacaacatcctttgattctcaagaaacattaagttcacctcctcctggattagaaggaaaagctgatagaagtgagaaaagtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcagggagacctgcaggaaaagtccctggagcatcttcgcttgccggaccggagcagcctgctgtccgagatccaggcgctgcgtgcccagctgcgcatgacgcacctgcagaaccaggagaagctgcagcacttgcgcacggcgctgacaagcncagaggcgcgcgggagccagcaggagcaccagctgcgcaggcaggttgaactgctggcttataaagtagagcaggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggagctgcgggcgtctttggagacacagcgtgctcagagcagtcgactctgcgtggcactgaaacacgagcagacggccaaggacaacctgcagaaggagctgcgtatcgagcactcacgctgcgaggccttgctggctcaggagcggagccagctctctgagctccagaaggaccttgcggctgagaagagccgcaccctggagctgtcagaggccttgcggcacgagcggctcctgaccgagcagctgagccagaggacacaggaggcttgcgtgcaccaggacacacaggcccatcacgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggagcgagaattagaactgcagcgtcagcgtgacttgcataagatcaagcagcttcagcagacggtgagagacctggagtcgaaggacgaggtgcctggcagccgcctccacctaggttctgcccgcagggctgccggctcggatgcggaccacctccgggaacagcagcgagagctggaggcgatgaggcagcggctgctctctgccgcccggcttctcaccagcttcaccagccaggccgtggacaggacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 459577 - DNA, 9240 bp, Homo sapiens
  misc_feature (6669)..(6669): n is a, c, g, or t
gagggtgactgtgtggattaggccttgcgtgcagaggctcgtctgtttcggggtgggtggtccttgtgcagaggctggtctgtttcaggaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgggcccttaggaacctggagagtcatcatcaagcagccattgagaagttacgtgaagacctgcagtccgagcacggccggtgtttagaagacttggagttcaagttcaaagagagcgagaaagaaaaacagctggagttagagaatcttcaagcatcatatgaagacctgaaggcacaatcacaagaagagatcaggcgcttgtggtcccagcttgattctgccaggaccagtagacaggaattgagtgagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggttgtcctgtgtgggtttagaagagaaacctgagaaaggaagaaaagatcacgttgatgaactcgagcctgagcgacataaggagagcctgccacgcttccaggcggagttagaagaaagccacaggcaccagctggaagcgctggagtctcccctctgcatccagcacgaggggcatgtctcagacagatgctgcgtagagacttcagcattgggacacgagtggcgtctggaaccctctgaagggcacagccaagagcttccctgggtgcatctccagggtgtgcaggacggggacttggaggccgacacagagcgggcagccagagtcttgggtctggaaactgagcacaaggtgcaactttcgcttcttcagactgagctcaaagaagaaattgaactcctaaaaatagaaaatagaaatttgtttgagaagttgcagcatgaaactcgtctgaaggacgatttggagaaggtaaaacacaatctaattgaagaccaccagaaggaactaaataatgctaagcaaaagactgagctgatgaaacaggaattccaaagaaaagaaacggactggaaagttatgaaggaggagctacagcgggaagctgaggagaagttaacattgatgctacttgaactgagagaaaaggctgaatccgagaaacagaccatcataaacaagttggagcttcgagaagctgaaatgaggcagcttcaggaccaacaggcagcgcagatcctggatctggagaggtccttgacggagcagcaggcccgcctgcagcagctggaacaggacctcacttcagacgacgccctgcattgcagccagtgtgggcgggagccgcccacagcccaggacggggagcttgccgcgctccacgtgaaggaagactgcgccctgcagctgatgctggcccggagcaggtttttagaggaacgtaaagagatcgccgagaaattcagtgcggaacaagatgccttcctgcagctcctccaggagagacaccagcagcagctcctgtcagtgacggcggagctcgaggccagacaccaggccgcgttgggcgagctgacagcctccttagagagcaagcagggggctctgctggctgcacgtgtggccgaactgcagaccaaacacgctgccgacctcggcgctctggagaccagacatctgtccagccttgattctttggaatcctgttacctgtctgaatttcagaccatccgtgaggagcacaggcaggccctagagctcttacgagcagactttgaggaacaactgtggaaaaaggactctcttcaccaaacgattttgactcaagagttggagaaactgaagcggaaacacgaaggggagctacagtctgtgcgggaccacctgcgaaccgaagcgagcacagagctcgccggaaccgtggctcacgagctgcagggagtgcaccagggtgaatttggaagtgaaaagaaaactgctttgcatgaaaaagaggagacacttcggcttcagagtgcacaggcacagccttttcaccaagaggagaaagagtctttgtctctgcagcttcaaaagaagaatcaccaagtccagcagctgaaagaccaggttttatccttaagtcacgagatagaagagtgccgctccgagttggaggtgctgcagcagaggcgggagcgggagaaccgggaaggcgcaaacctcctctccatgctcaaggccgacgtcaacctgtcccacagcgaaagaggggccctccaggacgccctgcgcaggctgctgggtttgtttggagagacgctgagggcagccgtcaccctgaggagccggatcggggagcgcgtggggctctgcctggatgacgcgggcgcaggcctggccctgtcgacagctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcagctggaagaagcacgccaacttcattctcgttttgaaaaagaatttagttttaagaatgaggagacagcacaggttgtcaggaagcaccaggagctgctggagtgtttgacggaggagagcgcagcaaaggcagagctggcgctggagctgcacaagactcagggtacccttgagggattcaaggtggagacagcagatctgaaggaggtgctggccgggaaggaggattccgagcaccgtctggtgctggagctggagagcctgagacggcagctgcagcaggcggcccaggagcaggcggcgctgagggaggagtgcacccgtctgtggagtcggggggaggccacagccacggacgccgaggccagagaagctgctctccggaaggaagtggaggatctgaccaaagaacagtcggagaccaggaagcaggctgagaaggaccgctcagccctgctctcccagatgaagattttggagtctgagttagaagaacagctgtctcagcatcgcgggtgtgccaagcaggcggaggccgtcactgccctggaacagcaggtggcatctctggacaagcatttgcgcaaccagcggcaattcatggatgagcaggcagccgagcgggagcacgagcgcgaggagttccagcaggagattcagaggctggaggggcagctccgccaggcggccaagccgcagccctggggccctcgcgacagccagcaggcgccgctggatggagaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccaggaagaagtggaaaaacagaaaaacatcgtgaaagggctggaacaggataaagaggtgttaaagaaacagcagatgagtagcttgcttctggcgtccacgttgcagtctacactagatgcaggcagatgtcccgagcctccttcgggcagccctcctgagggtccagaaatacagttagaggtgacacagagagcactcctgcggcgcgagagcgaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtcatatataccagaagttctgagattgaagagctgaaagccactattgaaaatctgcaagagaatcagaaacgattacaaaaggagaaagcagaggaaattgaacaactccatgaagtcattgagaagctgcagcacgagctgtccctcatggggcctgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagagccacactgcagaggctgggccccggaagagcccggtcgggatgctggacctgtcttcctggagctcccctgaggtcctcaggaaggactggaccctggagccctggcccagcctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggagaaagatgtcgaagattttatcacaacatcctttgattctcaagaaacattaagttcacctcctcctggattagaaggaaaagctgatagaagtgagaaaagtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcagggagacctgcaggaaaagtccctggagcatcttcgcttgccggaccggagcagcctgctgtccgagatccaggcgctgcgtgcccagctgcgcatgacgcacctgcagaaccaggagaagctgcagcacttgcgcacggcgctgacaagcncagaggcgcgcgggagccagcaggagcaccagctgcgcaggcaggttgaactgctggcttataaagtagagcaggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggagctgcgggcgtctttggagacacagcgtgctcagagcagtcgactctgcgtggcactgaaacacgagcagacggccaaggacaacctgcagaaggagctgcgtatcgagcactcacgctgcgaggccttgctggctcaggagcggagccagctctctgagctccagaaggaccttgcggctgagaagagccgcaccctggagctgtcagaggccttgcggcacgagcggctcctgaccgagcagctgagccagaggacacaggaggcttgcgtgcaccaggacacacaggcccatcacgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggagcgagaattagaactgcagcgtcagcgtgacttgcataagatcaagcagcttcagcagacggtgagagacctggagtcgaaggacgaggtgcctggcagccgcctccacctaggttctgcccgcagggctgccggctcggatgcggaccacctccgggaacagcagcgagagctggaggcgatgaggcagcggctgctctctgccgcccggcttctcaccagcttcaccagccaggccgtggacaggacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 459578 - DNA, 9023 bp, Homo sapiens
  misc_feature (6452)..(6452): n is a, c, g, or t
ctggggctgcaggaccatcgtctgtctccttgctggctgtgccccccacatccctgccacttcgagtgctgcttttgctcccagccctgtggctcttgccaccgcttggagagagctctccacattcaggggcgtacgagagtctaagccgtaggggtccctcatccctctccggttctgggatgggcccttttccgagttctgcccccaccacaggtaaccaggctcttgcctctcgcctggcttgttgtgggtgtcccattttaagacgattgcctgactccgttatgttgcagagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggttgtcctgtgtgggtttagaagagaaacctgagaaaggaagaaaagatcacgttgatgaactcgagcctgagcgacataaggagagcctgccacgcttccaggcggagttagaagaaagccacaggcaccagctggaagcgctggagtctcccctctgcatccagcacgaggggcatgtctcagacagatgctgcgtagagacttcagcattgggacacgagtggcgtctggaaccctctgaagggcacagccaagagcttccctgggtgcatctccagggtgtgcaggacggggacttggaggccgacacagagcgggcagccagagtcttgggtctggaaactgagcacaaggtgcaactttcgcttcttcagactgagctcaaagaagaaattgaactcctaaaaatagaaaatagaaatttgtttgagaagttgcagcatgaaactcgtctgaaggacgatttggagaaggtaaaacacaatctaattgaagaccaccagaaggaactaaataatgctaagcaaaagactgagctgatgaaacaggaattccaaagaaaagaaacggactggaaagttatgaaggaggagctacagcgggaagctgaggagaagttaacattgatgctacttgaactgagagaaaaggctgaatccgagaaacagaccatcataaacaagttggagcttcgagaagctgaaatgaggcagcttcaggaccaacaggcagcgcagatcctggatctggagaggtccttgacggagcagcaggcccgcctgcagcagctggaacaggacctcacttcagacgacgccctgcattgcagccagtgtgggcgggagccgcccacagcccaggacggggagcttgccgcgctccacgtgaaggaagactgcgccctgcagctgatgctggcccggagcaggtttttagaggaacgtaaagagatcgccgagaaattcagtgcggaacaagatgccttcctgcagctcctccaggagagacaccagcagcagctcctgtcagtgacggcggagctcgaggccagacaccaggccgcgttgggcgagctgacagcctccttagagagcaagcagggggctctgctggctgcacgtgtggccgaactgcagaccaaacacgctgccgacctcggcgctctggagaccagacatctgtccagccttgattctttggaatcctgttacctgtctgaatttcagaccatccgtgaggagcacaggcaggccctagagctcttacgagcagactttgaggaacaactgtggaaaaaggactctcttcaccaaacgattttgactcaagagttggagaaactgaagcggaaacacgaaggggagctacagtctgtgcgggaccacctgcgaaccgaagcgagcacagagctcgccggaaccgtggctcacgagctgcagggagtgcaccagggtgaatttggaagtgaaaagaaaactgctttgcatgaaaaagaggagacacttcggcttcagagtgcacaggcacagccttttcaccaagaggagaaagagtctttgtctctgcagcttcaaaagaagaatcaccaagtccagcagctgaaagaccaggttttatccttaagtcacgagatagaagagtgccgctccgagttggaggtgctgcagcagaggcgggagcgggagaaccgggaaggcgcaaacctcctctccatgctcaaggccgacgtcaacctgtcccacagcgaaagaggggccctccaggacgccctgcgcaggctgctgggtttgtttggagagacgctgagggcagccgtcaccctgaggagccggatcggggagcgcgtggggctctgcctggatgacgcgggcgcaggcctggccctgtcgacagctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcagctggaagaagcacgccaacttcattctcgttttgaaaaagaatttagttttaagaatgaggagacagcacaggttgtcaggaagcaccaggagctgctggagtgtttgacggaggagagcgcagcaaaggcagagctggcgctggagctgcacaagactcagggtacccttgagggattcaaggtggagacagcagatctgaaggaggtgctggccgggaaggaggattccgagcaccgtctggtgctggagctggagagcctgagacggcagctgcagcaggcggcccaggagcaggcggcgctgagggaggagtgcacccgtctgtggagtcggggggaggccacagccacggacgccgaggccagagaagctgctctccggaaggaagtggaggatctgaccaaagaacagtcggagaccaggaagcaggctgagaaggaccgctcagccctgctctcccagatgaagattttggagtctgagttagaagaacagctgtctcagcatcgcgggtgtgccaagcaggcggaggccgtcactgccctggaacagcaggtggcatctctggacaagcatttgcgcaaccagcggcaattcatggatgagcaggcagccgagcgggagcacgagcgcgaggagttccagcaggagattcagaggctggaggggcagctccgccaggcggccaagccgcagccctggggccctcgcgacagccagcaggcgccgctggatggagaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccaggaagaagtggaaaaacagaaaaacatcgtgaaagggctggaacaggataaagaggtgttaaagaaacagcagatgagtagcttgcttctggcgtccacgttgcagtctacactagatgcaggcagatgtcccgagcctccttcgggcagccctcctgagggtccagaaatacagttagaggtgacacagagagcactcctgcggcgcgagagcgaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtcatatataccagaagttctgagattgaagagctgaaagccactattgaaaatctgcaagagaatcagaaacgattacaaaaggagaaagcagaggaaattgaacaactccatgaagtcattgagaagctgcagcacgagctgtccctcatggggcctgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagagccacactgcagaggctgggccccggaagagcccggtcgggatgctggacctgtcttcctggagctcccctgaggtcctcaggaaggactggaccctggagccctggcccagcctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggagaaagatgtcgaagattttatcacaacatcctttgattctcaagaaacattaagttcacctcctcctggattagaaggaaaagctgatagaagtgagaaaagtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcagggagacctgcaggaaaagtccctggagcatcttcgcttgccggaccggagcagcctgctgtccgagatccaggcgctgcgtgcccagctgcgcatgacgcacctgcagaaccaggagaagctgcagcacttgcgcacggcgctgacaagcncagaggcgcgcgggagccagcaggagcaccagctgcgcaggcaggttgaactgctggcttataaagtagagcaggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggagctgcgggcgtctttggagacacagcgtgctcagagcagtcgactctgcgtggcactgaaacacgagcagacggccaaggacaacctgcagaaggagctgcgtatcgagcactcacgctgcgaggccttgctggctcaggagcggagccagctctctgagctccagaaggaccttgcggctgagaagagccgcaccctggagctgtcagaggccttgcggcacgagcggctcctgaccgagcagctgagccagaggacacaggaggcttgcgtgcaccaggacacacaggcccatcacgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggagcgagaattagaactgcagcgtcagcgtgacttgcataagatcaagcagcttcagcagacggtgagagacctggagtcgaaggacgaggtgcctggcagccgcctccacctaggttctgcccgcagggctgccggctcggatgcggaccacctccgggaacagcagcgagagctggaggcgatgaggcagcggctgctctctgccgcccggcttctcaccagcttcaccagccaggccgtggacaggacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 459579 - DNA, 7208 bp, Homo sapiens
  misc_feature (4637)..(4637): n is a, c, g, or t
acttactactactacttgccgctcttaggaatagtggatcatcggatccaagcggaaacacgaaggggagctacagtctgtgcgggaccacctgcgaaccgaagcgagcacagagctcgccggaaccgtggctcacgagctgcagggagtgcaccagggtgaatttggaagtgaaaagaaaactgctttgcatgaaaaagaggagacacttcggcttcagagtgcacaggcacagccttttcaccaagaggagaaagagtctttgtctctgcagcttcaaaagaagaatcaccaagtccagcagctgaaagaccaggttttatccttaagtcacgagatagaagagtgccgctccgagttggaggtgctgcagcagaggcgggagcgggagaaccgggaaggcgcaaacctcctctccatgctcaaggccgacgtcaacctgtcccacagcgaaagaggggccctccaggacgccctgcgcaggctgctgggtttgtttggagagacgctgagggcagccgtcaccctgaggagccggatcggggagcgcgtggggctctgcctggatgacgcgggcgcaggcctggccctgtcgacagctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcagctggaagaagcacgccaacttcattctcgttttgaaaaagaatttagttttaagaatgaggagacagcacaggttgtcaggaagcaccaggagctgctggagtgtttgacggaggagagcgcagcaaaggcagagctggcgctggagctgcacaagactcagggtacccttgagggattcaaggtggagacagcagatctgaaggaggtgctggccgggaaggaggattccgagcaccgtctggtgctggagctggagagcctgagacggcagctgcagcaggcggcccaggagcaggcggcgctgagggaggagtgcacccgtctgtggagtcggggggaggccacagccacggacgccgaggccagagaagctgctctccggaaggaagtggaggatctgaccaaagaacagtcggagaccaggaagcaggctgagaaggaccgctcagccctgctctcccagatgaagattttggagtctgagttagaagaacagctgtctcagcatcgcgggtgtgccaagcaggcggaggccgtcactgccctggaacagcaggtggcatctctggacaagcatttgcgcaaccagcggcaattcatggatgagcaggcagccgagcgggagcacgagcgcgaggagttccagcaggagattcagaggctggaggggcagctccgccaggcggccaagccgcagccctggggccctcgcgacagccagcaggcgccgctggatggagaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccaggaagaagtggaaaaacagaaaaacatcgtgaaagggctggaacaggataaagaggtgttaaagaaacagcagatgagtagcttgcttctggcgtccacgttgcagtctacactagatgcaggcagatgtcccgagcctccttcgggcagccctcctgagggtccagaaatacagttagaggtgacacagagagcactcctgcggcgcgagagcgaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtcatatataccagaagttctgagattgaagagctgaaagccactattgaaaatctgcaagagaatcagaaacgattacaaaaggagaaagcagaggaaattgaacaactccatgaagtcattgagaagctgcagcacgagctgtccctcatggggcctgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagagccacactgcagaggctgggccccggaagagcccggtcgggatgctggacctgtcttcctggagctcccctgaggtcctcaggaaggactggaccctggagccctggcccagcctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggagaaagatgtcgaagattttatcacaacatcctttgattctcaagaaacattaagttcacctcctcctggattagaaggaaaagctgatagaagtgagaaaagtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcagggagacctgcaggaaaagtccctggagcatcttcgcttgccggaccggagcagcctgctgtccgagatccaggcgctgcgtgcccagctgcgcatgacgcacctgcagaaccaggagaagctgcagcacttgcgcacggcgctgacaagcncagaggcgcgcgggagccagcaggagcaccagctgcgcaggcaggttgaactgctggcttataaagtagagcaggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggagctgcgggcgtctttggagacacagcgtgctcagagcagtcgactctgcgtggcactgaaacacgagcagacggccaaggacaacctgcagaaggagctgcgtatcgagcactcacgctgcgaggccttgctggctcaggagcggagccagctctctgagctccagaaggaccttgcggctgagaagagccgcaccctggagctgtcagaggccttgcggcacgagcggctcctgaccgagcagctgagccagaggacacaggaggcttgcgtgcaccaggacacacaggcccatcacgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggagcgagaattagaactgcagcgtcagcgtgacttgcataagatcaagcagcttcagcagacggtgagagacctggagtcgaaggacgaggtgcctggcagccgcctccacctaggttctgcccgcagggctgccggctcggatgcggaccacctccgggaacagcagcgagagctggaggcgatgaggcagcggctgctctctgccgcccggcttctcaccagcttcaccagccaggccgtggacaggacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 459580 - DNA, 7067 bp, Homo sapiens
  misc_feature (4496)..(4496): n is a, c, g, or t
gtctttgtgtccccactcgaggcctctgggttgtgctgctgtgtcctgaagctctgaactggtttggctctgctctggagaccacccagggtccggagaccaggtcgggcttatgggaccctctgagctcacagctgtttctggagcattggtgtctgtcatgctgagggtccatccgtgtgtggggggtgtctgtgcaggtctctctttgttcttttcatcaagttttgtgatttttctgtgaggaccttgccttctgtagcacttggctgtgggtgtctcgtagcttggtgctgactctctccagtcacccagaggggccctccaggacgccctgcgcaggctgctgggtttgtttggagagacgctgagggcagccgtcaccctgaggagccggatcggggagcgcgtggggctctgcctggatgacgcgggcgcaggcctggccctgtcgacagctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcagctggaagaagcacgccaacttcattctcgttttgaaaaagaatttagttttaagaatgaggagacagcacaggttgtcaggaagcaccaggagctgctggagtgtttgacggaggagagcgcagcaaaggcagagctggcgctggagctgcacaagactcagggtacccttgagggattcaaggtggagacagcagatctgaaggaggtgctggccgggaaggaggattccgagcaccgtctggtgctggagctggagagcctgagacggcagctgcagcaggcggcccaggagcaggcggcgctgagggaggagtgcacccgtctgtggagtcggggggaggccacagccacggacgccgaggccagagaagctgctctccggaaggaagtggaggatctgaccaaagaacagtcggagaccaggaagcaggctgagaaggaccgctcagccctgctctcccagatgaagattttggagtctgagttagaagaacagctgtctcagcatcgcgggtgtgccaagcaggcggaggccgtcactgccctggaacagcaggtggcatctctggacaagcatttgcgcaaccagcggcaattcatggatgagcaggcagccgagcgggagcacgagcgcgaggagttccagcaggagattcagaggctggaggggcagctccgccaggcggccaagccgcagccctggggccctcgcgacagccagcaggcgccgctggatggagaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccaggaagaagtggaaaaacagaaaaacatcgtgaaagggctggaacaggataaagaggtgttaaagaaacagcagatgagtagcttgcttctggcgtccacgttgcagtctacactagatgcaggcagatgtcccgagcctccttcgggcagccctcctgagggtccagaaatacagttagaggtgacacagagagcactcctgcggcgcgagagcgaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtcatatataccagaagttctgagattgaagagctgaaagccactattgaaaatctgcaagagaatcagaaacgattacaaaaggagaaagcagaggaaattgaacaactccatgaagtcattgagaagctgcagcacgagctgtccctcatggggcctgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagagccacactgcagaggctgggccccggaagagcccggtcgggatgctggacctgtcttcctggagctcccctgaggtcctcaggaaggactggaccctggagccctggcccagcctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggagaaagatgtcgaagattttatcacaacatcctttgattctcaagaaacattaagttcacctcctcctggattagaaggaaaagctgatagaagtgagaaaagtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcagggagacctgcaggaaaagtccctggagcatcttcgcttgccggaccggagcagcctgctgtccgagatccaggcgctgcgtgcccagctgcgcatgacgcacctgcagaaccaggagaagctgcagcacttgcgcacggcgctgacaagcncagaggcgcgcgggagccagcaggagcaccagctgcgcaggcaggttgaactgctggcttataaagtagagcaggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggagctgcgggcgtctttggagacacagcgtgctcagagcagtcgactctgcgtggcactgaaacacgagcagacggccaaggacaacctgcagaaggagctgcgtatcgagcactcacgctgcgaggccttgctggctcaggagcggagccagctctctgagctccagaaggaccttgcggctgagaagagccgcaccctggagctgtcagaggccttgcggcacgagcggctcctgaccgagcagctgagccagaggacacaggaggcttgcgtgcaccaggacacacaggcccatcacgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggagcgagaattagaactgcagcgtcagcgtgacttgcataagatcaagcagcttcagcagacggtgagagacctggagtcgaaggacgaggtgcctggcagccgcctccacctaggttctgcccgcagggctgccggctcggatgcggaccacctccgggaacagcagcgagagctggaggcgatgaggcagcggctgctctctgccgcccggcttctcaccagcttcaccagccaggccgtggacaggacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 459581 - DNA, 10378 bp, Homo sapiens
  misc_feature (7570)..(7570): n is a, c, g, or t
aagcgcgggggagggagtgtaaatagagcgaaggctgctctgtgtcagccccgtcaccgccgggcggcccgcgcggagtctgagggagatggaagttgagcaagagcagcggcgcagaaaggtggaggccgggaggacgaagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatggggcaggaggggcctttgcagctcagccggaggactgtgatggagagaagagagaggacttggaacagctgcagcagaagcaagtcaatgaccatcctccagagcagtgtgggatgttcacagtcagtgaccacccaccagaacagcatgggatgttcacagtcggtgaccacccaccagaacagcgtgggatgttcacaagtcagtgaccacccaccagaacagcgtgggatgttcacaatcagtgaccaccaaccggaacagcgtgggatgttcacagtcagtgaccacacaccagaacagcgtgggatcttcacaatcagtgaccacccagcagaacagcgtgggatgttcacaaaggagtgtgaacaagaatgtgaacttgccattactgacctggagagcggccgtgaagatgaggctggcctgcatcagagtcagaggccttttctccgccgcaggccgtgcatggccttgagctggaggcgctgcgcctgagtctgagcaacatgcacacggcgcagctggagctgacacaggccaacctccagaaggagaaggagacggcattgacggagctgcgggagatgctcaacagccggcgtgcccaggagctggccctgctacagagcaggcagcagcacgagctggagctcctcagggagcagcacgcacgggagaaggaggaggtggtgctcaggtgtggacaggaagcagctgagctgaaggagaagttacaatcagaaatggagaaaaacgcccagatagtaaagaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgggcccttaggaacctggagagtcatcatcaagcagccattgagaagttacgtgaagacctgcagtccgagcacggccggtgtttagaagacttggagttcaagttcaaagagagcgagaaagaaaaacagctggagttagagaatcttcaagcatcatatgaagacctgaaggcacaatcacaagaagagatcaggcgcttgtggtcccagcttgattctgccaggaccagtagacaggaattgagtgagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggttgtcctgtgtgggtttagaagagaaacctgagaaaggaagaaaagatcacgttgatgaactcgagcctgagcgacataaggagagcctgccacgcttccaggcggagttagaagaaagccacaggcaccagctggaagcgctggagtctcccctctgcatccagcacgaggggcatgtctcagacagatgctgcgtagagacttcagcattgggacacgagtggcgtctggaaccctctgaagggcacagccaagagcttccctgggtgcatctccagggtgtgcaggacggggacttggaggccgacacagagcgggcagccagagtcttgggtctggaaactgagcacaaggtgcaactttcgcttcttcagactgagctcaaagaagaaattgaactcctaaaaatagaaaatagaaatttgtttgagaagttgcagcatgaaactcgtctgaaggacgatttggagaaggtaaaacacaatctaattgaagaccaccagaaggaactaaataatgctaagcaaaagactgagctgatgaaacaggaattccaaagaaaagaaacggactggaaagttatgaaggaggagctacagcgggaagctgaggagaagttaacattgatgctacttgaactgagagaaaaggctgaatccgagaaacagaccatcataaacaagttggagcttcgagaagctgaaatgaggcagcttcaggaccaacaggcagcgcagatcctggatctggagaggtccttgacggagcagcaggcccgcctgcagcagctggaacaggacctcacttcagacgacgccctgcattgcagccagtgtgggcgggagccgcccacagcccaggacggggagcttgccgcgctccacgtgaaggaagactgcgccctgcagctgatgctggcccggagcaggtttttagaggaacgtaaagagatcgccgagaaattcagtgcggaacaagatgccttcctgcagctcctccaggagagacaccagcagcagctcctgtcagtgacggcggagctcgaggccagacaccaggccgcgttgggcgagctgacagcctccttagagagcaagcagggggctctgctggctgcacgtgtggccgaactgcagaccaaacacgctgccgacctcggcgctctggagaccagacatctgtccagccttgattctttggaatcctgttacctgtctgaatttcagaccatccgtgaggagcacaggcaggccctagagctcttacgagcagactttgaggaacaactgtggaaaaaggactctcttcaccaaacgattttgactcaagagttggagaaactgaagcggaaacacgaaggggagctacagtctgtgcgggaccacctgcgaaccgaagcgagcacagagctcgccggaaccgtggctcacgagctgcagggagtgcaccagggtgaatttggaagtgaaaagaaaactgctttgcatgaaaaagaggagacacttcggcttcagagtgcacaggcacagccttttcaccaagaggagaaagagtctttgtctctgcagcttcaaaagaagaatcaccaagtccagcagctgaaagaccaggttttatccttaagtcacgagatagaagagtgccgctccgagttggaggtgctgcagcagaggcgggagcgggagaaccgggaaggcgcaaacctcctctccatgctcaaggccgacgtcaacctgtcccacagcgaaagaggggccctccaggacgccctgcgcaggctgctgggtttgtttggagagacgctgagggcagccgtcaccctgaggagccggatcggggagcgcgtggggctctgcctggatgacgcgggcgcaggcctggccctgtcgacagctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcagctggaagaagcacgccaacttcattctcgttttgaaaaagaatttagttttaagaatgaggagacagcacaggttgtcaggaagcaccaggagctgctggagtgtttgacggaggagagcgcagcaaaggcagagctggcgctggagctgcacaagactcagggtacccttgagggattcaaggtggagacagcagatctgaaggaggtgctggccgggaaggaggattccgagcaccgtctggtgctggagctggagagcctgagacggcagctgcagcaggcggcccaggagcaggcggcgctgagggaggagtgcacccgtctgtggagtcggggggaggccacagccacggacgccgaggccagagaagctgctctccggaaggaagtggaggatctgaccaaagaacagtcggagaccaggaagcaggctgagaaggaccgctcagccctgctctcccagatgaagattttggagtctgagttagaagaacagctgtctcagcatcgcgggtgtgccaagcaggcggaggccgtcactgccctggaacagcaggtggcatctctggacaagcatttgcgcaaccagcggcaattcatggatgagcaggcagccgagcgggagcacgagcgcgaggagttccagcaggagattcagaggctggaggggcagctccgccaggcggccaagccgcagccctggggccctcgcgacagccagcaggcgccgctggatggagaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccaggaagaagtggaaaaacagaaaaacatcgtgaaagggctggaacaggataaagaggtgttaaagaaacagcagatgagtagcttgcttctggcgtccacgttgcagtctacactagatgcaggcagatgtcccgagcctccttcgggcagccctcctgagggtccagaaatacagttagaggtgacacagagagcactcctgcggcgcgagagcgaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtcatatataccagaagttctgagattgaagagctgaaagccactattgaaaatctgcaagagaatcagaaacgattacaaaaggagaaagcagaggaaattgaacaactccatgaagtcattgagaagctgcagcacgagctgtccctcatggggcctgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagacctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggagaaagatgtcgaagattttatcacaacatcctttgattctcaagaaacattaagttcacctcctcctggattagaaggaaaagctgatagaagtgagaaaagtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcagggagacctgcaggaaaagtccctggagcatcttcgcttgccggaccggagcagcctgctgtccgagatccaggcgctgcgtgcccagctgcgcatgacgcacctgcagaaccaggagaagctgcagcacttgcgcacggcgctgacaagcncagaggcgcgcgggagccagcaggagcaccagctgcgcaggcaggttgaactgctggcttataaagtagagcaggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggagctgcgggcgtctttggagacacagcgtgctcagagcagtcgactctgcgtggcactgaaacacgagcagacggccaaggacaacctgcagaaggagctgcgtatcgagcactcacgctgcgaggccttgctggctcaggagcggagccagctctctgagctccagaaggaccttgcggctgagaagagccgcaccctggagctgtcagaggccttgcggcacgagcggctcctgaccgagcagctgagccagaggacacaggaggcttgcgtgcaccaggacacacaggcccatcacgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggaggtaagtgccacactgaagtcgacggtggaagccctgcacacccaaaaacgagagctgagatgctctctggagagagagagggagaaaccagcgtggttgcaggcagaattagagcagtcacacccacggttgaaagagcaagaaggacgcaaggctgcgaggaggagcgcggaggccaggcagagcccagcggctgcggagcagtggaggaagtggcagagagacaaggagaagctgcgagaattagaactgcagcgtcagcgtgacttgcataagatcaagcagcttcagcagacggtgagagacctggagtcgaaggacgaggtgcctggcagccgcctccacctaggttctgcccgcagggctgccggctcggatgcggaccacctccgggaacagcagcgagagctggaggcgatgaggcagcggctgctctctgccgcccggcttctcaccagcttcaccagccaggccgtggacaggacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 459582 - DNA, 9682 bp, Homo sapiens
aagcgcgggggagggagtgtaaatagagcgaaggctgctctgtgtcagccccgtcaccgccgggcggcccgcgcggagtctgagggagatggaagttgagcaagagcagcggcgcagaaaggtggaggccgggaggacgaagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatggggcaggaggggcctttgcagctcagccggaggactgtgatggagagaagagagaggacttggaacagctgcagcagaagcaagtcaatgaccatcctccagagcagtgtgggatgttcacagtcagtgaccacccaccagaacagcatgggatgttcacagtcggtgaccacccaccagaacagcgtgggatgttcacaagtcagtgaccacccaccagaacagcgtgggatgttcacaatcagtgaccaccaaccggaacagcgtgggatgttcacagtcagtgaccacacaccagaacagcgtgggatcttcacaatcagtgaccacccagcagaacagcgtgggatgttcacaaaggagtgtgaacaagaatgtgaacttgccattactgacctggagagcggccgtgaagatgaggctggcctgcatcagagtcagaggccttttctccgccgcaggccgtgcatggccttgagctggaggcgctgcgcctgagtctgagcaacatgcacacggcgcagctggagctgacacaggccaacctccagaaggagaaggagacggcattgacggagctgcgggagatgctcaacagccggcgtgcccaggagctggccctgctacagagcaggcagcagcacgagctggagctcctcagggagcagcacgcacgggagaaggaggaggtggtgctcaggtgtggacaggaagcagctgagctgaaggagaagttacaatcagaaatggagaaaaacgcccagatagtaaagaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgggcccttaggaacctggagagtcatcatcaagcagccattgagaagttacgtgaagacctgcagtccgagcacggccggtgtttagaagacttggagttcaagttcaaagagagcgagaaagaaaaacagctggagttagagaatcttcaagcatcatatgaagacctgaaggcacaatcacaagaagagatcaggcgcttgtggtcccagcttgattctgccaggaccagtagacaggaattgagtgagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggttgtcctgtgtgggtttagaagagaaacctgagaaaggaagaaaagatcacgttgatgaactcgagcctgagcgacataaggagagcctgccacgcttccaggcggagttagaagaaagccacaggcaccagctggaagcgctggagtctcccctctgcatccagcacgaggggcatgtctcagacagatgctgcgtagagacttcagcattgggacacgagtggcgtctggaaccctctgaagggcacagccaagagcttccctgggtgcatctccagggtgtgcaggacggggacttggaggccgacacagagcgggcagccagagtcttgggtctggaaactgagcacaaggtgcaactttcgcttcttcagactgagctcaaagaagaaattgaactcctaaaaatagaaaatagaaatttgtttgagaagttgcagcatgaaactcgtctgaaggacgatttggagaaggtaaaacacaatctaattgaagaccaccagaaggaactaaataatgctaagcaaaagactgagctgatgaaacaggaattccaaagaaaagaaacggactggaaagttatgaaggaggagctacagcgggaagctgaggagaagttaacattgatgctacttgaactgagagaaaaggctgaatccgagaaacagaccatcataaacaagttggagcttcgagaagctgaaatgaggcagcttcaggaccaacaggcagcgcagatcctggatctggagaggtccttgacggagcagcaggcccgcctgcagcagctggaacaggacctcacttcagacgacgccctgcattgcagccagtgtgggcgggagccgcccacagcccaggacggggagcttgccgcgctccacgtgaaggaagactgcgccctgcagctgatgctggcccggagcaggtttttagaggaacgtaaagagatcgccgagaaattcagtgcggaacaagatgccttcctgcagctcctccaggagagacaccagcagcagctcctgtcagtgacggcggagctcgaggccagacaccaggccgcgttgggcgagctgacagcctccttagagagcaagcagggggctctgctggctgcacgtgtggccgaactgcagaccaaacacgctgccgacctcggcgctctggagaccagacatctgtccagccttgattctttggaatcctgttacctgtctgaatttcagaccatccgtgaggagcacaggcaggccctagagctcttacgagcagactttgaggaacaactgtggaaaaaggactctcttcaccaaacgattttgactcaagagttggagaaactgaagcggaaacacgaaggggagctacagtctgtgcgggaccacctgcgaaccgaagcgagcacagagctcgccggaaccgtggctcacgagctgcagggagtgcaccagggtgaatttggaagtgaaaagaaaactgctttgcatgaaaaagaggagacacttcggcttcagagtgcacaggcacagccttttcaccaagaggagaaagagtctttgtctctgcagcttcaaaagaagaatcaccaagtccagcagctgaaagaccaggttttatccttaagtcacgagatagaagagtgccgctccgagttggaggtgctgcagcagaggcgggagcgggagaaccgggaaggcgcaaacctcctctccatgctcaaggccgacgtcaacctgtcccacagcgaaagaggggccctccaggacgccctgcgcaggctgctgggtttgtttggagagacgctgagggcagccgtcaccctgaggagccggatcggggagcgcgtggggctctgcctggatgacgcgggcgcaggcctggccctgtcgacagctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcagctggaagaagcacgccaacttcattctcgttttgaaaaagaatttagttttaagaatgaggagacagcacaggttgtcaggaagcaccaggagctgctggagtgtttgacggaggagagcgcagcaaaggcagagctggcgctggagctgcacaagactcagggtacccttgagggattcaaggtggagacagcagatctgaaggaggtgctggccgggaaggaggattccgagcaccgtctggtgctggagctggagagcctgagacggcagctgcagcaggcggcccaggagcaggcggcgctgagggaggagtgcacccgtctgtggagtcggggggaggccacagccacggacgccgaggccagagaagctgctctccggaaggaagtggaggatctgaccaaagaacagtcggagaccaggaagcaggctgagaaggaccgctcagccctgctctcccagatgaagattttggagtctgagttagaagaacagctgtctcagcatcgcgggtgtgccaagcaggcggaggccgtcactgccctggaacagcaggtggcatctctggacaagcatttgcgcaaccagcggcaattcatggatgagcaggcagccgagcgggagcacgagcgcgaggagttccagcaggagattcagaggctggaggggcagctccgccaggcggccaagccgcagccctggggccctcgcgacagccagcaggcgccgctggatggagaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccaggaagaagtggaaaaacagaaaaacatcgtgaaagggctggaacaggataaagaggtgttaaagaaacagcagatgagtagcttgcttctggcgtccacgttgcagtctacactagatgcaggcagatgtcccgagcctccttcgggcagccctcctgagggtccagaaatacagttagaggtgacacagagagcactcctgcggcgcgagagcgaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtcatatataccagaagttctgagattgaagagctgaaagccactattgaaaatctgcaagagaatcagaaacgattacaaaaggagaaagcagaggaaattgaacaactccatgaagtcattgagaagctgcagcacgagctgtccctcatggggcctgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagagccacactgcagaggctgggccccggaagagcccggtcgggatgctggacctgtcttcctggagctcccctgaggtcctcaggaaggactggaccctggagccctggcccagcctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggagaaagatgtcgaagattttatcacaacatcctttgattctcaagaaacattaagttcacctcctcctggattagaaggaaaagctgatagaagtgagaaaagtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggaagtgcccaccgcgtgccccgattggagaaggagctgcgtatcgagcactcacgctgcgaggccttgctggctcaggagcggagccagctctctgagctccagaaggaccttgcggctgagaagagccgcaccctggagctgtcagaggccttgcggcacgagcggctcctgaccgagcagctgagccagaggacacaggaggcttgcgtgcaccaggacacacaggcccatcacgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggaggtaagtgccacactgaagtcgacggtggaagccctgcacacccaaaaacgagagctgagatgctctctggagagagagagggagaaaccagcgtggttgcaggcagaattagagcagtcacacccacggttgaaagagcaagaaggacgcaaggctgcgaggaggagcgcggaggccaggcagagcccagcggctgcggagcagtggaggaagtggcagagagacaaggagaagctgcgagaattagaactgcagcgtcagcgtgacttgcataagatcaagcagcttcagcagacggtgagagacctggagtcgaaggacgaggtgcctggcagccgcctccacctaggttctgcccgcagggctgccggctcggatgcggaccacctccgggaacagcagcgagagctggaggcgatgaggcagcggctgctctctgccgcccggcttctcaccagcttcaccagccaggccgtggacaggacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 459583 - DNA, 10952 bp, Homo sapiens
  misc_feature (7682)..(7682): n is a, c, g, or t
aagcgcgggggagggagtgtaaatagagcgaaggctgctctgtgtcagccccgtcaccgccgggcggcccgcgcggagtctgagggagatggaagttgagcaagagcagcggcgcagaaaggtggaggccgggaggacgaagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatggggcaggaggggcctttgcagctcagccggaggactgtgatggagagaagagagaggacttggaacagctgcagcagaagcaagtcaatgaccatcctccagagcagtgtgggatgttcacagtcagtgaccacccaccagaacagcatgggatgttcacagtcggtgaccacccaccagaacagcgtgggatgttcacaagtcagtgaccacccaccagaacagcgtgggatgttcacaatcagtgaccaccaaccggaacagcgtgggatgttcacagtcagtgaccacacaccagaacagcgtgggatcttcacaatcagtgaccacccagcagaacagcgtgggatgttcacaaaggagtgtgaacaagaatgtgaacttgccattactgacctggagagcggccgtgaagatgaggctggcctgcatcagagtcagaggccttttctccgccgcaggccgtgcatggccttgagctggaggcgctgcgcctgagtctgagcaacatgcacacggcgcagctggagctgacacaggccaacctccagaaggagaaggagacggcattgacggagctgcgggagatgctcaacagccggcgtgcccaggagctggccctgctacagagcaggcagcagcacgagctggagctcctcagggagcagcacgcacgggagaaggaggaggtggtgctcaggtgtggacaggaagcagctgagctgaaggagaagttacaatcagaaatggagaaaaacgcccagatagtaaagaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgggcccttaggaacctggagagtcatcatcaagcagccattgagaagttacgtgaagacctgcagtccgagcacggccggtgtttagaagacttggagttcaagttcaaagagagcgagaaagaaaaacagctggagttagagaatcttcaagcatcatatgaagacctgaaggcacaatcacaagaagagatcaggcgcttgtggtcccagcttgattctgccaggaccagtagacaggaattgagtgagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggttgtcctgtgtgggtttagaagagaaacctgagaaaggaagaaaagatcacgttgatgaactcgagcctgagcgacataaggagagcctgccacgcttccaggcggagttagaagaaagccacaggcaccagctggaagcgctggagtctcccctctgcatccagcacgaggggcatgtctcagacagatgctgcgtagagacttcagcattgggacacgagtggcgtctggaaccctctgaagggcacagccaagagcttccctgggtgcatctccagggtgtgcaggacggggacttggaggccgacacagagcgggcagccagagtcttgggtctggaaactgagcacaaggtgcaactttcgcttcttcagactgagctcaaagaagaaattgaactcctaaaaatagaaaatagaaatttgtttgagaagttgcagcatgaaactcgtctgaaggacgatttggagaaggtaaaacacaatctaattgaagaccaccagaaggaactaaataatgctaagcaaaagactgagctgatgaaacaggaattccaaagaaaagaaacggactggaaagttatgaaggaggagctacagcgggaagctgaggagaagttaacattgatgctacttgaactgagagaaaaggctgaatccgagaaacagaccatcataaacaagttggagcttcgagaagctgaaatgaggcagcttcaggaccaacaggcagcgcagatcctggatctggagaggtccttgacggagcagcaggcccgcctgcagcagctggaacaggacctcacttcagacgacgccctgcattgcagccagtgtgggcgggagccgcccacagcccaggacggggagcttgccgcgctccacgtgaaggaagactgcgccctgcagctgatgctggcccggagcaggtttttagaggaacgtaaagagatcgccgagaaattcagtgcggaacaagatgccttcctgcagctcctccaggagagacaccagcagcagctcctgtcagtgacggcggagctcgaggccagacaccaggccgcgttgggcgagctgacagcctccttagagagcaagcagggggctctgctggctgcacgtgtggccgaactgcagaccaaacacgctgccgacctcggcgctctggagaccagacatctgtccagccttgattctttggaatcctgttacctgtctgaatttcagaccatccgtgaggagcacaggcaggccctagagctcttacgagcagactttgaggaacaactgtggaaaaaggactctcttcaccaaacgattttgactcaagagttggagaaactgaagcggaaacacgaaggggagctacagtctgtgcgggaccacctgcgaaccgaagcgagcacagagctcgccggaaccgtggctcacgagctgcagggagtgcaccagggtgaatttggaagtgaaaagaaaactgctttgcatgaaaaagaggagacacttcggcttcagagtgcacaggcacagccttttcaccaagaggagaaagagtctttgtctctgcagcttcaaaagaagaatcaccaagtccagcagctgaaagaccaggttttatccttaagtcacgagatagaagagtgccgctccgagttggaggtgctgcagcagaggcgggagcgggagaaccgggaaggcgcaaacctcctctccatgctcaaggccgacgtcaacctgtcccacagcgaaagaggggccctccaggacgccctgcgcaggctgctgggtttgtttggagagacgctgagggcagccgtcaccctgaggagccggatcggggagcgcgtggggctctgcctggatgacgcgggcgcaggcctggccctgtcgacagctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcagctggaagaagcacgccaacttcattctcgttttgaaaaagaatttagttttaagaatgaggagacagcacaggttgtcaggaagcaccaggagctgctggagtgtttgacggaggagagcgcagcaaaggcagagctggcgctggagctgcacaagactcagggtacccttgagggattcaaggtggagacagcagatctgaaggaggtgctggccgggaaggaggattccgagcaccgtctggtgctggagctggagagcctgagacggcagctgcagcaggcggcccaggagcaggcggcgctgagggaggagtgcacccgtctgtggagtcggggggaggccacagccacggacgccgaggccagagaagctgctctccggaaggaagtggaggatctgaccaaagaacagtcggagaccaggaagcaggctgagaaggaccgctcagccctgctctcccagatgaagattttggagtctgagttagaagaacagctgtctcagcatcgcgggtgtgccaagcaggcggaggccgtcactgccctggaacagcaggtggcatctctggacaagcatttgcgcaaccagcggcaattcatggatgagcaggcagccgagcgggagcacgagcgcgaggagttccagcaggagattcagaggctggaggggcagctccgccaggcggccaagccgcagccctggggccctcgcgacagccagcaggcgccgctggatggagaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccaggaagaagtggaaaaacagaaaaacatcgtgaaagggctggaacaggataaagaggtgttaaagaaacagcagatgagtagcttgcttctggcgtccacgttgcagtctacactagatgcaggcagatgtcccgagcctccttcgggcagccctcctgagggtccagaaatacagttagaggtgacacagagagcactcctgcggcgcgagagcgaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtcatatataccagaagttctgagattgaagagctgaaagccactattgaaaatctgcaagagaatcagaaacgattacaaaaggagaaagcagaggaaattgaacaactccatgaagtcattgagaagctgcagcacgagctgtccctcatggggcctgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagagccacactgcagaggctgggccccggaagagcccggtcgggatgctggacctgtcttcctggagctcccctgaggtcctcaggaaggactggaccctggagccctggcccagcctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggagaaagatgtcgaagattttatcacaacatcctttgattctcaagaaacattaagttcacctcctcctggattagaaggaaaagctgatagaagtgagaaaagtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcagggagacctgcaggaaaagtccctggagcatcttcgcttgccggaccggagcagcctgctgtccgagatccaggcgctgcgtgcccagctgcgcatgacgcacctgcagaaccaggagaagctgcagcacttgcgcacggcgctgacaagcncagaggcgcgcgggagccagcaggagcaccagctgcgcaggcaggttgaactgctggcttataaagtagagcaggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggagctgcgggcgtctttggagacacagcgtgctcagagcagtcgactctgcgtggcactgaaacacgagcagacggccaaggacaacctgcagaaggagctgcgtatcgagcactcacgctgcgaggccttgctggctcaggagcggagccagctctctgagctccagaaggaccttgcggctgagaagagccgcaccctggagctgtcagaggccttgcggcacgagcggctcctgaccgagcagctgagccagaggacacaggaggcttgcgtgcaccaggacacacaggcccatcacgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggaggtaagtgccacactgaagtcgacggtggaagccctgcacacccaaaaacgagagctgagatgctctctggagagagagagggagaaaccagcgtggttgcaggcagaattagagcagtcacacccacggttgaaagagcaagaaggacgcaaggctgcgaggaggagcgcggaggccaggcagagcccagcggctgcggagcagtggaggaagtggcagagagacaaggagaagctgcgagaattagaactgcagcgtcagcgtgacttgcataagatcaagcagcttcagcagacggtgagagacctggagtcgaaggacgaggtgcctggcagccgcctccacctaggttctgcccgcagggctgccggctcggatgcggaccacctccgggaacagcagcgagagctggaggcgatgaggcagcggctgctctctgccgcccggcttctcaccagcttcaccagccaggccgtggacaggacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccaggtaatgcaagtcctcgccgagtatttattaagctgattatcactgtaccctggaaacgtagggtctgttgaaagatggctggtattcagcttagtaaccaaagtttcagtctgaacaatcagtgtcactaatagtattagaatagaggctacaagtgaagaatctcacagaagtctaagccagtgtactcagtgatacgtgctgaggtcagtttgacttaatcaccgtctggacttttttgtcctttctcttacattgatagcgaacataaagattatatttcgaccaggatataatttgttcagtgtttcttaaatatcataatttaaaccactgtataattcatatttttaccaaaatttacatgaattcagtgatagtgtttcaaaattgtggaattcttttcaaaaaatctgtgaagccttgtaaccaatttgctgcctcatttttatttatatgcagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 459584 - DNA, 11129 bp, Homo sapiens
  misc_feature (7682)..(7682): n is a, c, g, or t
  misc_feature (10930)..(10931): n is a, c, g, or t
  misc_feature (10951)..(10951): n is a, c, g, or t
  misc_feature (10960)..(10960): n is a, c, g, or t
  misc_feature (11045)..(11045): n is a, c, g, or t
aagcgcgggggagggagtgtaaatagagcgaaggctgctctgtgtcagccccgtcaccgccgggcggcccgcgcggagtctgagggagatggaagttgagcaagagcagcggcgcagaaaggtggaggccgggaggacgaagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatggggcaggaggggcctttgcagctcagccggaggactgtgatggagagaagagagaggacttggaacagctgcagcagaagcaagtcaatgaccatcctccagagcagtgtgggatgttcacagtcagtgaccacccaccagaacagcatgggatgttcacagtcggtgaccacccaccagaacagcgtgggatgttcacaagtcagtgaccacccaccagaacagcgtgggatgttcacaatcagtgaccaccaaccggaacagcgtgggatgttcacagtcagtgaccacacaccagaacagcgtgggatcttcacaatcagtgaccacccagcagaacagcgtgggatgttcacaaaggagtgtgaacaagaatgtgaacttgccattactgacctggagagcggccgtgaagatgaggctggcctgcatcagagtcagaggccttttctccgccgcaggccgtgcatggccttgagctggaggcgctgcgcctgagtctgagcaacatgcacacggcgcagctggagctgacacaggccaacctccagaaggagaaggagacggcattgacggagctgcgggagatgctcaacagccggcgtgcccaggagctggccctgctacagagcaggcagcagcacgagctggagctcctcagggagcagcacgcacgggagaaggaggaggtggtgctcaggtgtggacaggaagcagctgagctgaaggagaagttacaatcagaaatggagaaaaacgcccagatagtaaagaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgggcccttaggaacctggagagtcatcatcaagcagccattgagaagttacgtgaagacctgcagtccgagcacggccggtgtttagaagacttggagttcaagttcaaagagagcgagaaagaaaaacagctggagttagagaatcttcaagcatcatatgaagacctgaaggcacaatcacaagaagagatcaggcgcttgtggtcccagcttgattctgccaggaccagtagacaggaattgagtgagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggttgtcctgtgtgggtttagaagagaaacctgagaaaggaagaaaagatcacgttgatgaactcgagcctgagcgacataaggagagcctgccacgcttccaggcggagttagaagaaagccacaggcaccagctggaagcgctggagtctcccctctgcatccagcacgaggggcatgtctcagacagatgctgcgtagagacttcagcattgggacacgagtggcgtctggaaccctctgaagggcacagccaagagcttccctgggtgcatctccagggtgtgcaggacggggacttggaggccgacacagagcgggcagccagagtcttgggtctggaaactgagcacaaggtgcaactttcgcttcttcagactgagctcaaagaagaaattgaactcctaaaaatagaaaatagaaatttgtttgagaagttgcagcatgaaactcgtctgaaggacgatttggagaaggtaaaacacaatctaattgaagaccaccagaaggaactaaataatgctaagcaaaagactgagctgatgaaacaggaattccaaagaaaagaaacggactggaaagttatgaaggaggagctacagcgggaagctgaggagaagttaacattgatgctacttgaactgagagaaaaggctgaatccgagaaacagaccatcataaacaagttggagcttcgagaagctgaaatgaggcagcttcaggaccaacaggcagcgcagatcctggatctggagaggtccttgacggagcagcaggcccgcctgcagcagctggaacaggacctcacttcagacgacgccctgcattgcagccagtgtgggcgggagccgcccacagcccaggacggggagcttgccgcgctccacgtgaaggaagactgcgccctgcagctgatgctggcccggagcaggtttttagaggaacgtaaagagatcgccgagaaattcagtgcggaacaagatgccttcctgcagctcctccaggagagacaccagcagcagctcctgtcagtgacggcggagctcgaggccagacaccaggccgcgttgggcgagctgacagcctccttagagagcaagcagggggctctgctggctgcacgtgtggccgaactgcagaccaaacacgctgccgacctcggcgctctggagaccagacatctgtccagccttgattctttggaatcctgttacctgtctgaatttcagaccatccgtgaggagcacaggcaggccctagagctcttacgagcagactttgaggaacaactgtggaaaaaggactctcttcaccaaacgattttgactcaagagttggagaaactgaagcggaaacacgaaggggagctacagtctgtgcgggaccacctgcgaaccgaagcgagcacagagctcgccggaaccgtggctcacgagctgcagggagtgcaccagggtgaatttggaagtgaaaagaaaactgctttgcatgaaaaagaggagacacttcggcttcagagtgcacaggcacagccttttcaccaagaggagaaagagtctttgtctctgcagcttcaaaagaagaatcaccaagtccagcagctgaaagaccaggttttatccttaagtcacgagatagaagagtgccgctccgagttggaggtgctgcagcagaggcgggagcgggagaaccgggaaggcgcaaacctcctctccatgctcaaggccgacgtcaacctgtcccacagcgaaagaggggccctccaggacgccctgcgcaggctgctgggtttgtttggagagacgctgagggcagccgtcaccctgaggagccggatcggggagcgcgtggggctctgcctggatgacgcgggcgcaggcctggccctgtcgacagctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcagctggaagaagcacgccaacttcattctcgttttgaaaaagaatttagttttaagaatgaggagacagcacaggttgtcaggaagcaccaggagctgctggagtgtttgacggaggagagcgcagcaaaggcagagctggcgctggagctgcacaagactcagggtacccttgagggattcaaggtggagacagcagatctgaaggaggtgctggccgggaaggaggattccgagcaccgtctggtgctggagctggagagcctgagacggcagctgcagcaggcggcccaggagcaggcggcgctgagggaggagtgcacccgtctgtggagtcggggggaggccacagccacggacgccgaggccagagaagctgctctccggaaggaagtggaggatctgaccaaagaacagtcggagaccaggaagcaggctgagaaggaccgctcagccctgctctcccagatgaagattttggagtctgagttagaagaacagctgtctcagcatcgcgggtgtgccaagcaggcggaggccgtcactgccctggaacagcaggtggcatctctggacaagcatttgcgcaaccagcggcaattcatggatgagcaggcagccgagcgggagcacgagcgcgaggagttccagcaggagattcagaggctggaggggcagctccgccaggcggccaagccgcagccctggggccctcgcgacagccagcaggcgccgctggatggagaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccaggaagaagtggaaaaacagaaaaacatcgtgaaagggctggaacaggataaagaggtgttaaagaaacagcagatgagtagcttgcttctggcgtccacgttgcagtctacactagatgcaggcagatgtcccgagcctccttcgggcagccctcctgagggtccagaaatacagttagaggtgacacagagagcactcctgcggcgcgagagcgaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtcatatataccagaagttctgagattgaagagctgaaagccactattgaaaatctgcaagagaatcagaaacgattacaaaaggagaaagcagaggaaattgaacaactccatgaagtcattgagaagctgcagcacgagctgtccctcatggggcctgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagagccacactgcagaggctgggccccggaagagcccggtcgggatgctggacctgtcttcctggagctcccctgaggtcctcaggaaggactggaccctggagccctggcccagcctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggagaaagatgtcgaagattttatcacaacatcctttgattctcaagaaacattaagttcacctcctcctggattagaaggaaaagctgatagaagtgagaaaagtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcagggagacctgcaggaaaagtccctggagcatcttcgcttgccggaccggagcagcctgctgtccgagatccaggcgctgcgtgcccagctgcgcatgacgcacctgcagaaccaggagaagctgcagcacttgcgcacggcgctgacaagcncagaggcgcgcgggagccagcaggagcaccagctgcgcaggcaggttgaactgctggcttataaagtagagcaggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggagctgcgggcgtctttggagacacagcgtgctcagagcagtcgactctgcgtggcactgaaacacgagcagacggccaaggacaacctgcagaaggagctgcgtatcgagcactcacgctgcgaggccttgctggctcaggagcggagccagctctctgagctccagaaggaccttgcggctgagaagagccgcaccctggagctgtcagaggccttgcggcacgagcggctcctgaccgagcagctgagccagaggacacaggaggcttgcgtgcaccaggacacacaggcccatcacgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggaggtaagtgccacactgaagtcgacggtggaagccctgcacacccaaaaacgagagctgagatgctctctggagagagagagggagaaaccagcgtggttgcaggcagaattagagcagtcacacccacggttgaaagagcaagaaggacgcaaggctgcgaggaggagcgcggaggccaggcagagcccagcggctgcggagcagtggaggaagtggcagagagacaaggagaagctgcgagaattagaactgcagcgtcagcgtgacttgcataagatcaagcagcttcagcagacggtgagagacctggagtcgaaggacgaggtgcctggcagccgcctccacctaggttctgcccgcagggctgccggctcggatgcggaccacctccgggaacagcagcgagagctggaggcgatgaggcagcggctgctctctgccgcccggcttctcaccagcttcaccagccaggccgtggacaggacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccaggtaatgcaagtcctcgccgagtatttattaagctgattatcactgtaccctggaaacgtagggtctgttgaaagatggctggtattcagcttagtaaccaaagtttcagtctgaacaatcagtgtcactaatagtattagaatagaggctacaagtgaagaatctcacagaagtctaagccagtgtactcagtgatacgtgctgaggtcagtttgacttaatcaccgtctggacttttttgtcctttctcttacattgatagcgaacataaagattatatttcgaccaggatataatttgttcagtgtttcttaaatatcataatttaaaccactgtataattcatatttttaccaaaatttacatgaattcagtgatagtgtttcaaaattgtggaattcttttcaaaaaatctgtgaagccttgtaaccaatttgctgcctcatttttatttatatgcagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatacnntaaaaaatattttaaataantaattcaanttttttataattattttttattttataataatattaatttttataaatatattataaattatttttatattttttttttaactanttaattattatttattttacttttatatttaattttattatttatttatttactatattatatctttattccttctcttttttt

SEQ ID NO: 459585 - DNA, 1756 bp, Homo sapiens
  misc_feature (28)..(31): n is a, c, g, or t
ttttatataatcaagacagacagaagannnntttgcaagcctcggccactttcgcgagaattagaactgcagcgtcagcgtgacttgcataagatcaagcagcttcagcagacggtgagagacctggagtcgaaggacgaggtgcctggcagccgcctccacctaggttctgcccgcagggctgccggctcggatgcggaccacctccgggaacagcagcgagagctggaggcgatgaggcagcggctgctctctgccgcccggcttctcaccagcttcaccagccaggccgtggacaggacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 459586 - DNA, 1575 bp, Homo sapiens
  misc_feature (42)..(42): n is a, c, g, or t
tttattattaatctcgattatcccagataatattgaaataangggaaaatttcacgagaattagaactgcagcgtcagcgtgacttgcataagatcaagcagcttcagcagacggtgagacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 459587 - DNA, 1582 bp, Homo sapiens
agttcgacggagactctctccgtgagtcagaagcactgtgaggcgctcaggagagagaaggcgagaattagaactgcagcgtcagcgtgacttgcataagatcaagcagcttcagcagacggtgagacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 459588 - DNA, 1284 bp, Homo sapiens
tgcatttttagttctggctttggcccagcccagggcaaggcaggaaactctccagcgtgagtccgtgagggccaagaagtcccgccctgttctgggggaggacctggcttttctggtgtctctggtgcccgagagcccggtgctgccatctttagtgaaagagtaaatggtggccgagggctccttttgtgagggatgtgccttggtgaagaaggcatgttccctgccgtgaagatacttggaagctctgggtggagagggaaaagggatacccctggtgctccctgggcctggcggaaggctaggaggaaggacagctgaggtgaggactgagtggggcaggtatcaccctgacaaacagtttgggaagatcaggaaaggcaggtgagacctggtgcagaatccaggttgggtaatagatacatcgtcgaagatgtagcaagcaaagtaatatactcaactctggaacattgcacagaagcttttaaagcactctgtgacactttttgtaatgagggatctaaaggaaacggccccagagtcacccatccccacgggtctggttggcggggctggtgcctttcttctgcactcagtcaccatggctccgtctgtcaaactcaactcttttttttttttttcttctcttggtgtggtaatttgtttgaagagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 459589 - DNA, 1746 bp, Homo sapiens
tgcatttttagttctggctttggcccagcccagggcaaggcaggaaactctccagcgtgagtccgtgagggccaagaagtcccgccctgttctgggggaggacctggcttttctggtgtctctggtgcccgagagcccggtgctgccatctttagtgaaagagtaaatggtggccgagggctccttttgtgagggatgtgccttggtgaagaaggcatgttccctgccgtgaagatacttggaagctctgggtggagagggaaaagggatacccctggtgctccctgggcctggcggaaggctaggaggaaggacagctgaggtgaggactgagtggggcaggtatcaccctgacaaacagtttgggaagatcaggaaaggcaggtgagacctggtgcagaatccaggttgggtaatagatacatcgtcgaagatgtagcaagcaaagtaatatactcaactctggaacattgcacagaagcttttaaagcactctgtgacactttttgtaatgagggatctaaaggaaacggccccagagtcacccatccccacgggtctggttggcggggctggtgcctttcttctgcactcagtcaccatggctccgtctgtcaaactcaactcttttttttttttttcttctcttggtgtggtaatttgtttgaagagccactccatccccaaattcaagattagaaagatccctgactgcttctcaagatccagaacattccttgacagagtatattcaccatttagaagtgatccagcaaagattgggaggggtactaccaggtaatgcaagtcctcgccgagtatttattaagctgattatcactgtaccctggaaacgtagggtctgttgaaagatggctggtattcagcttagtaaccaaagtttcagtctgaacaatcagtgtcactaatagtattagaatagaggctacaagtgaagaatctcacagaagtctaagccagtgtactcagtgatacgtgctgaggtcagtttgacttaatcaccgtctggacttttttgtcctttctcttacattgatagcgaacataaagattatatttcgaccaggatataatttgttcagtgtttcttaaatatcataatttaaaccactgtataattcatatttttaccaaaatttacatgaattcagtgatagtgtttcaaaattgtggaattcttttcaaaaaatctgtgaagccttgtaaccaatttgctgcctcatttttatttatatgcagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 459590 - DNA, 453 bp, Homo sapiens
agtgcgtccgaagcacgtgaaggtatggctggcaggggcggccctcacagcttcacatgtgcagcctcggggcatcccccaagccctgtgtcctgccttgccggggagagccttggagggccagcttttcctgggtgcctctgagcacctgcattttaatgactcacgggaggcagccccacggtggccccggaagccgcccacccagccctgcactggccccttaggtggccgcctcccatctgggcagggagggtcctgtgagcccgtgggcaggtggtgttgccccgagtcgcagagccggcctgtgcctctctcccgcctgtgcctccctcctgcctgtgccctgtagagaagccgaggcaccagacgccgcagtgctctaggactgagccgagttctcttcagacgatgggagagaagccactcagcctccttggaatcaaccttgaa

SEQ ID NO: 459591 - DNA, 489 bp, Homo sapiens
gagagtctaagccgtaggggtccctcatccctctccggttctgggatgggcccttttccgagttctgcccccaccacaggtaaccaggctcttgcctctcgcctggcttgttgtgggtgtcccattttaagacgattgcctgactccgttatgttgcagagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggtaagcaaagcagttccagcctcagtgagtttctgccatacaggggccaggctctgagttcaggggtagttttgttggtgatttcatgctagtaggcaccaatggcc

SEQ ID NO: 459592 - DNA, 476 bp, Homo sapiens
ccacctcctcagctgagacagacctggaagttcctgagattctgaaagtgcctggccttgtggggtcagcgctgaccgatccctcttgtcacggacagagctctctcggtctctgctgtggctggctttctccgagctgcaggtttgggatgtgagcttttacccttaggatcgcagtggcagggataaaaccgcacacgtcactgctggggtgggggccttgagctcattagggtttcacctggacactttgctttttccagttagagaatcttcaagcatcatatgaagacctgaaggcacaatcacaagaagagatcaggcgcttgtggtcccagcttgattctgccaggaccagtagacaggaattgagtggtgaggaattgtattggaaaattcagatcctcaaaagctgaagctgtgtgtttttcattgttgtaacaccaagccagaatttaacaattctagcaaacaca

SEQ ID NO: 459593 - DNA, 421 bp, Homo sapiens
tgcatttgtgaggacgccacgtttcttccttcttcctttaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcaggtgagtgtcagctctgccaccaggcctcagtttgccccaggggtccagccctggcagagagggtgacacagactgttttgtgtgtgaatttcggtttgtgtgtttctctcgaccgctggaatgtggctgtcacttacccaggtgttgacgctcagtccatgcaggatgctgcacttttccacctgcagctgtaacaggacaggtgt

SEQ ID NO: 459594 - DNA, 417 bp, Homo sapiens
gatgtaagccttggttctgtttctcatagaattaaataaacttgaaatgtgcagggctcattgtggaatcacccgagtgctccgaaactccctgaaatccactcattaacaccagacaggtgcgactcctggtgagccaggtattccaccgtgcacctgttctgtttcacctgcagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatg

SEQ ID NO: 459595 - DNA, 272 bp, Homo sapiens
gctctgcagaagcgtccagccacaggcctgttgcccccgtgggcccctggctctgcctcacggctggacgaagtgattcacacacaggctcctcagaaacctgtcttgtctctcttgagccgtgagctcttgtttagttttgcataatggtcacttggggcgcgtatgcaactttgagtgcccatttatttttacagacagttaatgattggacgtcatccaatgagaaagcagtgatgtctttactgcacacgttggaggagctgaagtct

SEQ ID NO: 459596 - DNA, 252 bp, Homo sapiens
ggcagtgcacacagaaagtatttttctagcttactggtattttttattgttattgatgtgtacagggtgaatttggaagtgaaaagaaaactgctttgcatgaaaaagaggagacacttcggcttcagagtgcacaggcacagccttttcaccaagaggagaaagagtctttgtctctgcagcttcaaaagaagaatcaccaagtccagcaggtgtgtggaatacgctgttcccttgtgataagacgtgtat

SEQ ID NO: 459597 - DNA, 379 bp, Homo sapiens
ctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcaggtgaggcccaggctcccggggtcctgtggagatgtgaacaactgagtagctgatgatgccacacgagcctggtggatgccggtgccaacgacgctcgcacgggtttctccccaaggaggaggcttttctgaaccagatctttgagg

SEQ ID NO: 459598 - DNA, 307 bp, Homo sapiens
atgccctttaacaacaaattcttacaaatttattttcttttctccaagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcgtaggtgtctgtgcttaactcttacctgcctcagcctaacccaccatggtccagagcagctccaccccacaagaggccgggctcc

SEQ ID NO: 459599 - DNA, 462 bp, Homo sapiens
aaaagacattttttaaaatgtggcttagccattcaatgatattgaggaactactgtgaattttattaggtgctttactaatggcatgggatcatgtttaaaagatgtctttctcagatatgcagactgagatatttacaggagaaatgttatctgggatttgctttaaaatattatttgggccgggtgtggtggctcacacctgtaatcccagcactttgggaggccaaggtgggcggatcacctgaggtcgggagttcgagaccaacctgaccaacatggagaaaccccgtctctactaaaaatacaaaattagccaggtgtggtggtgcatgcctgtagtcccagctactgaggaggctgaggcaggagaatggcttgaatccaagaggccgaggttgtggtgagccaagattttaccattgcactccagcctggacaacaagagggaaactccgtctca

SEQ ID NO: 459600 - DNA, 4349 bp, Homo sapiens
agccttaagatgatgggacacctagttgacaatgttgattgcaggctcgcctgggcttctctggctgcagccccaaccttgccatctgctatagtttggatgtgctgcccaacgtttctgtgttggaaactcaatccccaatgcagcagtgttggaagaattgtgttttcaaaaaagatgatgcagttagaaaattataggacagttttgattttcacacagattaggagaggatgcatttggagaatagacgccaaggatgttaaatcttctgcaatgagtgagagagccccacacaactttagggtgtttctggatattcatctaaaagaaattaattgttgctcattgaatatcccacatacttctgtaattatacctttgcttactcttatacataaatcttactggaatttccttcccacaatgtctgtggtccagaatccttgacttgaggtggagaatactataatttttttatgtcattttgtgttaaagcactgattgctgtaaataaggtggtgctagctcctaaacatagggtaaggttttggattaacatgttattctctattaatgggtggaagcggataagcaggaaaacttctgccacaactctagtgctagagtggagtaggtctgagaatggggttgggccttccatggcggaaagaagtcaggggtggagactaagttgagctgattttcctgttgctgctaagagaaggccaattaatggaagaaaatcggggataggatttaggataaatattttttgaggttctcatgtattagaggatgagaggaatcgtgctatggctaaaatgaagtcaatgtcaccaatgcgattacgtaggattgcttggagggctgctgtattagcatctgctcagccatgtcatcagccaattagtaaaaaagacaaaattcctacaccttctcatctgataaaaagttgaaaaaggttgttggcagtaaccagaattaatactgtggttaggaagataagtaaatatttgaaaaaactggctaatgttaggatctgactttatatataatattgagaattctataatagatcaggtgacgaatagtgctactgtaataaatatcatggagaagtagtctagtttgaagcttaatgagagtttaagggtttgaattgttattcaatgtcagtttgaggtgatggcttctaggttggtatacataaacgttgtgggaatgaggctaatagtgaacgtgcacgcgatagctatttttacataatatggctacaagtttttcttgcgagggttgatgaaggtaataatgattggtaaggttaaggagattaaggttattatagtaatggaaaaatgcatgattattacttttatttggagttgcaccaatatttttggttcctaagaccaatgggtcgctcttatactttaaaagttgagaaagccatgttgttaggcatgggggcatgagttagcagttcttgcatagtttctcagtaaataagaagttacagacttctattatcagatccacaatctaatattttgactaaactatatttacagggtataaagcctataattattttagggtttagagataaaaagaataggtgaaagatgtataaatattaatatattttctcttgtaaaggagggtttaatactgttaatatagcatgtacatgttcctcgttgtattgtgacaagtatataaagggaataaagggctgtggttaatatattaagtcctataagcataatggtaatgtttgatcaggagaatgaagctattattacaaggagtcctcctattagattaatggtggggggtaaggcaaggttggtaagatttgctgtaagtcatcaaaaagctattagtggaagtaatggttgaaggcgttaagagagcagtataattcggctgtggactcactcgtaatttgaatttgctaagcagaatagtaaggacagattattttgttttctgcagcaatcacaagaatatctaagttcctcatactacattcttcccctgctgattcacaaatctattataatcagaaagcatgtgaaaaactgagaaatgggagaaaacaatcactgactgccatttggtaataggagtaattattaggagtcaattcgagcattgcttttaatcttttgagttgctttgctggttgtcattctctataactactaaaaagtccaactagaatttgttttcttgctcacacaggcaaagatgatgtttggagttcagtggtcaagaaaaccccgatgactgcacttctgtgaattttgaagtcttcatcagtatatccatgtaaaaaggagatgacaaaaaccaaaataaaataattatgggctgacaggacaactggattaaaataagcatcagtttcagtaaaaagggctaacttgaagacaaatcttttgaagataaattttgacaccagttctttagaggatctaaagtgaccttgatggagaatgaaagaaatcacaagatggaattcctcgaataaaaatttattgactttaaataattttgcctaatgttacatacacacaattaaaaaaaaaacacctctttatgctgttaagaaagaaagaaagaaagaaagaaaagaaaagaaagaaagaaagaaagaaagaaagaaagaaagaaagaaagaaagaaagaaagaaaggaaaccctgatgaagccacacctgtttggggtacaagaggacacacgtgttccatgtcatgagggtcgaagcaagagtctgcctcacatgaacacagatattttcctttaagctagaagatgatctttattttcattttttaagattctcaagtctttttatccttccttattaaatatttgaaattttaaaattgataacaaataataaaagacaacaaataatcattttgtataatttaccaatttaccataaattgttactcaagttgccctacttcactctgatcttgcatgctacaaaagtcatcctataagatgcttcaatttatgcaggcagtaagatgtttgtaacactaagaaaactcagattatattgacaatcagatttatttatgaaaataagtattcatattcacaacttgttatggagacagaaaacacatctgctaaaattggcactcccatttcaaatgactcatggacagggagtgataaactatgatttgccaacaggttcatgtaccagtttgtggcttgggttgacatcacatgatctttcttttgcaatctctggcacatgcttctcacatagaatgccagctatagttcagtggacatttctcagaaaaggacacaatgtcagagagaagcttgccacttctcaaaatgtgttagaattgatgaatgtgttagaattgatgaacactaagaattgatgaacgggttacactggttaaattcttctttagcttcttttcttcttttttgctgttagtcaagatgggagtcttaatttttgtttcagcaaatgtacatcattgtcacacagaaaaacaagcaacatcataaatagcagtgttaataaattaactcatgatcatgcttttaaatctaaatataaaataaagaaaaatattttaaaaataggaaaataaaaatatgaatatatttatatttaaagaaagagttacacttattatattttatgatctatatattccttactgtaaaaataaactgtgaacatattcagtttagaaaataaagtccttatagttgagcctaaaaagctgtgttttcatttccaaattgaggcaatttacaagtaggtgtcaaagcaaaccattttcttttaattatgtagtaaatcatgtaccatgaaaacttcctaggagattattgagaaaggatgttcttggcacagagacagccacatgaaaaattgattagcattgcagaacagaaacaagcatgagaaatggaaaagaaatattgaaagaggacagataattatgacaactgggtgtcttggctaagtgactattacagtcagtattagaaacttgtcacctattggttgattaatttgtagagatctccagggagacactagaatatatcaagctctgggacccggctacctggtacatatggtggctctgctattttcttcctatgtggccatgggtagcctccttaatctctttgtgcatccattccctcatctgcaaaatgggaataataatcataccttctatgtaggcttgtgatgagaattaagtgagtccatgtaaaacactataaaaagttcctggaatacagtaaacatccaaatgtttgctcttatgaatattactggttgtaaa

SEQ ID NO: 459601 - DNA, 2573 bp, Homo sapiens
agccttaagatgatgggacacctagttgacaatgttgattgcaggctcgcctgggcttctctggctgcagccccaaccttgccatctgctatagtttggatgtgctgcccaacgtttctgtgttggaaactcaatccccaatgcagcagtgttggaagaattgtgttttcaaaaaagatgatgcagttagaaaattataggacagttttgattttcacacagattaggagaggatgcatttggagaatagacgccaaggatgttaaatcttctgcaatgagtgagagagccccacacaactttagggtgtttctggatattcatctaaaagaaattaattgttgctcattgaatatcccacatacttctgtaattatacctttgcttactcttatacataaatcttactggaatttccttcccacaatgtctgtggtccagaatccttgacttgaggtggagaatactataatttttttatgtcattttgtgttaaagcactgattgctgtaaataaggtggtgctagctcctaaacatagggtaaggttttggattaacatgttattctctattaatgggtggaagcggataagcaggaaaacttctgccacaactctagtgctagagtggagtaggtctgagaatggggttgggccttccatggcggaaagaagtcaggggtggagactaagttgagctgattttcctgttgctgctaagagaaggccaattaatggaagaaaatcggggataggatttaggataaatattttttgaggttctcatgtattagaggatgagaggaatcgtgctatggctaaaatgaagtcaatgtcaccaatgcgattacgtaggattgcttggagggctgctgtattagcatctgctcagccatgtcatcagccaattagtaaaaaagacaaaattcctacaccttctcatctgataaaaagttgaaaaaggttgttggcagtaaccagaattaatactgtggttaggaagataagtaaatatttgaaaaaactggctaatgttaggatctgactttatatataatattgagaattctataatagatcaggtgacgaatagtgctactgtaataaatatcatggagaagtagtctagtttgaagcttaatgagagtttaagggtttgaattgttattcaatgtcagtttgaggtgatggcttctaggttggtatacataaacgttgtgggaatgaggctaatagtgaacgtgcacgcgatagctatttttacataatatggctacaagtttttcttgcgagggttgatgaaggtaataatgattggtaaggttaaggagattaaggttattatagtaatggaaaaatgcatgattattacttttatttggagttgcaccaatatttttggttcctaagaccaatgggtcgctcttatactttaaaagttgagaaagccatgttgttaggcatgggggcatgagttagcagttcttgcatagtttctcagtaaataagaagttacagacttctattatcagatccacaatctaatattttgactaaactatatttacagggtataaagcctataattattttagggtttagagataaaaagaataggtgaaagatgtataaatattaatatattttctcttgtaaaggagggtttaatactgttaatatagcatgtacatgttcctcgttgtattgtgacaagtatataaagggaataaagggctgtggttaatatattaagtcctataagcataatggtaatgtttgatcaggagaatgaagctattattacaaggagtcctcctattagattaatggtggggggtaaggcaaggttggtaagatttgctgtaagtcatcaaaaagctattagtggaagtaatggttgaaggcgttaagagagcagtataattcggctgtggactcactcgtaatttgaatttgctaagcagaatagtaaggacagattattttgttttctgcagcaatcacaagaatatctaagttcctcatactacattcttcccctgctgattcacaaatctattataatcagaaagcatgtgaaaaactgagaaatgggagaaaacaatcactgactgccatttggtaataggagtaattattaggagtcaattcgagcattgcttttaatcttttgagttgctttgctggttgtcattctctataactactaaaaagtccaactagaatttgttttcttgctcacacaggcaaagatgatgtttggagttcagtggtcaagaaaaccccgatgactgcacttctggagccaatgagggcccagccattgcgcaagtctggattcgtaggagatcaccttttattccaaatcacatcctagtttttgtcttggtctgaatggaaacattaggggaaacacagaggaaaatcagaaaggaatctccagcaactagtgggaatattaatattttaagatcccatctctacctttaatgacgtggcgtggtactgatggtggtgtgtcgtccattctttcagacacgtatttcacataaatgcactaaataaaacctga

SEQ ID NO: 459602 - DNA, 974 bp, Homo sapiens
tggctgcaaaccacccagaggatggcccactggctgcagccagatatggaagaagcagattctcagtgcacgagccagttcttccagaagctaagcagatacaggcgccagcccaccaagacctttgccaaagccgaattcctgagaatcacagggtccacggctttcaggtgcatctgtggggaggtgccttcccttgtgaataggtcccgtgtcaagagtctcgtggacaccactgaggccatggagctgagtactgggcggattaatcagagattcaagtcctcagtccagagggctggctccaaaggacatgcagtcaaccagatatggaagaagaggaaaggcttctgtcaagggaaacagcctttcgtggaccgcaggaagctcagagaagccagggaacgctactcccagactacagggagccgttctgaaatggatctcctcttcaacgctgtggttggggcagcaagggatggctgggaacatgattccagagggcactgtgacctagccagccacagggggaagaaccccaggtcctgagcgtgctctttgaggagaaggttctgacagagtaggaagtgggctgtggggtcacgttgttcccacttcaccacagtgaaagcctgccaggaaacacatcccggaaatgagatctactctagaaaatacaaggaaggtactgggaaggtaacaaaccaggcagacacctgtcctccatgatctcatatggacgtgggagctgatcactgcatatgtgtagacacaaagggaacaaggactgccgcgcctacctgagggcagaagatggagcatgaggattaaaaactacccatggggtattgtgcttattccttattagagacaaagtaatctgtacgtcaaacccccacaacacgcaatttacccgtgtaaaaaacctgcacttgtaccccttgagccgaaaataaaagttgtaaagaaaaaaa

SEQ ID NO: 459603 - DNA, 334 bp, Homo sapiens
aaagaacataaggacaaaagactaaactttgaaggttattgagaggtactgggaaggtaacaaaccaggcagacacctgtcctccatgatctcatatggacgtgggagctgatcactgcatatgtgtagacacaaagggaacaaggactgccgcgcctacctgagggcagaagatggagcatgaggattaaaaactacccatggggtattgtgcttattccttattagagacaaagtaatctgtacgtcaaacccccacaacacgcaatttacccgtgtaaaaaacctgcacttgtaccccttgagccgaaaataaaagttgtaaagaaaaaaa

SEQ ID NO: 459604 - DNA, 869 bp, Homo sapiens
ttttgggtgcaggcgctcccggggaaagcagtttgtgctcagtgcgttctgcagcataaggaatcctaacgcgaatccgtgaacagtctattccgacggcgcagagaaatctcacgcggggatccccacgatgtgccggcgcttaacgcagacgcccgaacccaggggaaggctgcgactccgcgatgagtgacatgcgggcttgagacgttctaaaggaacgtggaccgagttagggaacgtaactgaagctcattttgtcttagttatggactatgagtccttaataaatgtatgtcattatgtttaaagaatgacaaatgtctgcaaagagtggtccctgtcccaagccctttccagactatgtgaaattcttttttgccagttgtttccaagacacgtgaaagcaatcaagctcccctggaagaagaagaggaggaagaggaagaagtggaaaaagaaggagaaggagaaggaggaggaggagaggaagaggaagaggaagaggaagaagaaggaagaagaagaagaagaagaagaagaagaagaagaagaagaagaagaagaagaagaagaagaagaagcagcagctgatgccttaaggagacatgcatggagcaggactttcacggttaccacctgctctgctcagggttccagcacatattccatcccctcctatccgggcccttttctctcgccggatgtcttccttctgctgagttatttgcctggggtggccctagaggatctgcccaacctgttctccaaaatcccagaatgattcagactttccctccctccctccctccctccctccctccctcccttcttccctccctccttccctccttccctccctcccttcc

SEQ ID NO: 459605 - DNA, 1187 bp, Homo sapiens
ttttgggtgcaggcgctcccggggaaagcagtttgtgctcagtgcggtgagtcccctcctcaccgccccggaggctccagcccgagcctctccgcccgcggggactcgagcctgcagcttgctcggctgggtttctgccctgcccgctccctagctctgctgcagggccggcagcggcagttctgcctgaaacgcaagaattaatagtctgctctggggagacagtggggaagccgtgagcgaccgggccttttccagaggccactatttaccttgaagtttcctgttgaccctctgctgacccacccgcttaaatagattagaacttaaacatcgcaattctgatacatttatttctttgaagttctgcagcataaggaatcctaacgcgaatccgtgaacagtctattccgacggcgcagagaaatctcacgcggggatccccacgatgtgccggcgcttaacgcagacgcccgaacccaggggaaggctgcgactccgcgatgagtgacatgcgggcttgagacgttctaaaggaacgtggaccgagttagggaacgtaactgaagctcattttgtcttagttatggactatgagtccttaataaatgtatgtcattatgtttaaagaatgacaaatgtctgcaaagagtggtccctgtcccaagccctttccagactatgtgaaattcttttttgccagttgtttccaagacacgtgaaagcaatcaagctcccctggaagaagaagaggaggaagaggaagaagtggaaaaagaaggagaaggagaaggaggaggaggagaggaagaggaagaggaagaggaagaagaaggaagaagaagaagaagaagaagaagaagaagaagaagaagaagaagaagaagaagaagaagaagaagcagcagctgatgccttaaggagacatgcatggagcaggactttcacggttaccacctgctctgctcagggttccagcacatattccatcccctcctatccgggcccttttctctcgccggatgtcttccttctgctgagttatttgcctggggtggccctagaggatctgcccaacctgttctccaaaatcccagaatgattcagactttccctccctccctccctccctccctccctccctcccttcttccctccctccttccctccttccctccctcccttcc

SEQ ID NO: 459606 - DNA, 1286 bp, Homo sapiens
  misc_feature (4)..(4): n is a, c, g, or t
  misc_feature (7)..(7): n is a, c, g, or t
  misc_feature (10)..(11): n is a, c, g, or t
  misc_feature (16)..(16): n is a, c, g, or t
  misc_feature (18)..(19): n is a, c, g, or t
ccanccnccnntgccncnnaagcagccctctgttctgcctgacaatgctgcaacattgcctcctgctcgaggggggcatcttgcaaaaggaagtctgttctgctgacaatttcctccccctgtcccattctgcatggggagaaaactttgctgagaatcccaatcagaccctcaggatcccaggaatcagcctgttccgtggaaacaagagctccccaaggctgggccgggccctgctgcaagcacctccacccccacgtcccacctgcggcctcctcacaggccaagccctctcctacatccaactcaccttccagaaccagatcaagaaattgagcaacacgttcaggaaagacagagcatggctgctgggcagccaggtcaaccggacggcaaggcaggggttggccggggaagcactgcgccgcccctgcatgccctgcatcctcgggtcctgggagggctgctcagtaactggaaggaaaatgaaactgaaaaagagcaagggtcccgtaggattgaacacagttggtgaaacttgggccgtctgcctcaagtccccgcttggcaaaaccactccctcctggtggacgccctcaccatgaagagttatagtaaggtgttggtgaggctggctgctctggttgctaagagagacccggcctgccacactcctaagagacacagaagaccagcctacccttcccttgcctcccgtgacactgccctgcaggtggctggccaagagaagcctgcccggcgacgctgaggcaccgaacatgagcaggggaggaaggaatgcctgggagcagctgagccgagcccctgccaccagcctcctccgcacgcccgtggaatcagcactttctgcttcccgcccctgagagccttgctctggggccactcacagccaattaagtggggatgttgtaagagactctaaaatacgtggagctggctgaggacgcgggaccgaccccattatgtgtgtgtgaggctgattaaagtgttacctgtcaccaggtgtcgccaattcttggtgaagctctctccatgtgacctccatgctacttattttttattttattgttcatcctggactccaaaggctgatgctatttttttttttaatgtgatcttttggaagagttctaactgcaactcttcacatagtggtagtagaatataccatgggtattaaaaactaaagcatttcttaatctgtggggtccagattaggaagacatgtattaggaaaatgattactttaaaaaaaataaaaaatt

SEQ ID NO: 459607 - DNA, 1160 bp, Homo sapiens
  misc_feature (4)..(4): n is a, c, g, or t
  misc_feature (7)..(7): n is a, c, g, or t
  misc_feature (10)..(11): n is a, c, g, or t
  misc_feature (16)..(16): n is a, c, g, or t
  misc_feature (18)..(19): n is a, c, g, or t
ccanccnccnntgccncnnaagcagccctctgttctgcctgacaatgctgcaacattgcctcctgctcgaggggggcatcttgcaaaaggaagtctgttctgctgacaatttcctccccctgtcccattctgcatggggagaaaactttgctgagaatcccaatcagaccctcaggatcccaggaatcagcctgttccgtggaaacaagagctccccaaggctgggccgggccctgctgcaagcacctccacccccacgtcccacctgcggcctcctcacaggccaagccctctcctacatccaactcaccttccagaaccagatcaagaaattgagcaacacgttcaggaaagacagagcatggctgctgggcagccaggtcaaccggacggcaaggcaggggttggccggggaagcactgcgccgcccctgcatgccctgcatcctcgggtcctgggagggctgctcagtaactggaaggaaaatgaaactgaaaaagagcaagggtcccgtaggattgaacacagttggtgaaacttgggccgtctgcctcaagtccccgcttggcaaaaccactccctcctggtggacgccctcaccatgaaggtggctggccaagagaagcctgcccggcgacgctgaggcaccgaacatgagcaggggaggaaggaatgcctgggagcagctgagccgagcccctgccaccagcctcctccgcacgcccgtggaatcagcactttctgcttcccgcccctgagagccttgctctggggccactcacagccaattaagtggggatgttgtaagagactctaaaatacgtggagctggctgaggacgcgggaccgaccccattatgtgtgtgtgaggctgattaaagtgttacctgtcaccaggtgtcgccaattcttggtgaagctctctccatgtgacctccatgctacttattttttattttattgttcatcctggactccaaaggctgatgctatttttttttttaatgtgatcttttggaagagttctaactgcaactcttcacatagtggtagtagaatataccatgggtattaaaaactaaagcatttcttaatctgtggggtccagattaggaagacatgtattaggaaaatgattactttaaaaaaaataaaaaatt

SEQ ID NO: 459608 - DNA, 674 bp, Homo sapiens
aataaccaacacctctaacaacagatgtattgttgctcattgcttgtcaaacttagccaatctgaaatcactgtcaccacagacaacaggcttctaaagatttgggacagacaaaaaagccaaaaatccaccatctattcagcaccaagagccctgtgggtgcttaagcacagtggacaatcagtgattgagacactgctggccagtggctgtcctgttcatgtgactgtagaatctaaacaatgcaattggagatacatacacatgtggacaattatggccataatatacacaaaattcacggtttcatggaagggaggaatgggatcttggaagaacacaaagatagcttctcaacttgagtgcgatgttggggaagcagcccacggctgatctagaggctcaacaccgtcaccaagaccaggccccatgagtagtcctgccccgccgtcctcagagtgaggctcctgtgctgggatcacaggatggctgctgtgctcccagcatttccaggggccaagatgggaggaagaagatggacggcagaggaaggacagaggccaaaggcacaagcgagcattgtcagatcaccaaaaagatttttttgctttaagccccacccctagtgacttctgattccatccaaacacccaaaattgggtcatatgtccccc

SEQ ID NO: 459609 - DNA, 2494 bp, Homo sapiens
acccaacagctcattgagaacgggccatgatgacgatggcggttttgtggaatagaaaagggggcaagagagcagccgctctcaacatctaccgtatcccaccgtctagcaggaagcccgctctctgtccaactccgcgggaccgactagagtacgacgaggaccgactagagcacagtgaggaccgtccagagcgccccctcggagagccccagggcttccaggacggcgcccgcgcatgcgcggacgccgacgggcgtggcgaggggctcgcctacgtgcgcgcccgggagctgcacactcttgaagtgaccggcctggagacggttgcccagagcaaggcccatgtagcatccctggagggcctcatccctgaagataaggtcgtgcttctggcaggttctcccttacagaatgaagccaccctgggtcagtgtggggtggaagccctgacaaccctggaagtggttggccgcaggctaggagttcacaatgtctaaaagtcagctgattttgtgttaaaattcagtgtctggctttgcttcaaaaattgggaagatcggccggacgcggtggctcacgcctgtaatctcagcactttgggaggccgaggtgggtggatcacgaggtcaggagatcgagaccatcctggctaacatggtgaaaccctgtctctactaaaaatacaaaaaaaaaaaaaaaaaaaaaaattagccgggcgtggtggcgggcgcctatagtcccagctactccggaggctgaggcaggagaatggcgtgaacccaggaggcagagcttgcaatgagccgagatcgcaccactgaactgcagcctgggcaacagagagagactccgtctcaaaaaaaaaaaaaatgggggagatcagggccagccaccatttatcatcaggcttgcgctgttgtttctcttaaagaaaagtgaattctctttttgttcctatgtctctatcaaaagtgggaaaatgaaagatggattgatagcgccgcgtgtttcaagagaagtgggagcaagcatatttctttgtggaagtatagtcctatgtgtttaatatgtaaccaaactttgtctgtgtcaaaagaatacaactgaagatgccattatgaaacaaaccatgctcccgtcttcccctctttcccctctgactcttgacgaacaccctcctccaccatggtatgcatgccccttccttttgagaaatgcaacaagctctccagtggtcatctcctgatctgttggccttactggccctcaaatttcctattcatgcattacatatttatttatttactttgagacaggagtgagactctgccaaaaaaaaaaaaaagtaatttagcaatgttgcaagttgtaagatcaatacaaaaatcaatattatttctatatactgtcaatgaaacactggaaattgaaaatcttaaaacataatacagccaaatgtggtggctcatggctataatcctgtactttgggaggctgctgttggaggattgtttgaggctgggagttcaagctcagcctgggaaacatagtgagacccttgtctctaccaaaaagaaaaagaaaaagaaaaaaattataattctgtctctcaacaaaatcataattttttttttaatttggccaggtttggtggcgggcatctgtagtcccagctcctgagctgaggctgaggtaggaggatcgcttgagcccaggagtttgaggctgcagtgagctatgataatgccactgcactcttgcctgggggacaagactgagaccttctctctctctcaaaaaaacacacacaaaaaaacatatatatatatatatatagccacttacaatatcatttaaaaatgaaatacttaggaatgaatttgaaaagcagttgacctgttctctgaaaattacaaagcattactgagagattaccagatagagatttaccatctcaatattgagctgagatataccaaactcaatattgttaatatgatgattcttccaaaataaactattcaatgcaataccagtcaaaatcccagtaggctttttaatacaagttaacaagctcattccaaaattcttgtggtaatgcaaaggacctagaatagtcaagacaatgttgaaaataataaaactggaaaagttaaactacgtgacttatataaccaagacttaatataaaattacagaaattagccaggcgtggtggctcacgcctgtaatcccagcactttaggaggccgaggtgggcggatcacctgaggtcaggagttcaagaccagcctggccaacatggtgaaaccccgtctctactaaaaatacaaaaattagccgggcatggtggttggcgcctgtaatcccagctactcgggagactgaagcaggagaatcacttgaacccaggaggcggaggttgcagtgagccgagatcacgccgttgcactccaccctgggggacaagaatgagacttcgtctcaaaaa

SEQ ID NO: 459610 - DNA, 2350 bp, Homo sapiens
acccaacagctcattgagaacgggccatgatgacgatggcggttttgtggaatagaaaagggggcaagagagcagccgctctcaacatctaccgtatcccaccgtctagcaggaagcccgctctctgtccaactccgcgggaccgactagagtacgacgaggaccgactagagcacagtgaggaccgtccagagcgccccctcggagagccccagggcttccaggacggcgcccgcgcatgcgcggacgccgacgggcgtggcgaggggctcgcctacgtgcgcgcccgggagctgcacactcttgaagtgaccggcctggagacggttgcccagagcaagttcacaatgtctaaaagtcagctgattttgtgttaaaattcagtgtctggctttgcttcaaaaattgggaagatcggccggacgcggtggctcacgcctgtaatctcagcactttgggaggccgaggtgggtggatcacgaaggtacgagcccgcaatcgtccgggctcaaaggcacctgccgacctaatcacttacacgcacgccgggcactccgggcggtcgccctgacaagtacgttggcgggcgcctatagtcccagctactccggaggctgaggcaggagaatggcgtgaacccaggaggcagagcttgcaatgagccgagatcgcaccactgaactgcagcctgggcaacagagagagactccgtctcaaaaaaaaaaaaaatgggggagatcagggccagccaccatttatcatcaggcttgcgctgttgtttctcttaaagaaaagtgaattctctttttgttcctatgtctctatcaaaagtgggaaaatgaaagatggattgatagcgccgcgtgtttcaagagaagtgggagcaagcatatttctttgtggaagtatagtcctatgtgtttaatatgtaaccaaactttgtctgtgtcaaaagaatacaactgaagatgccattatgaaacaaaccatgctcccgtcttcccctctttcccctctgactcttgacgaacaccctcctccaccatggtatgcatgccccttccttttgagaaatgcaacaagctctccagtggtcatctcctgatctgttggccttactggccctcaaatttcctattcatgcattacatatttatttatttactttgagacaggagtgagactctgccaaaaaaaaaaaaaagtaatttagcaatgttgcaagttgtaagatcaatacaaaaatcaatattatttctatatactgtcaatgaaacactggaaattgaaaatcttaaaacataatacagccaaatgtggtggctcatggctataatcctgtactttgggaggctgctgttggaggattgtttgaggctgggagttcaagctcagcctgggaaacatagtgagacccttgtctctaccaaaaagaaaaagaaaaagaaaaaaattataattctgtctctcaacaaaatcataattttttttttaatttggccaggtttggtggcgggcatctgtagtcccagctcctgagctgaggctgaggtaggaggatcgcttgagcccaggagtttgaggctgcagtgagctatgataatgccactgcactcttgcctgggggacaagactgagaccttctctctctctcaaaaaaacacacacaaaaaaacatatatatatatatatatagccacttacaatatcatttaaaaatgaaatacttaggaatgaatttgaaaagcagttgacctgttctctgaaaattacaaagcattactgagagattaccagatagagatttaccatctcaatattgagctgagatataccaaactcaatattgttaatatgatgattcttccaaaataaactattcaatgcaataccagtcaaaatcccagtaggctttttaatacaagttaacaagctcattccaaaattcttgtggtaatgcaaaggacctagaatagtcaagacaatgttgaaaataataaaactggaaaagttaaactacgtgacttatataaccaagacttaatataaaattacagaaattagccaggcgtggtggctcacgcctgtaatcccagcactttaggaggccgaggtgggcggatcacctgaggtcaggagttcaagaccagcctggccaacatggtgaaaccccgtctctactaaaaatacaaaaattagccgggcatggtggttggcgcctgtaatcccagctactcgggagactgaagcaggagaatcacttgaacccaggaggcggaggttgcagtgagccgagatcacgccgttgcactccaccctgggggacaagaatgagacttcgtctcaaaaa

SEQ ID NO: 459611 - DNA, 827 bp, Homo sapiens
tccccagagtgtgatgttccacttcctgtgtccatgtgttctcattgttcaattcccacctatgagtcttaataaaagaccaataactatgttgcaaaagcacatgcaggaactgagacctaataagctactaaccaaaaatagttttcactctgaatgctttatgatatttatagagacattaatgctttatagttctcagaatgggtccacatgttccacaaaggagatatttccttattttctaggggttaaacatctttcttcaaccaacgaccatactttgagcttctcaataactttatttaaaaccaaccaattaaaggaaccaaccaaggaagctccattactgaagctagagagtcacacattcattcgtcctggcaccgaaagtggtgaacatagaaaatacgtttttaaagaatatcacaaggagatcccttcttacatttttgtaatatacatagtaagaatgtgagcaattcagagttttaccaacgcaggaaaagctttcttggtactaacataatattgaaacttggtgaatcgtattttttcagccataaaacttgcaatcatgacaggagggatatttccttttctctgaaattaatttgctcatttctaacattcagaaatacgttctcatttttctgaaataccaccaacattttcctggaactttacttcggcctctttccctgtaatgtgagacagtctgatacatctgcagtgcccttgctatatgcattacacgctatgactaggcaccgggctgggtcaactctacgccaaggttatattcagggtcgtatacttgattgaaa

SEQ ID NO: 459612 - DNA, 237 bp, Homo sapiens
gtgacattcccccaaattcatcagaagtggacccggaagagatccaaatacgttctcatttttctgaaataccaccaacattttcctggaactttacttcggcctctttccctgtaatgtgagacagtctgatacatctgcagtgcccttgctatatgcattacacgctatgactaggcaccgggctgggtcaactctacgccaaggttatattcagggtcgtatacttgattgaaa

SEQ ID NO: 459613 - DNA, 1778 bp, Homo sapiens
tataaactcaggacctgattgaggtgaaaggataacagcaacagagccacagatcactggattgtttcagtgggctcagtctcctgcctgtctcagttttccccagtcgccatcgtgttactgacccaatagagaagagagactcctaagagagagggaatcacctttgtgcctgggagcccccagctgactgccaagaaaattcgctatcaattacgcatgtctaaggcccagtgcattgtggctaatgaagctatggccccagttgtaaactctgccgtgtccgactgccccaccttgaaaaccaagctcctggtgtcagataagagctatgatgggtggttggatttcaagaagttgattcaagttgcccctccaaagcagacctacatgaggaccaaaagccaagatccaatggccatattcttcaccaagggtacaacaggagctcccaaaatggtcgagtattcccagtatggtttgggaatgggattcagccaggcttccagacggtggatggatctccagccaacagatgtcttgtggagtctgggtgatgcctttggtggatctttatccctgagcgctgtcttgggaacttggttccaaggagcctgtgtgtttctgtgtcacatgccaaccttctgccctgagactgttctaaatgtcctgtccagatttcccatcaccactctatctgcaaatccagagatgtaccaggaactgcttcagcacaagtgtttcaccagctacagattcaagagtctgaagcagtgtgtggctgcaggaggacccatcagccctggggtgattgaggactggaaacgcatcactaagttggacatctatgaaggctatgggcagacggaaactggtctactctgtgccacttccaaaacaataaaattgaagccaagctctctggggaagccattgccaccttatattgtccagattgtggatgaaaactcaaatctcctgcctccaggggaagaaggaaatattgcaatccgcataaaactaaaccaacctgcttctctgtactgtccacacatggtgagctgggaggaatatgcttcagcaagaggccacatgctttacctcacaggtgacagagggatcatggatgaagacggctacttctggtggtctggtagagttgatgatgttgccaatgcattgggtcagagattgtgaatgctttggttattgctattgagcctggggctgtgggagtttgaagaagactctggactgcttccaatacgtaggaattatatttctaaagtttagaaaatgcaaacaaccaaaaataaaaaaataaaactcatccataatctcatattgtggagtatattcttctaatcttctttcttcttatacataaacttttttttttggtagaattgagttcagggagaaatgctctagcgtaacttgcctttttcactcaacaatgtaacagaaatatttttctgtgcaattaaatataaaaattcattttttaaattagtttatcacgaccaataagtacacagatcttacatgaatactgtcaggcctctgagcccaagctaagccatcatatcccctgtgacctgcacgtacacatccagatggccggttcctgccttaactaatgacattctaccacaaaagaagtgaaaatggcctgttcctgccctaactgatgacattatcttgtgaaattccttctcctggctcatcctggctcaaaagctcccctactgagcacctcgtgacccccattcctgccc

SEQ ID NO: 459614 - DNA, 1567 bp, Homo sapiens
ctggtaccggtcggaccttgctttgcattgtggctaatgaagctatggccccagttgtaaactctgccgtgtccgactgccccaccttgaaaaccaagctcctggtgtcagataagagctatgatgggtggttggatttcaagaagttgattcaagttgcccctccaaagcagacctacatgaggaccaaaagccaagatccaatggccatattcttcaccaagggtacaacaggagctcccaaaatggtcgagtattcccagtatggtttgggaatgggattcagccaggcttccagacggtggatggatctccagccaacagatgtcttgtggagtctgggtgatgcctttggtggatctttatccctgagcgctgtcttgggaacttggttccaaggagcctgtgtgtttctgtgtcacatgccaaccttctgccctgagactgttctaaatgtcctgtccagatttcccatcaccactctatctgcaaatccagagatgtaccaggaactgcttcagcacaagtgtttcaccagctacagattcaagagtctgaagcagtgtgtggctgcaggaggacccatcagccctggggtgattgaggactggaaacgcatcactaagttggacatctatgaaggctatgggcagacggaaactggtctactctgtgccacttccaaaacaataaaattgaagccaagctctctggggaagccattgccaccttatattgtccagattgtggatgaaaactcaaatctcctgcctccaggggaagaaggaaatattgcaatccgcataaaactaaaccaacctgcttctctgtactgtccacacatggtgagctgggaggaatatgcttcagcaagaggccacatgctttacctcacaggtgacagagggatcatggatgaagacggctacttctggtggtctggtagagttgatgatgttgccaatgcattgggtcagagattgtgaatgctttggttattgctattgagcctggggctgtgggagtttgaagaagactctggactgcttccaatacgtaggaattatatttctaaagtttagaaaatgcaaacaaccaaaaataaaaaaataaaactcatccataatctcatattgtggagtatattcttctaatcttctttcttcttatacataaacttttttttttggtagaattgagttcagggagaaatgctctagcgtaacttgcctttttcactcaacaatgtaacagaaatatttttctgtgcaattaaatataaaaattcattttttaaattagtttatcacgaccaataagtacacagatcttacatgaatactgtcaggcctctgagcccaagctaagccatcatatcccctgtgacctgcacgtacacatccagatggccggttcctgccttaactaatgacattctaccacaaaagaagtgaaaatggcctgttcctgccctaactgatgacattatcttgtgaaattccttctcctggctcatcctggctcaaaagctcccctactgagcacctcgtgacccccattcctgccc

SEQ ID NO: 459615 - DNA, 972 bp, Homo sapiens
tgacattgaaggattgcttgctagggaaagtttggttaagtatgaagtctaattattccaatttagcaaacaaaaccttatctgcagtcattccccctcctccccaagcgttctcaggcctggctcctgtcacacagagctcacctccatgcctctgcccctgctgtccccggacaagccccccagccaggcggctctcaacctggtggcctcagtatgatcttcctgatttgcaagctttgtctcttaataatctgcctttgtctgttgatgttcagcaaacctttgggaaggtttcccttggcccctacagtgttggcgtcacagacaggatcctaaagctgctctacttttctggaagccacagtccagggaacccaggacctgacaaagcatcagaaggagccctcatgacccaatcgcctcttaaaggccctgcccctcacgactgccacactggggattcagttccaacacctggcatttgccagacacattaaaccatgaatctcacttagttgatctatattactattttaatgtacttttaaattatctttatgaatattttattgagaattttggctctcatatttaaaaatgaaattgtctgtaatactttcccactctccggcacctgagtccatggctttggcagccatagtgatcatgaacttccggctatgtcctagagtcatttatctccgaggatgtcaggaggaaccccaaaatgtcatcaagacactggctacaggtctaaactccaataaaatccagctgggttacatcaattcagacatctggataaaaggatgaatgaaaccatgtacataatacagaattatgcatgccaggaaaaaaaattatactgcctaaaagctgcaaccttcatgacatcaaatctattttaacactggctggttatgtgaggaaaaggctaataaaaaaaaattctggctgaccaaagaagta

SEQ ID NO: 459616 - DNA, 2125 bp, Homo sapiens
agttaagaaacattctaaagaaaggaggaggaggaacccttctaagacagccctgctaatatttagggaacaaattgtgaggcctcgccagccatgtggaactgcagatgttggaacagtttggagggctcagaagaagacacgaaaatgtgggaaagtttggaacttcctagagacttgaatggctttgaccaaaatgctgataaggacatggaaaatgaaatccaggatgagatggtctcagatggagatgaggaacttgttgggaactggaatccagaggcctatgaggaaaacgtggttttgtgggctgggcccaaggtccctgtgctgtgtgcttggtcccctgcatcccagccactccagccgactgaaaggggtcaacatagagctcgggccgtagcttcagagggtgcaagcatcaagccttggcagcttccacatggtgttgagcctgcgagtgcagagaagtcaagaattgaggtttggaaacctctgcctagatttcagaagatgtatggaaacatctggatgcccaggcagaagtttgctgtaggagcagggtcttcatggagaacctctgctagggcaatacagaagggaaatgtgaggtcagagcccccacacagagtccctactggagcaccgcctagtggagctgtgagaagagggccaccgtccagacaccagaatgacagattcaccaacagcttgcaccatgcacctggaagacccacagacactcaacagcaggccatgaaagcacctggaagggaggctgtatcctgcaaagccacaggagtggagctgcccaagaccatgggaaccctcctcttgcatcggtgtgatctggatgtcagacatggagtcaaaggaggtcattttggagctttaagatttgaccgccctgctgaatttcggacttgcatggggcctgtagcccctttgttttggcaagtttctcccatttagaatggctgtatttacccaatgcttgtacccccattgtatctaggaagaattttttagttttaaatcttgtgtttaggtcatgaatccattttgaattattttttgtacatggcataaggaagaacatgggctcctgaacactcctggattttaatctggttctatcacctttcctgtgaccttgggcaagtaacttaacctcttcacatctcaattagctctactatcaaataagataatatttccccacaaggttgttatgtaagatagaatgacacaagtgccttgcatataacagattcttaaaaaaaaaaaaaaaaaaaagccagtttacctcttttccatgttcattattgaggcaagaacaaaaggcaccaaggaagagaaaggagtggactgggtagaaaagaaggatgccaaagagaaactcctgaaaattcctccttgaaaatcaggttcaatcaagagaagagacaggatcttgctgtactgcccagcctggagtgcaatgccacaatcatggcttacagcagcctcaaactactgggctcaagtgatccttccaccaccgtcttccaaggagctggtactataggtacatgccaccatgtccagctaatttttcaatttttttggtagagacagggccttgctatattgcctaggctagtcttgaactactggcctcaaccgatcctcccacctcagcctcccaaagtgctaagattacaagcatgagccactgcacctggcttctttttactttttaatgcagttaaaaattacgtatatgtattacatctgtagcccacattataattccattgaagagtgctgagatataatattgacatattatttccatcatagaaacttggaacatttttattatttagaaacatgctattttatacatacactgttatctatacttccaaagatagtaagtacgtactcataagaagctatatgtacaagttttcttattaatttgcttgctacttggtcatttattttatctcttactgcttgctaagggacaagtggtagcagtctctaaaggtttaaaaataattatgtaaaaacaccagtatgctatggcctgttagtctgacaaacaatgaattgatgtctaaaataaagaacacattgt

SEQ ID NO: 459617 - DNA, 1857 bp, Homo sapiens
gcctacgtgcgcgcccgggagctgcacactcttgaagtgaccggcctggagacggttgcccagagcaaggcccatgtagcatccctggagggcctcatccctgaagataaggttgtgcttctggcaggttctcccttacagaatgaagccaccctgggtcagtgtggggtggaagccctgacaaccctggaagtggttggccgcaggctaggagttcacaatgtctaaaagtcagctgattttgtgttaaaattcagtgtctggctttgcttcaaaaattgggaagatcggccggacgcggtggctcacgcctgtaatctcagcactttgggaggccgaggtgggtggatcacgaggtcaggagatcgagaccatcctggctaacatggtgaaacccttgtgggttcccgcggtctgttcggcgcagccacagggtcctcccaccaccctcgcggcccttcgccagcccagataccgttttcccgactttggaacggagaccacaacacccgccccggaactactgaaggctcaagttagtcaacccggcaggaaaccggccaccgccgccgggtctccagcccccaggagcgcggcctcctcccggactctctccgatgcggtcctgccctggggacacggcaggaagaagggacctggctgggggacgtggccccggcgcgggggcaggggaggcagcgcgggactcccagcggcccctgcgcgggtgcccacccgccgtcacgtgacacgccgggcgctgagtcaccgggaagcatctggctgggcggccgggattggccaatctgcgggaccgtctggagcggaagggcggtggtagctggccctgcttctccctccccaggatctctgcactggccttacgaactggggagtccaagggaacatgtacagtgctcattcactaggattgttacccgaatcctctgctagaatgtaagctccaggaaggtggaattcttgcctttttcctgccttatttttactagctgtaccttgcataaagggtgtttgttgagtgaatgaagttctgtcctagatcaagttaggaattgaagctagaagtcaggaaaactaggtctttctctgctactaatattttttttatttttcttttctttttcgtgtttgtttttggttttcgtttgtttggtttttgttttgaggtggagtctcaatctgtcacccaggctggaaatagcatgaacccgggaggcggagcttgcagtgagctgagattgcgccaccgcactccagcctgggcgacagagcaagattccgtctcaaaaataaataaataaataaatatgaaataaaataagaatcaagcagagaaaattcatgcatacctaaaagataagaccaaggaaaaaggccagagtcctgtacgactgccagagttgtgcctcagttattgctttgagcttctgtgagccaaagagaaaggaagaggaacaaaggtagttgcatgattcttcttgcctctagggaaaaagcatcccagttcctcagagaaaggaaattttttgctggcagttaatatctaaggaatttctcatacaggtctccatatagggatgtggtggctgatgagaacagactgcagctttcctaactaagggcattgttcactgagcatccaaatcagcagcatcagcagagagtgggatgccaaggaatgactcagcaagggcagctctgcaaggctacagaagagctttgtgggggctctggccagacccaggggcgatggctaaaaccaaagaggaatggatgtactgaattcccatcagagaagtgtggctcccggctttctggtttacattttttttaatc

SEQ ID NO: 459618 - DNA, 4639 bp, Homo sapiens
cagatgccatgagtccaaaggaatcatcccgcccccagcagacaagcgtggagccagcctgctcctctggccaaagcattccacccccggacctctcctccaggaagaagagatgtggaagaagagatgtgggtatggtggattctgacccttggctccccaaagttccacagagcccagctcccactgaaggcatatgacccagatcctgagaaccagatgcaccggcctgagctttcgtcagaagcaaggacacacagaacctttcttagaggcatcattagaggaccggacatggtggccagaggctgcagggacagaagtcccagggccatgtccaggaactgggctcaggggacctcctggtgccacctgcatatctgagcccatggagttcctctggtctattcagttctctcattttaacttaattttgtttttgtaggctttcttaaaaaattgcccagttcatttacctgatcacgtttattgttcagagttgagtgtggttctctcgtaattatttagtctccactgggtctgtgattatatttcctttcttattgctaatgctgtttgtgtttgattttcttcttttttttcttggcctgacttaaagaggtttgtctgttttatctttattttaaaaataaccaactgtttatttttacttctccactgtgatttccccctttatttctttaattagacaagtgggggcacccagttgagcactggaaatggggctctggacccttgaagagaagccagcagttgggtcattgcatgagaggtggttgtggtgatgatgggaactggtaagattgctcaggttaaaatgaagaaaacaagccaaggaaaaacgatggtcaaggcaaatacagtaaggatcgacggcatccttgaagtacttctttgtctccaagagcattcattctatttcatgtgcaatgagaattctagcattttagcactgtttaaaattaatgactcagagggaattctggccccacacaagcgcctgctagatggaatggaatgcgaccacagatcgacatgtgacgagcctctatcgcctcaagggagaagaactgtggcaggaacgcaatctgtcccgttctcctgctcctgtgggtttttccattgcatggatatgggttgtgagggaatggagtccctctacagagatatcagatgcagatggagggcagagcaggctggcttacagcatcaagccccatgggatgagtgctccatcctgactgccatgtctgcactgtgtctgcacagtgtctgtgaggccccatctgtcatgacccgatgctggccagcctggcctgggcagagctccgaggagcattataaaaatgtcgaagccatctgctagaaaatcacagctctgcgatataaaacacccagagctgtgttgctcaaactaatttaatcacaaaataccatttccttgatccgaagggaaacatttctacttggccactagagctttctggagaaaggcacttatatttgcagtaaggtatattagtaattttgaatttcaaagagaaaacagagcagggattttggaaaacatatgttgaaagggtaatttcaattctttgcagatgagaaaagtttttgttaaaacaactgacagacactgagaaacatggccatcagtttgaaggaaagtaattgagttgtgcagtttgcattttattttgcacacgtttaacaattaaaagcttttctgtactatgagaacaaaaccccccaaacaccaatgcaatggcagaaagttgggagtcaaatcaggcagcacacacacgaacactgtgttcacatgatgaggaccacatttttgagacattttctgaaaagaacctgtatatgtgtgtgtgtgtatgtatatattcttttttcctgccagaatctcttgttgaatgatcatcaagttagttctggaaaataggttccaatattgctccattcattggcataggttgactttatcttattccaatttaattggcagctgttttcttagatagttttgcataaaatggtgctcagagaacaagtagagttttaaacatgacacagtcgtgtatttgaggatgtttatgttatatatgtgcttgttaatttagtagttatgagtttaataataactttgagctctttagacatggatcctcatatatattaacaaaatcagctgtgtgccttaaccaacagtgagcatattttttaaaatgggcctctgaattgaaaatttaaaaaaacccttcagcatcctattaggattgattaacccacaggagggtaatcctggtaagcaaacgtaaccaagattctccttccccagtgattccaagtgcagcctggctctcctggtcaggtgcttcctttactcaatatttcctgatctgttcctagatcctaataccaccctctgcgtcaacctgtgaatgcatcctcactaccagggctcaggacttggagccgggattttgctgacatggtcttttctctggttgtcaccttccatttcttctttggtttgcctttcattttaatgccagattttctaagtgtaagaaaggagggtggagagtgggcagaagtcattgtttccatcatgaaagtcaacatcagtatttcctgtcctggggacaaaccagtgcctcatgtttctggaaacgctgcagcatttaacttcaattttaatctggataacgccaaagcttttcctcaaattcacccctggagtcagctcatagatgctctgattttgtctaccattgctcctccttaatatctctcgcacaggtgccattgacctttagatgggctgtacggtgtggggttcggtgccatggatctgcttctccagggaccaggatcttgagatcttcaggctgggtttccatggaggcatggagctgcttttcctccttcataactgcactcaaaacagccctgttgctctagaatggagacttgggcaactccttctggcacagatttgttcacctcaggtgaaattcagatagaagcaagctgcaggcagtttcacctctaagtccatgggttctcaactggtaacgtcctcttatggatgttagcccatgaggtcaatcctgtagcaatctaaggcttgagaaaaattaatcttctggaaaattccaagaatacatcttagggaaactggctctacctttatgacttggatcacacaaggatatgcttttcatcttggactagaactgagagccaatggatgtgttatctaaaactatcccagtgtgttcactatacagaggaagattctgagattcaagactcaagactgaagaagatcattatttttattattttagtcttatgcacaaaatgatatctactgaataagcaggtttttaataggtgacttatatatgttagcaaaaataaacactttgtcttttagatctattctagtttttcagtagctgtagacttaagtgctaacttttagcccataggataagaagaaaccaagtcctaaaagtaggccagcaccagggttcaggcctctgacttcaagccaagggctcatcatcttgaattgcgcacgaatttttacacagcgccaaaggaaactgcctgtacttactgttgtaggtaagacaaacctttgcttatttttacttctcatgaataaatagttgcaagaagaactgctgaaacaaagggcattaatgagcttttgctacatataaatagggagtgtgaaccagcagtgtggcggaagaacattttcccctcaactacggcaggactatgcgatgttctccaatgagctcatcttgtcaataatgtgtagaccttcatgtgctttttaattatgtgctgattttattacaagtgaacctgtcctcttgtttgttcccttatacatattcactgtctttatacctttcctttccctccacgaactgtctgctcatatcttttgccctttcagagggaatagtctgttttttcttataggcttataatattttaaatgtaatgataatgttaagatttttttgacatgtactttatactttcccagttcattatgtatatttaaatgtttcactaatattttaaaacatacatcttttcttaaattttccatggttttatctcttagccattatgcttttgctttctgtggtatattcctggggagtgtctcactgagacccttcggtttctctaagttggtaactttatctcccgtgatgagaaagcttttcaaagggagagcgtgaccatttccatatagagtacagtgttgttttggggtttaagattctattcccgggtgtcatcacttctttttaaatttaactttgttatggaaaatcttaagcatatgtagaagtagaacaaatagtctaatgaaacctcacttgttcataacctggcttcaataatgatcagtacttagctattcttacttcatctacccctttactctgtgttttatttttcctggagtattttgaagcaaattctagaaatatatatatatatatatatatatataaataccaatatagtatatatatacacacacaccgtattggtattgatatatatatatata

SEQ ID NO: 459619 - DNA, 991 bp, Homo sapiens
acgcaattaaagtcataattaaagaaacccccctctccacccaccctgatcaagacactgtctgaagtttccccctcatgatttaaaaaaaagaaatttatctgacagaggttctgctgaggaggccagctctcacatcagagggtgatggcagtttgtgctggatgaggataagacaatgctgtcctagggctggccatctgataaagcttcccagaaagtgcagtaatggacccctgggaggctttctgctctcctgtctgcgggttcctgagctgccaaaagtaccttgatgttttctgaaagcagagccaatgaccacactccagggactgagttctcaaatatttacctttggagtccaacccttctgaccatccagaggcaagcacaatattcctgagaaaatctcaaatagatggtgagacaacattgttttttctgccaagaaaaaaaataaaagtcttgttctttgatcagctgctgtacaagcatggcttcaacatctgcttctggtgagagcttcagcaaacttacaatcatgatggaaggcaaaggggaagcaggtggttccacatgtacaagaaaaaagaaaaagcaactatacagagcgtgtacagtggaagaagtcagtggttgggcattggcgtccaacgggtactggacctttgatgtcacttttactttaattaaaaatggcagctggctcctgacttggagacacctcccagcaggggttgatagacacctcatacaggaaagctggcatttggcgggtgcccctctgggacgaagcttccagaggaaggagcaggcagcaatctttgctgttctgcagcctctgctggtgatacccaggaaaacggtctggagtggacctccagcaaactccagcagacctgcagaagaggcctctgagtgttagaaggaaaactagcaaacagaaagcaataacatcaacatcaacatcaacaaaaaggacaacaatgca

SEQ ID NO: 459620 - DNA, 797 bp, Homo sapiens
tgcttcagtctgtaggtgactgcagaaggaggaggagctccatctgtactctcttcaggcagttgtgtctctcagtgcttgttgggttcacacctattaaataagctggctggtcttcaccctccaagagaagtcaactcatgggaggtggcagggtacaggcattggcccaagctgtggctggggccaggctgtggtgtcggcaggcaagcagcagacaagaccatctctgcaagtgcagcacagcctcagcctagggcaacgggagtgtgaggccaaagctgtgagcagaggcatagatttacctttggagtccaacccttctgaccatccagaggcaagcacaatattcctgagaaaatctcaaatagatgtgtgaccttggtgatatattaacatatcaagcaaagagatgcagatagatctttgggcatatttgatgaacggttacacccatttacatgagaagacgttttggaggaatattttaaatatgatccttaacacaaattggttttcagttttgtttgtattctgtttaaagccataaggctaacagctgaatttgcaattgtaagtttggaatgagttggaaagggaattcttgaagctaattaattacaatatcagcgttactggcagtgtttatagcagattctacttcaatcttcgaaccatggcacatgacaacagcctgtattcgctagtttatcttcttgacagagaaagagcatggaagctggaggctttttcaaggatggaacaagacaaagttttctatagtgctgccaagaaca

SEQ ID NO: 459621 - DNA, 931 bp, Homo sapiens
gtagataccgtggaggccagaagagacgaataattcaaaaacctgaatggcgaatctgacaactgaaaatgcgagtcgggcctcgatgagtcgtcccggtcgaacgctggcgcaggctgcggcgttgcagaggacgcgtgtcccggagcgccctgcggggccagcccaactctccctaggtgctttctcccagaaagaaacaagactacgtaataataataggaatggtaccgcgctgccaatgcggagcagccttgcacctgaggccagtaaccagaggtttttgtcttcgctgtggcctgcaggacgaggacctcgccggctttttttctcgctgaccgagcagctgagaccgcctttcaggggtcggcagtgtggactggctggtcccgatcgtggggaccagggacttattccctcgagggtcgactgttggaagtaatgtaggttttgatagtgaagtgtgtggagaggaagaaggaagcacacctataggatgtggagaagggatttcccctagagaaatttttaaaggttgagcatgtatgttttgaaacttcccaaagatccattgaaaagtaaaccttccatccctaataccctgtatctcggtgatccccagtagtcactactgttaatactctcttaggttttcttccaaatcttattaatacctttgcatattatgtttttatttatggtagagattttcatccattcaacagaagcttatggactgcctttttagtttattttaaaagaatttttctagctttaaataaaaattgtatatatttacagtgtaccatgtgatgttttcatagttgtatatgttgtgaaatgataacatacccatcacctcacatagtcgtgtgtgcttgtgtgtatatgtttattttgtgctaagaatatttaaggtcggccaggtgtc

SEQ ID NO: 459622 - DNA, 720 bp, Homo sapiens
gcaggctgcggcgttgcagaggacgcgtgtcccggagcgccctgcggggccagcccaactctccctaggtgctttctcccagaaagaaacaagactacgtaataataataggaatggtaccgcgctgccaatgcggagcagccttgcacctgaggccagtaaccagaggtttttgtcttcgctgtggcctgcaggacgaggacctcgccggctttttttctcgctgaccgagcagctgagaccgcctttcaggggtcggcagtgtggactggctggtcccgatcgtggggaccagggacttattccctcgagggtcgactgttggaagtaatgtaggttttgatagtgaagtgtgtggagaggaagaaggaagcacacctataggatgtggagaagggatttcccctagagaaatttttaaaggttgagcatgtatgttttgaaacttcccaaagatccattgaaaagtgaaccttccggccgggcgcggtggctcacgcctgtaatcccagcactttgggaggccgaggcgggcggatcacgaggtcaggagatcgagaccatcgtggctaacacggtgaaaccccgtctctactaaaaatacagaaaattcaccaggcgtggtggcgggcgcctgtagtcccagctactcaggaggctgaggcaggagaatcacttgaactcaggaggcagaagttgcagtgagtcgagatcgtgcca

SEQ ID NO: 459623 - DNA, 1414 bp, Homo sapiens
tctccccaaccccccctgttcctccacatcacccttccagcataaccctctcccaactcccctcccttccccaaaccacaggtccccctcatgcagaaagaagcccatgaggcgcacccctcccgagcgtggcgtggggaaggaccccccgaagaagcacaacctcaacccagccagaaagcaccccccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaataaccacccaaccaacctctcaccctccttcaccactcaatcccttcaaacctcaacatccccacttccacattcaaccatatcctcaacaccaatccacctttccccaacccaaccttcaaccatctctgacaccaatcagatcttcggcctgagcgagacggaaccttgctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaac

SEQ ID NO: 459624 - DNA, 368 bp, Homo sapiens
tctccccaaccccccctgttcctccacatcacccttccagcataaccctctcccaactcccctcccttccccaaaccacaggtccccctcatgcagaaagaagcccatgaggcgcacccctcccgagcgtggcgtggggaaggaccccccgaagaagcacaacctcaacccagccagaaagcaccccccccagtgggaggctcccaccctggtagatgaacagcccctggagaactacctggatatggagtacttcggcactatcggcatcggaactcctgcccaggatttcaccgtcgtctttgacaccggctcctcctagccctggagtctactgcctccggtacctaatcgagtcgtatcatgta

SEQ ID NO: 459625 - DNA, 247 bp, Homo sapiens
atcactgttgagctgcaccaagttgaggctgtgtccactgtcttcagtaattccctggggcacactattcctacacaactcagtccagtcctattcaggatcctttgaagggaccctttccctagaagatgtttaaggtttgttctgaccccaggagagcaacctgtgggtgccctcagtctactgctccagtcttgcctgcaccaaccacaaccgcttcaaccctgaggattcttccacctaccag

SEQ ID NO: 459626 - DNA, 1417 bp, Homo sapiens
tctccccaaccccccctgttcctccacatcacccttccagcataaccctctcccaactcccctcccttccccaaaccacaggtccccctcatgcagaaagaagcccatgaggcgcacccctcccgagcgtggcgtggggaaggaccccccgaagaagcacaacctcaacccagccagaaagcaccccccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaaccttgctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaac

SEQ ID NO: 459627 - DNA, 1235 bp, Homo sapiens
  misc_feature (33)..(33): n is a, c, g, or t
  misc_feature (36)..(36): n is a, c, g, or t
gtcgagttctgtaccctctctccacactggtanatnaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaaccttgctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaac

SEQ ID NO: 459628 - DNA, 2105 bp, Homo sapiens
ggcggttttgtggaatagaaaagggggaaaggttgattgaaaaactccactgataaggaaggaaatgaagaagaagtacctggaaccgtgtccctcatcctctctagaagactgtggctactccatcattttaaactattacttacaactcacattttcaatgggcccttctccaattgaattaaatatgatccacattataaacacccaattatctcactttcttcaaatatatgcaatttattttaagtacatctatggaaaaggagtgtgtgtgtgtgtgttgtggtgtgtgtgtgtgtggtgtggtgtgtgtgtgtgtgtctcaacatattttcctgcagaggtgattgtgccaaatttatggcaagtgaaaaaactgggagagggagggcatgcttattcaagtttcatccagtattgcaagtcttttttcgttcctcctctcgtgtatcttctgtgtgtccagtacaccgtgagttaagtaagagcaatcttcaatagttaactgaatatcatattaatgatctgcttcattttgagtaaactagtgcttctattccagaaagtggtataaaaaaaacctggtgaatataatataatataataaatataatactttctgtatataatgtgcccgactgaaaaatttatgattatattttccaagtaaattactagatttgcacagctaggtttaaaagagaaaaaggtcagcaaaaaaggtggggtgggttatggtaatttccatacaccacaccccaaactggcaaaggtatatcacaattaatcatcttatgacgttagaagagtgtctgtttccacccgagttacacattggcagagatatgcatgcattgaattctgctacactttaaacaaaggatacaaattgctaaggaaaggacagtctcagccagcaatatcaattctcagaaccagaagagaaacaatgagattctttctctttagccacggcaccaaactctgaaccggctgagcctggttagcccttgattcattgtataagttgacccccctaaaacaagaaaaacgatgaagatgaacaacctgaactggactcctgccaagtccacaaaccgattttgcaagacctgacacttttgaagagtattggacagctattttgaagaatgtcctgcaattctgcctaatgtgtttcaatgaataaatgttacacgtgcattgttggccaagagtaccacagaaatgataagcccttcttagtgtatcaaatcagatggcattgttttatgtaccttatagcaagagttaatatttctctaaagaaatgacaggtcacacttcgtaaggaatacctgtttttaaaaaattcttgatgtgttgtagttttaaagggaatatttaaaaccaagtattataagaaactcgaaatagagtttgcatatggataggctaagatacaaatttaagattaataatatatttactaaatctattactatctctaggcattgttgtaggattttccatctattaacatatataatcctcactgcaaccttataaatgctgaccctattgttatcttgtgtgtaggaagaggtattgctgtaaggtatgtgaagaggtgtatctatgaggaactttacttaagttctgattggttatgaaacttactccaggaacccagtgcaataggctttataaaccttttacatttaacagtcaactttgtggcaataaacattcattaaccacaatattcttaactaattaatgtattcatttctttctcaagcactgtctataatattcctgttgtgtgtcgcgtattgttctagacatggcagatacctagataggcaggagcaaacattagctatcaacagcaacaatttcatagacaaaaactgatggaattcgcttggtttatgtagactgaatcgtatctataaaaacatattttaaatcattaaaagtgtgagatgtttgccttctaaaatgacctttctcaatttaaaaagctgtgaatgtaaactgatctataaattattcttttcaaatatatgaccattttttgtaaacatagaggtctatttgtattatacctgtgtttaccc

SEQ ID NO: 459629 - DNA, 1185 bp, Homo sapiens
tcgtgccttgcccgagctggtcggaagcaaggggaaaggcctccatggtcatacagcttcagggccagatccgaaaccagccagtgctgcccgaggacagaggcctctgcctgctgacaacacggaataactggggaccagagggcctggatgaaactgattttaagactaccaccagttctgaaatcccaggagtcaggagacccgtgttgtgcgttcctgtctcagctctgccactgaccagcaacgtgaccttgatggcattgctgcagctcattttggggggttctctctcctcatcggtagacggcagtgagatggagcccctgcccctgccaccagaggccctttacccatccctacagtggccctcaggaggtgcagaccggcctctagacctgcaccaggaggctgccacagcctcagaatgcagtgagcatagtcggtcttggggcatggaggctttttccagcatccgcaggaggaaggagaaacagccacccaagcgacatttgctgtctgcctcctgtggcagggaggcagaggccaaccctggattccagtggggtggaggaggcagcacgctcacggataaggacaactcggtgctccaagattttgagcgttattacaaacacaacagaggtctaaggagaatttatcaggacccctgagtctccccgcatgacactcagctaagcaggggaaagtggtatttggaggacacatatgtggtgaatcataagacctgcagcatctgacctcctgagctgcctctccgggcgcttggcctcaaatgcaagagacagatcatagaagtgatgtgcatgaaccaagatacccaaggagcatcacacctttggacaagagcagtccgggagagggaaaaacaaaccagccagcattctgcagctcattcattcaacacgcttccactaagtgcctgctgccactgctgtggcagatgatgacaaagatgatgatgatgatgaccaagtattaagtaaagatgccatttacagatggacataatccctgtcctcacagaatacttgatttagtgggggactaaagcaataatgacacaaataaatacatcctttacaaattgtgagactgctgtgaaggagaaggaaaggttgtgaagaaacgtgtctcagactcagattttaataaagcgccccc

SEQ ID NO: 459630 - DNA, 699 bp, Homo sapiens
ttattattcccattttactggcacgggagcagaggcacagaaacatgaagtgactttcagcgaatggagaagtcagacatggaagtttccaatcagatcaccctcgtggaagacgtcttagccaagctctgtaaaaccatttacctgctggccaacctcctggccaggccactcccggagggggtcgatcctctgaagcttgagatctatctcaccgacgaagacttcgagagaaaggatgttgggctgctccagacctctgacaatggatgcacccccaggattagatcagaaagatggacctgccaggggaaagcgtcagaggcttctgttcctaccatcagtaccatggatgcgctattaacagaccagcgtcccttgtttctaatactgaactggcctctactgagcttttgcctctactgagcttttgtcgcgcagctgagattggaaaggaagcctcaggagcagaagcgaatgcaagctaacagaaagaaaggcagcgcggaggacgccacagccccagcgccctcccagcctcagcagagctgtggggattgttcttcacatctgacgccatggggttctggaagtctcttaagggatatattggaactgacttgtattatttggaaatcgacataaattgtctattattaaatctcactgaattaagtccaactttaccatctgaacacc

SEQ ID NO: 459631 - DNA, 5911 bp, Homo sapiens
  misc_feature (3713)..(3713): n is a, c, g, or t
ctacccaagattcccaatgccccagagccgcagtttgcacaactatatctcatggcgtttctcttgtgtgtctgaggagctgtccagctctgacatcctggaacaaggaccgtctaatgcccgtgaggagaggatgagactgggcttcgtattctttccgtctgccccggaccgccgcggtgttgagtccggagctgacgccctcgagccgccagcaagcggaaaacccggagtggatctccacgccttttggatcggagccaaagggcacctcggaggaggtggccggctctgcggccctgcccggtgccaggccgcggccatcgggggagcacgggctgggggtgggtcgcgcagcggagccggatcccctggccggacgagcccggccgtggggctcggcggccctccccgcggggactgcgaggcgggcggggcgcggggcggcggccgtgccctcggggcggcttcgggcggcggcgggcgcgggtgcagtgcggcgcgcggccggcagcgggcgcaggcggtggctgtggccgcggcgttcggcggctggcgggcggcgccggcggtgccccgggcgcgctcacacacgcgctcacacacacacatacacacggcctcgtacacacacacacgctccggcgcgcacacgcggcgcgcaggccggagggaggcggctcggcgctgttcggcggcggcggcagcgtgctccgcgggcgggcgggagggctggcgggcggcccccgctccccggctccgcggctaggtgcagcccgctcggcccccgccctcggacccgcccccgggggtcgcccggccccatgcccagcggcggcggcggagcagcgcgcggccgcgggcggctctgaggagcccggagggaaccggcgacgaggggaccatgtaccgggacccggaggcggccagcccaggtaagcgcggccccggcgggctggggcgccccgcaccggcgggcaggacagcggcagcgccggacgccgtctcggagccccagcctggggctgttgtccgcccggagccgcacgggctcccccaggggtcatcccagccccgggggcgcgggatcgagcggcagcggctcggaccccggtcccccgcagtctggacactgccaggctggatgtctgggaccggcttcgcagtgtccccacaaggacctctcccccacccctcaacagcccaaggacaacgtgtgtggcggagcgaggagccgctgcccctgtgggagccgggcagtgccctcagaggcacccgaggctccccagcaccggtgccccgggggtgccagcgctggcggaccccagggcgaggatcccggcagctcttggccaaggttgcgggcacaggggagcggagtggcatcgcagtgccaactgtgaattgagagggtgccagggggcaagtgggaatctggtctggccagctgggttgaggctgcactgtgacccaggcagccccaaagcggccaggatgcagtcagacaggctggagtgtgcgggtgtcgggcaacgccgcaagctctgagcgccagattgccccgggagcggtgagggggcggcgggggccggagaaccgtctgccgctgcttcgccgctggcccaggccgccgctggggaccgtctgtgcgcccgccggggtgcagtgcccgcgccagccaccaggaggcagtgcggcgggcccccgggagggaatggggcgtggtatttaccacgttcgcggggcggccctttttgtcctgagtcaggactggggtcttcagcatccgaggacctaactcgaggaaagggggctcttgaggtcactgggtgctgccatagcttcagctgagggttgatcagggaggcattggcagaggaaggcggaatcactatgcacagtctctcggatcctgctcgctgggagctgcgcaaagggcgacctggaagagggcgcagccccaggactgagttctgtttcagcaccaaggacaaggagccgcgtggccgacagctgaaggacctgcttcctgccttctgctccctgcagaagctccctgtcaccaacagggctgcccatgggctttgtgcatccctggggcctgacttcatgactttcaaggtcccttctagctggagacacagtgactccatatgcagggaatggttcactctggctggggcgccctcgcgcgacgtcctgctggtctctgccatcatcaccgtcagccttagcgtcactgtcgtcctctgcggcctctgccactggtgtcagcgcaaactggagggacattcatcccctgagggcgccggtagggggagcggggctgagccgcccgccccgcatcgcgccgccccgcccagcccgcagcccacagctccccgagccgctgctccgcaagacctccactcccgtccccactcctgccgcccggcccagaagtgtggtgggactttgggggcagcagggggcgaggggggcgacggtgggcccgggggtgtccgagatgtgtggaaccgggctggctgccctgctttgttcctgggtcccctgtgtctgcgtctgtctcagaatttcaggaaaggtggtggaggaggctgggccatgtgcctctgtgtgtgcgaggctccagtctgccgcctgccgcttgcctcctttctgtgtggcttcccggccctcgagtgcgtgcgtgtgtgcattggtatgtttgcacatgtgtgcgtgtgcgttgatctagacagagacttttggaataacaatgagagcacagtgcagcagaaatggagctcctaccctcccaaggagtttattctaaacatttcaccctacgccccttatggcgacccacgactgtccctcaaggccagccttgcaggagagccccctcggcagccatacctggcccccccagctggtcccggggcccaccccaccttctgtgcagtcaggatggggttgcccgtttgggtcccgccccctcggttgtggtcgcttcttcctccccgctgtgtgctgccgtggctgctcggtggtcggtgtggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaaggagctgtgggcctacctggccggccaggcctgggccggcccctggagcctcctgggcgaggcagtggcggcgacggcggtggcgacagctccgatggaggcctggcgaggtccggcagcgcgcaccctgcactggggcctcctagtcctggccctcggcttctttctcttccactgtgatcccttcatctgcttctcctttctctcctctcctccacctgccccaagtttcgaggactccaccctgtccacggccactacccttgagtctatccccagctccacgggagagccgaaatgccagcgaccccgcaccctgatgcggcagcagagcctgcaacagccgctgagccagcaccagcggggccggcagcccagccagcccaccaccagccagagcctgggccagctgcaggcccacatggcctcggcaccaggccccaacccccnggcctatggccggggccaggctcggcagggcacctcggccggctccaagtaccgggcggcagggggccgcagccgctccaacccaggcagctgggaccacgtggtggggcagattcgaaaccgaggcttggacatgaaatccttcctggaaggccggatggtggtgctatccttggtcttagggctttcggaacaggatgactttgccaatatccctgacctgcaaaacccaggaacccagcagaaccagaacgctcagggggacaagaggtacgagcacaggcgagggcctgcggcggcggcggcagagaaggaggcgcggagaggccgcctgcctcgaccggccccggctgctggacgagctgtttcgggctcctttccttccccctgcctgcccgtgttgcctgcaggagggaaggcggtgaacacagcccccgtgccaggccagacaccccacgatgagtccgaccgccggaccgagccacgttcctccgtctcagacctcgtcaactccctcaccagcgagatgctcatggctgacttctgctggtgcaagcgctcaggaagcaccttccctgactgtgatggggtggccaacctggctgccacagagatggctctgtcccagctgagctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagttcccactccatctgccgataaacaaccatatcaccttgggcaagtggctcggcctctccaagctttagtgttctcatctgtaaaatggagcaactaatactgtccctgtagaactttacagggtggcgtaagaattgcttgaggaggcagaggttgtagtgagccaagattgcaagactgcactccagcctgcgcaacagagaaaactctgcctgaaaaaaaaaaaaaaaaaaaaagtgatctcttcatatcacgtaaccaaaaaattcatacctgaccttgagttttcccaggacgggattctgtgacataaacccttccatgcttctaccttaaaatgtctactcctgtgtttatttatggtttagtgttgaaagcatgggctcgggagtcagattgcctgggtccaaatcctagcgttactttttaacgctgtaacctctctgagcctcattttctcctctcaaaatgagagtgggatggtcctacccttacaatgtgctgagaggattaagtaagatcacacaggtgagctgtttagcataggacttggaacatatgttagctagtatgataataaaggggcatgtatatccattcaggcaggacagtttgaccaggagtatgtgaggaaccagtgctcagggcagtcatggaggaaggggagatgccaggagtgagtgaggggcacatacctgggcattatcctgtgtgggggaaagggaaagggggactggatacccacagggaagggagctgagttggaggcaaccctcagacagatgggaatggagaactcacctgctggggtgagggaag

SEQ ID NO: 459632 - DNA, 862 bp, Homo sapiens
agcttcctgaatttcctattatattccagagcacagctgcagtgtgcatcagcatggctgcatgatacctattatttctacatgggctggcctctaaagaagaaaaaagctctgcagtggctgggccctcacattcctgcagaagccacatgtcaagaagatgatgaggagaagaaggatgacaatgttgatgatgccatcctttggcttcctcagcttttctgtggagccctttgctcacaagaaaatctaactgtgctatgtcctttcctttctctctggcctccgtggctcctaccgtgggcagctgaagggtcttcagatgcaagggagggggctcttttggctcaacccaaagtgtctggcactggtagccctgcacgttctagcagtggcaccaaggacccggcgtgggcaggagcacgcaggctggagctgccctgtaggaggcactgcttctcctgccctcatcgcccacttctcctattaggaaatgcctgaggaggtgccactcctgcggggctgttttgaaggggctggaagtcttttctgtcaccacctttacctacctgtcatctgtgaacgtgactggagatgccaaggctttcctcgacttctgccactgcccatggttcatggccctctcaccctgctcctcttaaaggccatgtgagcacagtgagaaggtggccatctgtaagccaggaagagagctctcatcagaacctgaccatgctgacactctgatcttgacctttcagcctccagaactgtgagaaataaatgtttgtggtttaagccatctactccatggtattttgttatgacagtccaggttgactaagacagacaccttagtctt

SEQ ID NO: 459633 - DNA, 945 bp, Homo sapiens
gtgagcaagatggcgactgtgaagagtgagcttattgagtgcttcacttccgaggagccctttcatcacagaaaggtctccatcacaggaactggatcagtgggcatggcctgcgctaccagcatcttattaaaaggcttgagtgatgaacttgcctttgtggatcttgatgaaggcaaactgaaaggtgagacaatggatcttcaacatgacagccctttcatgaaaatgtcaaatattgtttgtagcaaagattaccttgtcacagcaaacccccatctagtgattatcacagcaggtgcacgccgagaaaagggagaaatgcgctttaatttagtccggcaaaatgtggccatcttcaagttaatgatttccagtattgtccagcagagccccctctgcaaactaattattgtttccaatccagtagatatcttaacttacgtagcctggaagttgagtgcatttcccaaaaaccgtgttattggaagcggctgtaatctggatactgttcgttttcaattcttcattggacaaaagcttggtatccactctgaaagctgccgtggatggatcctcggagagcatggagactcaagtgttcctgtgtggagtggaatgaacatagctggtgtccttttgaaggatctgaactctgatataggaactgataaagatcctgagaaatggaaaaatgtccacaaagaagtgattgctagtgcctatgagattattgaaatgaaaagttctacttcgtgggccattggcctatctggagctgatttaacagaaagtattttgaagaatcttaggagaaaacatccagtttccaccataattaagggcctctacggaataaatgaagaagtcttcctcagtattccttctttggagagaagggtattaccaaccttataaagagaaagctgacccctgaagaggagg

SEQ ID NO: 459634 - DNA, 3125 bp, Homo sapiens
ttatggtcagctcatcacgcccttcacggttcctacgttccttttgtgtgctgagaggctgctgccatgatcattctgcggtcagggaatgagttggcctgaggttcacatcaccctattgtgtgagcacgtgcatgctgctgtttgaacccaggcacaaaatacttgaaggtgattgcgatgccctgaccaggctcttctcttccagtactctgccatgttccctgtttgttttaacctgcaggaagaaggaggagttgcggatgatagtgccatttctaatctgctttggcgggtcacagaaagtcgagagagccaaatgatgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagttggcgggatgcacgaaacggtgctcactgtcaccggcaaatctgtgaaggagctgatgaagccggatgatgacgaaacctttgcccaattttaccgcaacgtggattgtaatatgctgagaagtcctgtggagctggacgaggacttcgatgtcattttcgatccttatgcacccaagaaatactttgtggagtccaagacccccaggtcatccaggggtggtggtgtcacagaccgggaccgcggctctgcttccatccgcagattgacgtcttccgtggccgagcacaagtgggcagttaggcccaagcgccaggttcaggcctccaaaaaccccctgaaaatgctggcggcaagagaagatctccttcaggaatacactgagcagagattaaacgttgccttcatggagtcaaagcggataaaagtagaaaagagagagtatttgaacccccaccctgcttctgtgtttgggaatggcttcttccgatgctttactcattgcttggttttctgccttgtgaaggccaataatggtgctcagaaggccctcatgaacttctcagaagtcaccctggcgggtttagccagtaaagaaaacttcagcaacgtcagcctgcggagcgtcaacctgacggaacagaactctaacaacagcgccgtgcccttcaagaggctgatgctgttgcagattaaaggaagaagacacgtgcagaccaggctggtggaacctcgagcttcggcgctcaatagtggggactgcttcctcctgctctctccccactgctgcttcctgtgggtaggagagttcgcaaacgccatagaaaaggcgaaggttgctgctggagacccaaaagaagatgaactctatgaagcagccataatagaaactaactgcatttactgtctcatggatgacaaacttgttcctgatgacgactactgggggaaaattccaaagtgctctcttctgcaacccaaagaggtactggtgtttgattttggtagtgaagtttacgtatggcatgggaaagaagtcacgttagcacaacgaaaaatagaatttcagctggcaaagcacttatggaatggaacctttgactatgagaactgtgacattaatcccctggatcctggagaatgcaatccgcttatccgcagaaaaggacaggggcggcccgactgggcgatatttgggagacttactgaacacaatgagacgattttgttcaaagaaaagtttctggattggacagaactgaaaagaccaaatgagaagaaccccggggaacttgcccagcacaaggaagactccagggccgatgtcaagcggaacaacgtgacacggatggtgtccgtgccccagacgacagcaggtgccatcctggacagggtgaacattggctgtggctgtggcctggtggaaggacaccacaggaggcagtttgagatcaccagtgtctccgtggatgtctggtacatcctggaatttgactatagcaggctccccaaacaaagcatcgggcagttccacgagggggatgcctatgtggtcaagtggaagttcatgaccccattgcaaaacactcacccggatgcttggcgctggggaaagggggagtccggtgaactccggagaaatcatccctttccttgccaaggaggagcctttcccacagcgctcctcaccccttcccatttaggagagcatgcaggtcacagggaccaagtaaagatttcagaccctgtctccaagacagttatccatgatgtaaagcaagtgcaggaacacccagcaggcgggtctcactgagcacacggccagtggggctgtgtgctgtgcagagccgggctgtggcccagaggtccccctgccccctcagggcacgatgctgggggctttaccctgcctctagctgagtgcctcctgggtttcctgagacttgttctgttgtgatgctaatttctcagatgaggaacaggaccttaagatcaaggaacctgcctgaagccacaagctagcagggagtggagcgggacactcacatccaggcctgcctcttttcaaacccaactgtgctgctaacccaccctgcatgcagggagtcagagtggggctccagcacaggatgtggagagccgtgagtttggctacaaggaggggccgaagatcccagtcaccagactgtggagcagatcccggaagttttaacttcgcgccccgcctgttcgtcctcagcagctcctctggggatttcgcagccacggagttcgtgtaccctgcccgagccccctctgtggtcagttccatgcccttcctgcaggaagatctatacagcgtgccccagccaggaaaaaaatctcaagaagccagtccccaagtcttaccttatccatgctggtctggagcccctaacattcaccaatatgtttcctagctgggagcacagagacgacactgctgagatcacagagatggacatggaagtttccaatcagatcaccctcgtggaagacgtcttagccaagctctgtaaaaccatttacctgctggccaacctcctggccaggccactcccggagggggtcgatcc

SEQ ID NO: 459635 - DNA, 3385 bp, Homo sapiens
ttatggtcagctcatcacgcccttcacggttcctacgttccttttgtgtgctgagaggctgctgccatgatcattctgcggtcagggaatgagttggcctgaggttcacatcaccctattgtgtgagcacgtgcatgctgctgtttgaacccaggcacaaaatacttgaaggtgattgcgatgccctgaccaggctcttctcttccagtactctgccatgttccctgtttgttttaacctgcaggaagaaggaggagttgcggatgatagtgccatttctaatctgctttggcgggtcacagaaagtcgagagagccaaatgatgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagttggcgggatgcacgaaacggtgctcactgtcaccggcaaatctgtgaaggagctgatgaagccggatgatgacgaaacctttgcccaattttaccgcaacgtggattgtaatatgctgagaagtcctgtggagctggacgaggacttcgatgtcattttcgatccttatgcacccaagaaatactttgtggagtccaagacccccaggtcatccaggggtggtggtgtcacagaccgggaccgcggctctgcttccatccgcagattgacgtcttccgtggccgagcacaagtgggcagttaggcccaagcgccaggttcaggcctccaaaaaccccctgaaaatgctggcggcaagagaagatctccttcaggaatacactgagcagagattaaacgttgccttcatggagtcaaagcggataaaagtagaaaagagagagtatttgaacccccaccctgcttctgtgtttgggaatggcttcttccgatgctttactcattgcttggttttctgccttgtgaaggccaataatggtgctcagaaggccctcatgaacttctcagaagtcaccctggcgggtttagccagtaaagaaaacttcagcaacgtcagcctgcggagcgtcaacctgacggaacagaactctaacaacagcgccgtgcccttcaagaggctgatgctgttgcagattaaaggaagaagacacgtgcagaccaggctggtggaacctcgagcttcggcgctcaatagtggggactgcttcctcctgctctctccccactgctgcttcctgtgggtaggagagttcgcaaacgccatagaaaaggcgaaggttgctgctggagacccaaaagaagatgaactctatgaagcagccataatagaaactaactgcatttactgtctcatggatgacaaacttgttcctgatgacgactactgggggaaaattccaaagtgctctcttctgcaacccaaagaggtactggtgtttgattttggtagtgaagtttacgtatggcatgggaaagaagtcacgttagcacaacgaaaaatagaatttcagctggcaaagcacttatggaatggaacctttgactatgagaactgtgacattaatcccctggatcctggagaatgcaatccgcttatccgcagaaaaggacaggggcggcccgactgggcgatatttgggagacttactgaacacaatgagacgattttgttcaaagaaaagtttctggattggacagaactgaaaagaccaaatgagaagaaccccggggaacttgcccagcacaaggaagactccagggccgatgtcaagcggaacaacgtgacacggatggtgtccgtgccccagacgacagcaggtgccatcctggacagggtgaacattggctgtggctgtggcctggtggaaggacaccacaggaggcagtttgagatcaccagtgtctccgtggatgtctggtacatcctggaatttgactatagcaggctccccaaacaaagcatcgggcagttccacgagggggatgcctatgtggtcaagtggaagttcatgaccccattgcaaaacactcacccggatgcttggcgctggggaaagggggagtccggtgaactccggagaaatcatccctttccttgccaaggaggagcctttcccacagcgctcctcaccccttcccatttaggagagcatgcaggtcacagggaccaagtaaagatttcagaccctgtctccaagacagttatccatgatgtaaagcaagtgcaggaacacccagcaggcgggtctcactgagcacacggccagtggggctgtgtgctgtgcagagccgggctgtggcccagaggtccccctgccccctcagggcacgatgctgggggctttaccctgcctctagctgagtgcctcctgggtttcctgagacttgttctgttgtgatgctaatttctcagatgaggaacaggaccttaagatcaaggaacctgcctgaagccacaagctagcagggagtggagcgggacactcacatccaggcctgcctcttttcaaacccaactgtgctgctaacccaccctgcatgcagggagtcagagtggggctccagcacaggatgtggagagccgtgagtttggctacaaggaggggccgaagatcccagtcaccagactgtggagcagatcccggaagttttaacttcgcgccccgcctgttcgtcctcagcagctcctctggggatttcgcagccacggagttcgtgtaccctgcccgagccccctctgtggtcagttccatgcccttcctgcaggaagatctatacagcgtgccccagccaggaaaaaaatctcaagaagccagtccccaagtcttaccttatccatgctggtctggagcccctaacattcaccaatatgtttcctagctgggagcacagagacgacactgctgagatcacagagatggtgagcacgctttcctgccatatgaaggtggctcctgtgccttttggattgtgggttgactttactttggggagagcatccaattgcactttccaagtgggaaaatatttattttgcaacatgataacatgtcatagaattcacttagtaagaagagaagtcgaatgggaaatcaattgaactattttagtaattttctacacagtatacccaaatttaaaaaacttaaaagcaaaggtgagttgaatcatgctgagggctgtatgtgtacataaaagctgcgaactcttcattctctttgctaagaacctgttgcttggcattgcttgtctctcagtgtccatgtgacgcacaaccaaaccctcatgtttcagac

SEQ ID NO: 459636 - DNA, 1059 bp, Homo sapiens
gtcagccctgactcccacctccacacccccatgtacttcttcctctccaacctgtccttgcctgacatggtttcacctccaccatggtccccaagatgattgtggacatccaatctcacagcagtcatctcctatgcgggctgcctgactcagatgtctctttttgccatttttggaggcatggaagaaagacatgctcctgagtgtgatggccctatgaccggtttgtagccatctgtcaccctctatattattcagccatcatgaacccatgtttctgtggctttctagttctgttgtcttgttgtctcagtcttttagactcccagctgcacaatttgattgccttgcaaattacctgcttcaaggatgtggaaattcctaatttcttctgtgacccttctcaactcccccaccatgcgtgttgtgacaccttcaccaataacatagtcatgtatttccctgctgccatatttggttttcttcccacctcggggatccttttctcttactataaaattgtttcctccattctgagggtttcatcatcaggtgggaactataaagccctctctgcctgtgggtctcacctgtcagttgtttgcttattttatggaacaggcgttggagggtacctcagttcagatgtgtcatcttcccccagaaagggtgcagtggcctcagtgatgtacacggtggtcacccccatgctgaaccccttcatctacagcctgagaaacagggatattaaaagtgtcctgcggcgcctgcacggcagaacagtctaatctcaatatcttattatctgttccattccttttgtagtgtgggtttaaaaaggcagcaaggtgtagatcccctgtgatattaggagtaacatttccaaaaaaatattacgaataatatcactgtttgtacaccacgtgtgacattaggagtaacagcccccaatactattatgaataacttcacagggtgtacacctctgtgacattaggagtaacatctttctaaattattatgaataatatcgcaaagtgtacaccccctgtgacattc

SEQ ID NO: 459637 - DNA, 4942 bp, Homo sapiens
tgaggtgaggttgcccagcaggcggggaccccagctcggagagggttctccgcgtccccagccgtcggcgcaggaagttgaggcggccaacatgccttcgtccccactcgactcccgggcccacgtgctggtccacgccggggacctgagagcatcgcgactagggggctgcgggacgcctcccgagcgtcgaggaaagacaggaccggggggagcaggcggggcccacgcggttgcatttctcgcccgccgccgcttcaagaagcagaacccggagccccacctgcaccctcactccggcccccgagcccggcctggccggcagtgctcggggaggccctgggtggcgctgtctcctcccctcctgcaaacgccaccgccagaaaatcgctcccaccccacccggccaggcgagccaccgacccggggctgcgtccgcctcggttcagcctcggttcagcctctccgggtgcggatcccggacccggccagcagacggaggctggcggagcgcagagtcccggcgactcccacctcccggagggggcacggggacttgcgtggggcgggcgggggccgggattccgggcggggcgaagggacccagctcggctgcggggcgcgcggtcgctctccctcaggactgcggctcggatccctccctacctctcccggtccctcgcaggactctacatcgccttcggcgtttcctctccctcccgcagtttccacccttcggcttgtcttactctcggctccttcgcccaccctttcctccccatcctgtcccccgcccccactcttctgcagtttgtaactgagagcgccccaaacaaccccatcaagccaataaacccaaaatgtgagcactgcccaaacccgtgtgcttatcctgccgcttctagaaggcaaattgatacggggtggatttggaacggctttctcagagaggcccgaaagctttcaaaaattctaagtcaggagacagctggctgttttcttagcacctctgcagcgctgaggatgtcttcatcctcctcagacacccccagcccggggatgttagcccattgcccagatggaagacagagcagggaggtaaccccagcggttacaaacttgattcttctcatgtggtggactccagtcttttgaatacgatctctacctcttgttttcccttcttatttaatttcttgatgttttcttggatggtttaagcgacaggaggaagagagggcaaaggcagcccccgtacctttcaatagagtgaaatggcctgaaattacagctacataactatcaaaaatgaaactgtgtttgtgaaaatctgtaaccctagctatgtaattggagacattcatgaaagaaggatattgcacaggtgaaagtgatttttcaattgctttcatatttttaatatttttccaaattgttgagaggacttttcctgaatacaaggatgaatgtttcggcttggaaagttcagtgtagccctagtcattggaaggctacagttatcataaattgcttttaaagtgtttattaaagtgattgaaatttgtttctttaaaaaaaaatagtctctgaacttgcaaacttcctaccttaccaaatagactttcctgagacttgaaaatggttcccatgaactttctcatggcaaaattacacagtaaacatgttcctggaactcttttttaaaaggagttggagcccaatcttcacaaccattcattttcctgccagattctttgcattgggcatttccttgtgtgcctgggaccttactgttgttgaagcagaagttctcatataggaaattttgcattactgaagaactctgctttagggcaaaggctgaaatgatacaggtttaggcatcccatgcctactgagtgagaggtcatcgcattaaatattttgagcatgctgacaaggtaaggaagatgcagaaactcctgaccagattcatgaaggctgaagacagaattctaagcagtcccttgttttgcatgaagcactgtgatattgaggaagaggaggcgttaagatcggaattgcccaaagtgtctacacaccttcatatttgttactaattatcaccccttttccacttctcgttgtgtttggccagccctgaatacctggagactgatccgagaactgtttgctttcgtttcttcccacatatttttattaacaacttgaactgatcctgcctaatccaaattcttatactttgatcttgttccttagcatccacattaaagagtttttctgtttccaccaaatttttacctcccccccttaactttttccctatgctagttctctctgcttattattctcccatttattctctcgacttgaggtttctgtgatggttacttacattagtgaccacattgccaaagcaccttcaaaagtaactgatgccctttattacgtactggagttgcgtttaaccagggaatcctcatcaagccacaaaggtgagggagaaaactgagataattacatacaggtaacagggcaaaaacactgttttgtctcatcattgagttttttccaaatgaatgtttttaaattagaaatatcagattaatgactgtaataaaaatataaattgcctctttccaatgtgtattcaggccaggatcctcttctgccagtgacaccatgaaacagaaaagttgtgtgtctggcccccaaatgcttagttcctgttactaacaatcgatatggcgttcttctttgtagggaaacctgaccttagaggaaatggaaaagttggagagacactgagcactgatacgaaataattctcttgctgaaatacacgaaaggagtcccagcagccatattagtatttccacgtcctgtgtcagccccaagtagagagaacttggaatgggaggggaaatggcagccatcaggaaatgaaatgctggcccagagaattctaagcaagtcaatcaccagtccaaaggaaaggccatgtgaggacataaggaggagacagccatctataagccaagaagaaagccctcactagaaaccaactctaatggcaccctgatcttggatttctagcccctggacaatgagaaaataaatgtctgttgtttaagcacctagtctgtgttggggctctcttctggatggggtgaggtttataaaataagtgacttctgagcaagcattcctacacactgaaataaaaatacttcatgattttgatacagggagttcttagagacttgcatggagtaggtgtcactacctgcttgttgaataaatggctccagcagcttttcatgcagtaagaaattttagaaaatgatgggtttaaagacgctttgaaacacaaatgtactcctgttagaaagatacacatttataagtcaggtttcctagaaaacctcaaattctttgtgacccagaaaatgttgtaataaaatcaacctttttttttttctcccagaatgcttcatctggagaatttcaaagagacaaccaaccacctgttgtcaatttccattcaccaccctaagtgttaatgtatctctggtttcctaaaggtgagagcagaacgtgttcattttcatctttgtttttgaaaaacagaaagaaaatttagaggtctgtacccaccttccagtgagatgcctcctttcaatttcaagagaatttggttattccataggaggcactgtgtagttcgctggttatgatcatggcttttggtgtcagatggtcctgggtttgaatctaggttgtctcacttcctagctcctgaccatggacaagttgcttagcctttctgagcctcagtttctcattcacaatatggatgtttcagttacctattgctgtataacaaacctacccaaagcttagtagcttaaaacaaaaccaccttatgttttctccagattctatttggacagggctcagcatgggtggttcatccgtgcctcacatggtattatcacgaaccctcataaggctgaattcagctggaaatggaacatcaaagatgatctcattcacatgaatggaagttggtgctgtcagccggggtgcttcagtttttatgtagcctcttttcctctcacagtctagactgccttccttacagcatagcagctcggttctatgagagagcaagaacaaaaactaccagacctctttaaagcctagccccagacagaacaagcacaacttccacttcattttattgattatagcatgtcacaaagctccacctaattcagcaaaagggaatagactctacctcttgatgggaagtatggcaaaagatttacagctatttttaattcaacacaatgggtatacataattcttcttttctcaaagtgctgttatgagaagtaaatgagataatgctagtcagtaagtccttaataagcacaagctgttcattactgttttacagtattgaataagtatgaagccaatcaagctttgccatggagtacctggaccaatcagttaccttggttgactcttagttccttcttggtatctctggttctatttaacacaatgcacccgggttctatggctccataagagatgctcaaataaagactctaatagcaaatatttattgacagtgttcactgtgtgtcgagcactgttttaagcacttttgttacataacaaccctacagtatcaaagctaaccttattctgcagatagactaatgaggcacagggaaggaaactgacctgctaaagccacatgcctaacaggtaagggacctggggtatggatctataaatcaggaatcctgactaactccaaaacccatgtttgtatgatttgttgaataagtgagcctatagaattaatggggttccttttaactctaaaattgtatgatgtttccaagtacaaaatgtatatgtaatc

SEQ ID NO: 459638 - DNA, 919 bp, Homo sapiens
atacaacctgaacaaagctttttcttgtgctctgaagggtcctgagacgtgagggggatgccttccatgaggatttttatctcagtgaatgtgcttcttgcatctgctgtatcacttggagagcctgttaatcatgcagattccttggccccaaatcagaatctctgggacggcatccgcaggtctaaatctgggtgggggtgtttggtcactatgggcttcacgaggtcaattcctgactactttgctgtgaatcgcacaacccacacagtgatgcagcttcacatacagcttgggaagcacataggcatcgaagatgcttatttcagaaatgtccctgactgttgcagcctccactatgtttcaaatgacgaatttcttaatggccttgtccttgggcacgcattgggcacagttcgtgcagcaaataagctgcatgtggccatggcccattttggcacgaccattgttccttcttttctttgtcgtcttggagggccagaaaagcaaattaaactggaatgttatggagaccactatccctgcctcctttccttttttaaaggtggcactaatttctgtaattctttccaagatgtggctttccttctgatataccatcatggctggaagagaagatatggtatgacaaagtcttctaggctcattcctgctccagacatgaaatcatccattttcccaaggagcccttcagagatcacgatctggcactagaggtcctcgttgctgttgggttggtcaatgtatgaagtcctgttccctggacagagctagaaatatgtttttgtttaatgaaaaagagaaatacctcatgaattagtactcatatttctaattcaaataaaatattacagtttttctttacctaccttctttgattttatatttgcacttcttt

SEQ ID NO: 459639 - DNA, 1610 bp, Homo sapiens
gcctcaatttcctcatctgcccatgcgtatcctcaaggttgtggcagcctcgagtgacaccctccttgtgccaaacagagaattcagcaaagagccagagctgatgcccaaaacaccttctcagaagaaccgacggaagaagagacggatttcttatgttcaggatgaaaacagagatcccatcaggagaagaaagtctcggagcagccagctgagctcccgacgcctccgcagcaaggacagtgtagagaagctggctacagtggtcggggagaacggctccgtcctgcggcgtgtgacccgtgctgcggctgcagctgccgcggctaccatggcattggctgcaccttcttcacccacccctgagtctcccacgatgctgactaagaagcccgaggataaccacacccagtgccagctggtgcctgtggtggagatcggcatcagtgagcgccagaatgctgagcagcatgtcacccagctcatgtccaccgagcctctgccccgcactctgtccccgactccagcttcagccacagctccaacctcccagggcatcccgacatcagatgaggaatcaacacctaagaagtcgaaggccaggatactggagtccatcacagtgagctccctgatggctacaccccaggaccccaagggtcaaggggtcgggacggggcggtctgcgtctaagctcaggattgcgcaggtctcccctggcccacgggactcgccagcctttccagattctccatggcgggagcgggtgctggctcccatcctgccggataacttctccacgcccacgggctctcgcacggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctcccggcgctgcagctgctcccaccacctccccaaacctggctgctatacccaggaagggtcctggcttcccttctctgtgcctggcctgctgtcttccctcttttcctgagaccctgtgcaccccaacctcccgctggccacctcccagcctgaactctgaccaagcccccatggctcaggatgcgccagctcagctaccttctctctgttccccaaaaaagcctctttttttcctgcctcatggccttggccctccttctccctagaccagtggcactgggaacaggcatgctcccagctaggaagaagccggggacataaagctagcagctgtggtgaggataccagggtgagtgctgagggtgagggacctgggcttcctgtttttaatgattaagcctcagcctcaaaaagcttttgacagcctggacaacatggccagaccctatctctaccaaaatggaaaaaattagccaggtatggtggcatgtgcctgtagtcccagctactcaggaggctgaggtgggaggattgcttgaacccaggaggtcgaggctgcactgagctgagattgtgccactgcactccagcctaggtgacagagtgagactctgttaaaa

SEQ ID NO: 459640 - DNA, 1030 bp, Homo sapiens
gagctggtgaaatggctggtctagcagggttctctcttgcttctggcttaatccagagcaggttcatctgttggggtaaattagaaggttttacttgaaaacgtatgtagagtttttaacaaggaggccaaaagggagagagcaactgaaaagaaagaaaaagtctgtggactccctgtatgtatgtatgtatgtatgtatgtatgtatgtatgtatgtatgatgtatttgagacaggttctggatctgtcgccctggctggactgcatgagctgagatcgtgtcattgtacttcagcctgggcgacaagagtgaaactccatttcaaaaataaaaaataaaataaaaataattaaaaaacaaatgatgggcgctagcttgcactcccgccctgcctgtgcgctgcccgagtgtggagctgctatgctgcgaaggctcgaggacccgcagacgccaggggatcagcgccgctgcgtgcactgcgcctacttccagtgcgtgcaaagggagagcaagccgcacatgcggaagatgctggtttactggatgctggaggtgtgtgaggagcagtgctgtgaggaggagcagtgctgtaaggaggaagtctttcccctggccatgaaccacctgcatgctacctgtcctacgtccccacccacccgaaaggcacagttgcagctcttggttgcggtctccatgcggctggcctccaagctgcgtaagactgggcccatgaccattgagaaaatgtgcatctacaccgaccacgctgtctctccctgccagttgcgggactgggaggtgatggtcctggggaagctcaaatgggacctggccgctgtgattgctcatgacttcttggccctcattctgcaccgaccgacaggccttggtcaaaaagcatgcccagatctttttggctgtctgcagaggaaactcaccctgtggccaccaccagaggcccacagggaacactgccagcctacggtcgatgttcacttagggcccaagggctcttaaatcacttgtg

SEQ ID NO: 459641 - DNA, 400 bp, Homo sapiens
tactactactactaaattcgcggccgcgtcgacgctccggaactcggggaagagcgtccgggagccgggtctgggttccgcactccgtccgccccgatggcagagagtgagatacggacgccccgggacgaggggctcaggacccggctacggacacctgcctccatctccctccagataacacaagtgtgaagagaggggagagcagcaaaggctgagctgcgtgtgcctggtcccttccagactttccagataactttgccccacggaggacaaggaaagccaaaagagagaagccaggattgttagtcttggaaaatgcctccatatagaaacatgagccggagaataaatcacttgcctctctaaccaaaaaaaaaaagtcgacgcggccgcgaat

SEQ ID NO: 459642 - DNA, 902 bp, Homo sapiens
ggtggttagtttgcgaaagtcgtccgccaggcccagaccgctggataggaggctcttggccgggccgggggctgggggccgggatggcagagggggccctagctgcgccccgccgcgctgggccctcgtctccgggtgctctcaaccctcatacaggcccttagccgttctcctagggaccctgcccggacaggaggaaaggtttccggcccatggagtttagtctcattacaaaagcaaaacaagaataagacttaccaagttgcttgccgttggggctgaggtccaaggaggtgatcgcagctttgtggcctttgaaataacgctccagaacggggtcctcctggaaaggaaagttgtcaagttttgaaagccgccgcagacctcgaattctggcggctgggatccacgctgccacttccccggagtccggcttgggaatggccacccaggcggcggcttggctgggcggcggggccgggcagcagcccacccacgggcgcggcgcccagtcctgctacagggagacgccggcgccagctctccccgcagagcccgcaaaacgctctgttcgcgcttcccagagtccagcgcatcgcaggaaccgcggcccctttgaaatgcacgttcccgggccccgcccgctggcccaaggcaggcaggtgcgaggatgcgcctcggctttggtactttttttttttttaatacttcctaggtgattctgacgcaggcgctccacggaaaccctccgagaattctgggggccgtggggccgcccagctcagtccggagctccggaactcggggaagagcgtccgggagccgggtctgggttccgcactccgtccgccccgatggcagagagtgagatacggacgccccgggacgaggggctcaggacc

SEQ ID NO: 459643 - DNA, 639 bp, Homo sapiens
tccggcttgggaatggccacccaggcggcggcttggctgggcggcggggccgggcagcagcccacccacgggcgcggcgcccagtcctgctacagggagacgccggcgccagctctccccgcagagcccgcaaaacgctctgttcgcgcttcccagagtccagcgcatcgcaggaaccgcggcccctttgaaatgcacgttcccgggccccgcccgctggcccaaggcaggcagaattctgggggccgtggggccgcccagctcagtccggagctccggaactcggggaagagcgtccgggagccgggtctgggttccgcactccgtccgccccgatggcagagagtgagatacggacgccccgggacgaggggctcaggacccggctacggacacctgcctccatctccctccagataacacaagtgtgaagagaggggagagcagcaaaggctgagctgcgtgtgcctggtcccttccagactttccagataactttgccccacggaggacaaggaaagccaaaagagagaagccaggattgttagtcttggaaaatgcctccatatagaaacatgagccggagaataaatcacttgcctctctaaccaaaaaaaaaaagtcgacgcggccgcgaat

SEQ ID NO: 459644 - DNA, 967 bp, Homo sapiens
ttgagtcccagtagagttgaatgatttgtctgagaaaagtgaagtaaccttcctacttctcacagttggtgactggcctagctgggtcttagtcttaggtctttgccctccaagaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggaaccagggatgaacctgaggggcctggacaccgcctgaaattgtgtttgattctagtccttaatcatttcccaaccagcctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcaggtatttgtttttgatagttttaa

SEQ ID NO: 459645 - DNA, 917 bp, Homo sapiens
ttgagtcccagtagagttgaatgatttgtctgagaaaagtgaagtaaccttcctacttctcacagttggtgactggcctagctgggtcttagtcttaggtctttgccctccaagaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcaggtatttgtttttgatagttttaa

SEQ ID NO: 459646 - DNA, 2773 bp, Homo sapiens
  misc_feature (1)..(6): n is a, c, g, or t
  misc_feature (10)..(10): n is a, c, g, or t
nnnnnnctgncagcagcttcattgtgtgcgcgaggagcgagcggcggcggagagcgggcgagcaagcggcatcccgagcgcggcggggagagcgagcgcgccggggagggtgcgaggcggcacccgcggctgcgctccgcccgcctcccggcaactctgcccagcgccgcgcgccgtgcgcgccgtcccgccgccgtcgccgccgccgccgccgccggtgccccggccggctgccgtcgcgggcaggggtctgcttaggacacgggtccccgcccggggactggggcatccccggcgcagctgagaggcgcagagcccggggggcgcagattgcgctccagcgcccagccgctgaacggcgtgggcaggtgggcggtggggttccagggcgccccgaggacagggggccccgacttcaggggaaccccaaccctgaggggcgtacatagtaatcacgccccagccgcaccggaccttgcgctcatcccttgcgtcccccacttctgcacaaacttttctgacgccctggctcgtgggggtcgtggagagcgctggggctaccaggtgggctcccaccccgccggaccctagccacgctgacctcctgcctctcctaacctcagtggcgacctctccaggccgggccgggctcggcactcggagcgagtgcggcaaccactgtcgctctccgaaggctcctgcgccccccggggcagctgggcggggtaatgccctcagtgatggagaagccgagcgcgggctctgggatcctgtcccgtagccgggccaagacggtgcccaacggcggacagccccactcggaggatgacagcagcgaggaggagcactcgcacgacagcatgatccgcgttggaaccaattaccaggccgtaattccggagtgcaagcctgagagccccgcacgctacagcaacaaggagctgaaggggatgctggtgtggtcacccaaccactgtgtgtcagatgccaagcttgacaagtacattgcgatggccaaggagaagcatggctacaacattgagcaggcgctgggcatgcttctgtggcataagcacgatgtggagaagtcgctggccgacctggccaacttcaccccattccctgacgagtggacagtagaggacaaggtgctgtttgaacaggcctttggcttccatggcaaatgcttccagcggatccagcagatgctgcctgacaagttgattcccagcctggtgaaatactactactcttggaagaagacccgcagccgaactagtgtgatggacagacaggcccggcggctggggggccgcaaggacaaagaagacagtgatgagctcgaagagggtcgaggaggcgtgagtgagggagagcccgatcctgcagatcccaagagagagcctctaccctctcggcccctgaatgcacgcccaggccctgggaaaaaggaggtccaggtgtctcagtaccgccaccatcccttgcgaacccggcgtcgcccacccaagggcatgtacctgagccctgagggcctcacggcagtgtcaggaagcccggaccttgccaacctcacgctccgaggtcttgactctcagctcatctccctcaagcgccaggtacagagcatgaagcagacgaacagcagcctgcgccaagccctggagggcggtattgatccactacgccccccggaggccaacaccaagttcaactcccgctggaccacagatgagcagcttttggctgttcaaggtccagattacatcggtctccacgtccgtgccccgatcagtgccccctgcgccaccaccccctccacctcccacctcgctgtcccagccacccccgctgctgaggccacctttgcccacggctcccactctgctccgacagccacccccactgcagcagggccgcttcctccagccccggctggcccccaaccagcccccaccgcctctcatccgccccgctctggctgccccccgccacagcgcccgccctggccctcagcccccacccaccctgattggaacccctctggagcccccagcaccctcactctgagccctgacgtcctccaccaaccacgggctccaggacccctttgctggccatccccaggcatctctggtgtcactgaggacagaagggactagggctctggcggggtctttgtaagaccagagtttcggacagcccagccccgccctttgggttctgcatgtgttcctggcagctgggcctgtctcctggggccatggccgggctcaggggcctttgagctggcctgagggcactttcgcttcctggccggtactggaatggctgtgtcctagtctgctggggcttggcctctgggtcctgccctttgtgtgtccggggtagtgaccttagcgtggagtggggagagggcagttgggtgtgctggctgttctcattcctctttcccttcttttagcaataagtctggggtgaggtggggagggaggctgcagggggggaggtgggcagaggggccttacagcagcagaggctggaagagaagctctgtcttcaggggccagctgggaaatgctaaggagctgagggtgcccaccaagcccaccttccagaaacttggagaaatgggggttgggaacttatgcagacatggatttatttttcaacattttttaaaaattaaaaaaaataaaatctaagcttactgagttttctttcccttttggtgcaagggccctgggctttgcttcctgtctgtgccctgtgg

SEQ ID NO: 459647 - DNA, 1975 bp, Homo sapiens
gtccagggcgtgcattcaggggccgagagggtagaggctgccagtgaaaggagaggccctgggaaaaaggaggtccaggtgtctcagtaccgccaccatcccttgcgaacccggcgtcgcccacccaagggcatgtacctgagccctgagggcctcacggcagtgtcaggaagcccggaccttgccaacctcacgctccgaggtcttgactctcagctcatctccctcaagcgccaggtacagagcatgaagcagacgaacagcagcctgcgccaagccctggagggcggtattgatccactacgccccccggaggccaacaccaagttcaactcccgctggaccacagatgagcagcttttggctgttcaagccatccgtaggtatggcaaagactttggggctattgcagaggtgattgggaacaagactctgacccaggtgaagactttctttgtgagctaccggcgccgcttcaatctggaggaggtgctgcaggaatgggaggctgagcaggatggggcccctggagccccagtccccatggaggaggctaggagaggggctccattgccagccccagccctagaggaagatgatgaggtccagattacatcggtctccacgtccgtgccccgatcagtgccccctgcgccaccaccccctccacctcccacctcgctgtcccagccacccccgctgctgaggccacctttgcccacggctcccactctgctccgacagccacccccactgcagcagggccgcttcctccagccccggctggcccccaaccagcccccaccgcctctcatccgccccgctctggctgccccccgccacagcgcccgccctggccctcagcccccacccaccctgattggaacccctctggagcccccagcaccctcactctgagccctgacgtcctccaccaaccacgggctccaggacccctttgctggccatccccaggcatctctggtgtcactgaggacagaagggactagggctctggcggggtctttgtaagaccagagtttcggacagcccagccccgccctttgggttctgcatgtgttcctggcagctgggcctgtctcctggggccatggccgggctcaggggcctttgagctggcctgagggcactttcgcttcctggccggtactggaatggctgtgtcctagtctgctggggcttggcctctgggtcctgccctttgtgtgtccggggtagtgaccttagcgtggagtggggagagggcagttgggtgtgctggctgttctcattcctctttcccttcttttagcaataagtctggggtgaggtggggagggaggctgcagggggggaggtgggcagaggggccttacagcagcagaggctggaagagaagctctgtcttcaggggccagctgggaaatgctaaggagctgagggtgcccaccaagcccaccttccagaaacttggagaaatgggggttgggaacttatgcagacatggatttatttttcaacattttttaaaaattaaaaaaaataaaatctaaaaaaaaaaaaaaaaaaaaaaaaaaaaaaaaaaaaagagggggggggggcaaaaaatatccccggagggggccccaatttacgcggttacccagtttttttgttaaaaaggggcccccataaaggggggggaataaaaaaaagccaggcacgggggccccgtggtttaaccaacggttctgccggtggaacaacccgtgttagctggggagctgcttctgagagggaccctctattcctcggcgcgggcggcccctatcttgcggcaacaaccctcttataagaaaatttagaagacctaagggcaaattattcacacttctgacgctggcttcccctggtgtctacccacacgctgataatggctgcgcgctagaaaacatcgggctaaccagagcacgacttttttgaaccactttatcag

SEQ ID NO: 459648 - DNA, 3148 bp, Homo sapiens
  misc_feature (1)..(6): n is a, c, g, or t
  misc_feature (10)..(10): n is a, c, g, or t
nnnnnnctgncagcagcttcattgtgtgcgcgaggagcgagcggcggcggagagcgggcgagcaagcggcatcccgagcgcggcggggagagcgagcgcgccggggagggtgcgaggcggcacccgcggctgcgctccgcccgcctcccggcaactctgcccagcgccgcgcgccgtgcgcgccgtcccgccgccgtcgccgccgccgccgccgccggtgccccggccggctgccgtcgcgggcaggggtctgcttaggacacgggtccccgcccggggactggggcatccccggcgcagctgagaggcgcagagcccggggggcgcagattgcgctccagcgcccagccgctgaacggcgtgggcaggtgggcggtggggttccagggcgccccgaggacagggggccccgacttcaggggaaccccaaccctgaggggcgtacatagtaatcacgccccagccgcaccggaccttgcgctcatcccttgcgtcccccacttctgcacaaacttttctgacgccctggctcgtgggggtcgtggagagcgctggggctaccaggtgggctcccaccccgccggaccctagccacgctgacctcctgcctctcctaacctcagtggcgacctctccaggccgggccgggctcggcactcggagcgagtgcggcaaccactgtcgctctccgaaggctcctgcgccccccggggcagctgggcggggtaatgccctcagtgatggagaagccgagcgcgggctctgggatcctgtcccgtagccgggccaagacggtgcccaacggcggacagccccactcggaggatgacagcagcgaggaggagcactcgcacgtgcctccccctggctccacagacagcatgatccgcgttggaaccaattaccaggccgtaattccggagtgcaagcctgagagccccgcacgctacagcaacaaggagctgaaggggatgctggtgtggtcacccaaccactgtgtgtcagatgccaagcttgacaagtacattgcgatggccaaggagaagcatggctacaacattgagcaggcgctgggcatgcttctgtggcataagcacgatgtggagaagtcgctggccgacctggccaacttcaccccattccctgacgagtggacagtagaggacaaggtgctgtttgaacaggcctttggcttccatggcaaatgcttccagcggatccagcagatgctgcctgacaagttgattcccagcctggtgaaatactactactcttggaagaagacccgcagccgaactagtgtgatggacagacaggcccggcggctggggggccgcaaggacaaagaagacagtgatgagctcgaagagggtcgaggaggcgtgagtgagggagagcccgatcctgcagatcccaagagagagcctctaccctctcggcccctgaatgcacgcccaggccctgggaaaaaggaggtccaggtgtctcagtaccgccaccatcccttgcgaacccggcgtcgcccacccaagggcatgtacctgagccctgagggcctcacggcagtgtcaggaagcccggaccttgccaacctcacgctccgaggtcttgactctcagctcatctccctcaagcgccaggtacagagcatgaagcagacgaacagcagcctgcgccaagccctggagggcggtattgatccactacgccccccggaggccaacaccaagttcaactcccgctggaccacagatgagcagcttttggctgttcaaggtccagattacatcggtctccacgtccgtgccccgatcagtgccccctgcgccaccaccccctccacctcccacctcgctgtcccagccacccccgctgctgaggccacctttgcccacggctcccactctgctccgacagccacccccactgcagcagggccgcttcctccagccccggctggcccccaaccagcccccaccgcctctcatccgccccgctctggctgccccccgccacagcgcccgccctggccctcagcccccacccaccctgattggaacccctctggagcccccagcaccctcactctgagccctgacgtcctccaccaaccacgggctccaggacccctttgctggccatccccaggcatctctggtgtcactgaggacagaagggactagggctctggcggggtctttgtaagaccagagtttcggacagcccagccccgccctttgggttctgcatgtgttcctggcagctgggcctgtctcctggggccatggccgggctcaggggcctttgagctggcctgagggcactttcgcttcctggccggtactggaatggctgtgtcctagtctgctggggcttggcctctgggtcctgccctttgtgtgtccggggtagtgaccttagcgtggagtggggagagggcagttgggtgtgctggctgttctcattcctctttcccttcttttagcaataagtctggggtgaggtggggagggaggctgcagggggggaggtgggcagaggggccttacagcagcagaggctggaagagaagctctgtcttcaggggccagctgggaaatgctaaggagctgagggtgcccaccaagcccaccttccagaaacttggagaaatgggggttgggaacttatgcagacatggatttatttttcaacattttttaaaaattaaaaaaaataaaatctaaaaaaaaaaaaaaaaaaaaaaaaaaaaaaaaaaaaagagggggggggggcaaaaaatatccccggagggggccccaatttacgcggttacccagtttttttgttaaaaaggggcccccataaaggggggggaataaaaaaaagccaggcacgggggccccgtggtttaaccaacggttctgccggtggaacaacccgtgttagctggggagctgcttctgagagggaccctctattcctcggcgcgggcggcccctatcttgcggcaacaaccctcttataagaaaatttagaagacctaagggcaaattattcacacttctgacgctggcttcccctggtgtctacccacacgctgataatggctgcgcgctagaaaacatcgggctaaccagagcacgacttttttgaaccactttatcag

SEQ ID NO: 459649 - DNA, 1608 bp, Homo sapiens
  misc_feature (1)..(6): n is a, c, g, or t
  misc_feature (10)..(10): n is a, c, g, or t
nnnnnnctgncagcagcttcattgtgtgcgcgaggagcgagcggcggcggagagcgggcgagcaagcggcatcccgagcgcggcggggagagcgagcgcgccggggagggtgcgaggcggcacccgcggctgcgctccgcccgcctcccggcaactctgcccagcgccgcgcgccgtgcgcgccgtcccgccgccgtcgccgccgccgccgccgccggtgccccggccggctgccgtcgcgggcaggggtctgcttaggacacgggtccccgcccggggactggggcatccccggcgcagctgagaggcgcagagcccggggggcgcagattgcgctccagcgcccagccgctgaacggcgtgggcaggtgggcggtggggttccagggcgccccgaggacagggggccccgacttcaggggaaccccaaccctgaggggcgtacatagtaatcacgccccagccgcaccggaccttgcgctcatcccttgcgtcccccacttctgcacaaacttttctgacgccctggctcgtgggggtcgtggagagcgctggggctaccaggtgggctcccaccccgccggaccctagccacgctgacctcctgcctctcctaacctcagtggcgacctctccaggccgggccgggctcggcactcggagcgagtgcggcaaccactgtcgctctccgaaggctcctgcgccccccggggcagctgggcggggtaatgccctcagtgatggagaagccgagcgcgggctctgggatcctgtcccgtagccgggccaagacggtgcccaacggcggacagccccactcggaggatgacagcagcgaggaggagcactcgcacgacagcatgatccgcgttggaaccaattaccaggccgtaattccggagtgcaagcctgagagccccgcacgctacagcaacaaggagctgaaggggatgctggtgtggtcacccaaccactgtgtgtcagatgccaagcttgacaagtacattgcgatggccaaggagaagcatggctacaacattgagcaggcgctgggcatgcttctgtggcataagcacgatgtggagaagtcgctggccgacctggccaacttcaccccattccctgacgagtggacagtagaggacaaggtgctgtttgaacaggcctttggcttccatggcaaatgcttccagcggatccagcagatgctgcctgacaagttgattcccagcctggtgaaatactactactcttggaagaagacccgcagccgaactagtgtgatggacagacaggcccggcggctggggggccgcaaggacaaagaagacagtgatgagctcgaagagggtcgaggaggcgtgagtgagggagagcccgatcctgcagatcccaagagagagcctctaccctctcggcccctgaatgcacgcccagcaagcccaccttccagaaacttggagaaatgggggttgggaacttatgcagacatggatttatttttcaacattttttaaaaattaaaaaaaataaaatctaagcttactgagttttctttcccttttggtgcaagggccctgggctttgcttcctgtctgtgccctgtgg

SEQ ID NO: 459650 - DNA, 86 bp, Homo sapiens
gaagagcctggcttctcactctttcctctcccctcaggtccagattacatcggtctccacgtccgtgccccgatcagtgccccctg

SEQ ID NO: 459651 - DNA, 178 bp, Homo sapiens
tggtccctttctggacaggcctgggttaggagctataacccccttcaccaagaccctgcccctgctgcccctgcagttgacaagtacattgcgatggccaaggagaagcatggctacaacattgagcaggtgagccttggcccccagggacttgggaatggggtggaacggtgccggg

SEQ ID NO: 459652 - DNA, 1309 bp, Homo sapiens
aagttaaagggaggaaaataggatcaaaagagctgggtacaccatgagggggagaagaaaagcctcctgtttttgtagagactgggaacttagcaagggggcagagttcaataagcctgtgggagaaccctcgacttgtacccacatcctaaacattactggagttcctagaggagtacctgatgaatttaagacccgaaaccaaatagctgttgggtttgaatcagcactcttctggtggtcaactactaataaaaacgtggattggattaattacatctattataatcaacaaagattcatcagctatactcgatacactctcaagggagtggctaaccagttagatgccaccagccaaatggcctgggagaacagacttgcactgcataagatcttagcagagaaagggggcgtatgcatcatgctggatggaaagtgttgcactttaattcctaacaatactgccccagatggaaccatcacaaatgcattacaagggttaattgttctagtcaatgaattggtggaaaatgttggaattgatgacccatttactgattggctagaaaacaaatgcatcctcatcctcatcctcatcattatcatcggcaccaaaactggtattgactgggcactcactacatgcagagagtatgccatgtcctcagcgtggagtcctgataagatagtagtaatgtcctctgatgatatctgattaaactacttgacatggtcagtatccatctattttgacttatgaagatggcaatttcacattggtcagcctaaactttggtgtaagttttgtttcttggagttaataactgattttttttttgtatgtgtttctctgaggctgaaagattttatatcttttaaagaccttttcttagttcctgggagcctgttctaatatgacagttggaagcctggaaaaagtttccaggcagactgtggaggaaggcctagagaactgagcgtgccagttggatctgctctccccagcctgattctcggcaggatctggaggagactcgtgtaccaagacaccaaggagtcgctcatttagaagcacttgacttgggtgggcatccctatgagctggaggggcccaggctgcagaggctctcatgggagttctgtggctggaagtgggttgttggagcaactcgaacccgaagttgagttcattcattatcccaggaaagggccatcagttaaaagggaactcatactttcaagaccagcctgctttcaaggtgtcaactgatcgtgtagacaatgtctcaaaaaacaaaaaaaaaat

SEQ ID NO: 459653 - DNA, 1161 bp, Homo sapiens
aagttaaagggaggaaaataggatcaaaagagctgggtacaccatgagggggagaagaaaagcctcctgtttttgtagagactgggaacttagcaagggggcagagttcaataagcctgtgggagaaccctcgacttgtacccacatcctaaacattactggagttcctagaggagtacctgatgaatttaagacccgaaaccaaatagctgttgggtttgaatcagcactcttctggtggtcaactactaataaaaacgtggattggattaattacatctattataatcaacaaagattcatcagctatactcgatacactctcaagggagtggctaaccagttagatgccaccagccaaatggcctgggagaacagacttgcactgcataagatcttagcagagaaagggggcgtatgcatcatgctggatggaaagtgttgcactttaattcctaacaatactgccccagatggaaccatcacaaatgcattacaagggttaattgttctagtcaatgaattggtggaaaatgttggaattgatgacccatttactgattggctagaaaacaaatgcatcctcatcctcatcctcatcattatcatcggcaccaaaactggtattgactgggcactcactacatgcagagagtatgccatgtcctcagcgtggagtcctgataagatagtagtaatgtcctctgatgatatctgattaaactacttgacatggtcagtatccatctattttgacttatgaagatggcaatttcacattggtcagcctaaactttggtgtaagttttgtttcttggagttaataactgattttttttttgtatgtgtttctctgaggctgaaagattttatatcttttaaagaccttttcttagttcctgggagcctgttctaatatgacagttggaagcctggaaaaagtttccaggcagactgtggaggaaggcctagagaactgagcgtgccagttggatctgctctccccagcctgattctcggcaggatctggaggagactcgtgtaccaagacaccaaggagtgagtttttgggagcgccagcactgcagagaagctcagagcgggtggggggaggctgttccctagagaggagatgctgttacagaactggagcctctaaca

SEQ ID NO: 459654 - DNA, 774 bp, Homo sapiens
ttccagaggggcagctccagtacaggcagcggcaccacccggggcttccagcgggtccatgtggagaacccgtgagcagctacaagccgaagtgcagagggcacaggcgcggatagaggacctggagaaggccctggcggagcaggggcaggatatgaagtggattgaagagaagcaggcactgtaccggagaaatcaagagcttgtggaaaaggtgatgtggcatgaggcaggggcggggctggctacgggtccaggggcaggaaggccagcagggctgtcattaccacgcacagctcagagccccgctaaggcccccgtgctcctggcttgtgatgtacagcccctgctggagacgtttatccttgacggcctcccttccacatccctgtccaggggccacccaagctcagggccccgatatgatcgccaggctcctggcttgtggacaaacccaaacataccgagggctgtgaggcgcttccagggctgggtaccaggccagccggcctccccggcagccagcagctgtcccatcaaacaaatggagacggaagaggctcggctcagacatgaggtgcaggacgccagagaccaaaacgagctgctggagttcaggatcctggagcttgaggagagggagaggaagtcacccgccatcagcttccaccacacgcccttcgtggacgggaagagccccctccaggtgtactgcgaggcctaaggtgtgacggtgagttccgccccttctgcccactgctgttcggcgtgtgg

SEQ ID NO: 459655 - DNA, 462 bp, Homo sapiens
ttccagaggggcagctccagtacaggcagcggcaccacccggggcttccagcgggtccatgtggagaacccgtgagcagctacaagccgaagtgcagagggcacaggcgcggatagaggacctggagaaggccctggcggagcaggggcaggatatgaagtggattgaagagaagcaggcactgtaccggagaaatcaagagcttgtggaaaagatcaaacaaatggagacggaagaggctcagctctggcctgctccccagctcgtctccagcggctctggcgtgctccccagctcgtctccagcggctctggcctgctggtttctcatgaatgcaccagcggattccacctcaggactccgcacgtttccctccacagggacttccccagatgtgcccgtggctccttcttggcatctggtcttagttcccgtcttgcactctccgagtggaccgactgg

SEQ ID NO: 459656 - DNA, 662 bp, Homo sapiens
tccaaggtcaatgtgccagcagattccatgagggcccaccctctgcatcacatgtggccccttcttgcatcatcttcgcttgttggaaggggtgaacaagctcccttgggcctcctttatgagggcactaatcccaatcatgacagtggggccctcatgacctcgtcagctcccaaaggccccacctcttactatccccaaggccctgagaggaggccaggaggacaagggatattgggggtgattcctgtgaaagataaaaggtggaggaagcagaactgggaagaaaagccttcagcccctgacatgaatctgacggcagctatcacagcgagacttgacctttgtacatcaaaggaggcttctttacaccccgcacagcttggaaggagtcagtgagcagaactaggcccagccgctgcctttggtttgtcttcctctgaaggaaaaatacgccagcaaagacaacgttctataaccccgtttgagtgtctcattacaattacataatgataattgccagctttgtgttccatttggcaacttgttgaagtaattgaacaaagtataactaacgaacacttataatgaagttcataattaggtccttgaaacacttgatataaaaaaaattttcagattctttttttaaaaaagctgta

SEQ ID NO: 459657 - DNA, 776 bp, Homo sapiens
cgaggcctctgattggaggccccatgggatccacctccaggccgaacactcagacaaaatcactctggcaacttgtgaatgccttctgctcatgtaggatggctgttttgccccctgtgctttctttactgagctgtttaataaacagcagggtagctgggaatttcttggaaggagcctggcagggagagggcaccgtggtgccgactttccaggctgactcgccgttgcatttgcaaacctggggctccccagccatccccacagagctgctgaataggttgctaagggcttggcaatgttctgcacagccactgctgatactaaagaggccgcaacaggctggatcccagaagaaaggaactgctaacaggttgagtcaccatgaatgcgggactccttcctttaataatctcagacaattctttctgggcttaaacgccccacagtcctgtgacaatgtcccagagattcaaaggagcagtatgacaaaatcatgtagaaggatttgttgtgatatcatccagttaaaccccaggaaacagtgatgcaacagctcttgggaaagatcctgcggtgttatcagttctttctttcaaattctcttcaagcttgtacatctagagtatctcctgctaaatggcaaataagcattgtttcataatgcttataaggcattcacaaaataaaatacggacattttttgactctttttcttgtccatataatgtggattagtctccatgacaacaccaactgtcgcatcacattatcac

SEQ ID NO: 459658 - DNA, 1524 bp, Homo sapiens
tatttaaaaaaaattagagagttgtggaaacaaggagaagataaaatttccagagtggaaacagccctccctagaactctaggctctgcagtgtgagaattcttggtccccaagggggacacgctcacctggaaacccagcaaggggcacattgaatacaccttatgactgctccctgggcactttgggatcctcgtgtccaggaaccagcagccacaacctgaaaaggatatggttaccaagggctcagaatccgcacccccctcccaccgggatgaggattagggtcatgccatcagctcctcttgccctgcatgcttcagggacgatggaggtctcggggcacccccaggccaggagatgctgcccagaggccctgggaaagctcttccctggcctctgcttcctctgctttctggtgacctacgccctggtgggtgctgtggtcttctctgccattgaggacggccaggtcctggtggcagcagatgatggagagtttgagaagttcttggaggagctctgcagaatcttgaactgcagtgaaacagtggtggaagacagaaaacaggatctccaggggcatctgcagaaggtgaagcctcagtggtttaacaggaccacacactggtccttcctgagctcgctctttttctgctgcacggtgttcagcaccgtgggctatggctacatctaccccgtcaccaggcttggcaagtacttgtgcatgctctatgctctctttggtatccccctgatgttcctcgttctcacggacacaggcgacatcctggcaaccatcttatctacatcttataatcggttccgaaaattccctttctttacccgccccctcctctccaagtggtgccccaaatctctcttcaagaaaaaaccggaccccaagcccgcagatgaagctgtccctcagatcatcatcagtgctgaagagcttccaggccccaaacttggcacatgtccttcacgcccaagctgcagcatggagctgtttgagagatctcatgcgctagagaaacagaacacactgcaactgcccccacaagccatggagaggagtaactcgtgtcccgaactggtgttgggaagactctcatactccatcatcagcaacctggatgaagttggacagcaggtggagaggttggacatccccctccccatcattgcccttattgtttttgcctacatttcctgtgcagctgccatcctccccttctgggagacacagttggatttcgagaatgccttctatttctgctttgtcacactcaccaccattgggtttggggatactgttttagaacaccctaacttcttcctgttcttctccatttatatcatcgttggaatggagattgtgttcattgctttcaacaaccttatggatgtccctgcttttcttgaaatatgagaaacaaaacacctttattcttggaagttgtacttttagttaaattaaaatcttcctgagctgttctttgttacctgaaaaagaactagtgc

SEQ ID NO: 459659 - DNA, 1207 bp, Homo sapiens
ggccaaagcatgagaaaactcatcgcgggactcattttccttaaaatttgggcttgtacagtaagaacttcaactgaccttcctcagactgagggctgttcccagtgtatacatcaagtcactgaggaaatagcagctggtgcagtggaatgccatgcatttgtggtgccggagcagcaaagtctccaggcccctgctgcagatcctctgatttctgctgtccaggctctgcattctctttccctgaagggcattagcttcagtatagaagagggagaattgctgtgttcctgtgaccctggggaaaaaggaattcctagattcaccttcaggacaaagattgacccggtagaaaataaaactgaggaaagaagaagatacgcacaacagaggggaagacattggctgagcctcacaaacattgcagatatccctatgtgactcagaatcaacacaagatcctgcctttaaacactgatgccgaaaatcaagaacatcctttaaactgaaaccatcagaacaaacatgtttaaacaacacaaatgttattattaatgtaaagcatttctaaaatgcttttttaaatgtgaaaaagcaacgaaagttttagttctgacaccaccagacaaatagctaggaaacagacacttctgtcttcacaacagtaaaaataaaacaaactgaaaatcagtaagttttgcgggcctatcagaaaactaagattgcaggaagagctgtcacacccaaatatgaagaaatagaagacttcagagagacaaaaccaagttctgcttatcagaagtagaagacactggagacatataaactcataagaacacttagaacacttacatggcaatgttaacaaattgctgtaatctgagtatggactatcttgagagtgataatcccttaagagcttcagtattagaggggcctgccacattcacggcctttatctacagttatctcaccagatactcacagtgaagatgcccttgtagctctggctggggcggaggaagagcaatccttgtgaattacctccagagtatgctctgtaaaacaggtttatttttccaggagaaaagacactaacagcgtcttctaatgtccatgaggtgatgaatgatgacccttatttcatttctcttttattcttggttagcctggttagatgtttataaaatttcttaaatttttcaaa

SEQ ID NO: 459660 - DNA, 1270 bp, Homo sapiens
ggccaaagcatgagaaaactcatcgcgggactcattttccttaaaatttgggcttgtacagtaagaacttcaactgaccttcctcagactgagggctgttcccagtgtatacatcaagtcactgaggaaatagcagctggtgcagtggaatgccatgcatttgtggtgccggagcagcaaagtctccaggcccctgctgcagatcctctgatttctgctgtccaggctctgcattctctttccctgaagggcattagcttcagtatagaagagggagaattgctgtgttcctgtgaccctggggaaaaaggaattcctagattcaccttcaggacaaagattgacccggtagaaaataaaactgaggaaagaagaagatacgcacaacagaggggaagacattggctgagcctcacaaacattgcagatatccctatgtgactcagaatcaacacaagatcctgcctttaaacactgatgccgaaaatcaagaacatcctttaaactgaaaccatcagaacaaacatgtttaaacaacacaaatgttattattaatgtaaagcatttctaaaatgcttttttaaatgtgaaaaagcaacgaaagttttagttctgacaccaccagacaaatagctaggaaacagacacttctgtcttcacaacagtaaaaataaaacaaactgaaaatcagtaagttttgcgggcctatcagaaaactaagattgcaggaagagctgtcacacccaaatatgaagaaatagaagacttcagagagacaaaaccaagttctgcttatcagaagtagaagacactggagacatataaactcataagaacacttagaacacttacatggcaatgttaacaaattgctgtaatctgagtatggactatcttgagagtgataatcccttaagagcttcagtattagaggggcctgccacattcacggcctttatctacagttatctcaccagatactcacagtgaagatgcccttgtagctctggctggggcggaggaagagcaatccttgtgaattacctccagagtatgctctgtaaaacaggtttatttttccaggagaaaagacactaacagcgtcttctaatgtccatgaggtaaaagaactgatggctggagagcattgaaacagacagatgaaaattaaagaagaaataaaaataaaattaaaaagggaaaaacaagtttagaaaaaagaatttttttcttattttcctttttcctttgataagagccaacttatgag

SEQ ID NO: 459661 - DNA, 2808 bp, Homo sapiens
gaccacagggcccctttgcagtgtgcctcatcggtctgtttcttggccaggctgactgagagatttgtgctgggagtggatatgttcgtggagacactgtggaaagtctggaccgagctcttggatgttcttggacttgacgtctccaacctgtcccagtatttcagcccagcctcggtgtccagcagcccggcccgcgcgctcctgctggtcggcgtcgtcctcctggcctactggttcttgtccctgaccctgggcttcactttcagcgtcctgcacgtggtgttcggccgcttcttctggatcgtgcgggtcgtcctgttttccatgtcctgcgtgtacatcctgcacaagtacgagggcgagccggagaacgcggtgctgccgctgtgcttcgtggtggccgtctacttcatgaccgggcccatgggcttctactggcgaagcagtcccagcggccccagcaaccccagcaaccccagcgtggaggagaagctggagcacctggagaagcaggtcagactgctcaacatccgtctcaaccgggtgctcgagagcctggaccgctccaaggacaagtgaaggtcagccggccgggcgggtccacagttaccagcacgctgtctcagaaaacgaaaacggaggaaaaaaaccccaaaccccaaacaatcttaataaacacgactgagcaagaaagtggcgctgtgtagggctatttccacccacccggcagctcttaggacacattcccagaagagcggaaagatcattgacgtggaactacacacgaagtgtaattagtgggggaaaaaatattttttaaacaaaggatataaccatatttagttgtacagtaagagaaatttatctgtgcatagagcataaagttaattttttcaagcatttaaatacatcttttgtaaggttttttaataaaggcagattgagtcaagtttattaaaactttacatggaggggaagaatatgctaatttgacatttgagaaaagtttaaatgcgagcgtttgttttcacagcttagggattggtgggtgaggtctgtgtgcgttattttcatgttcccaaactgtgagctttatttcatgttatttttggtggatgttgacttagttcatgaatgttgtcacttctaaatgtggacagttgggctgcaggatgcaactcaacctcttttggatcctagagacccctgccaagcccccatcagtcctatttttaaatgaagacatcgccatttctagaagacctgagattttcttccctctgtgcttcgatgtattttaacctcaacattttgaaacggaaaatgcaaggaggggccaagaaatgtcctggggatttgatgccaggaagtacctggtaaggattggagattgctccagaatctactgcatgtcccaatttgcagtttgctcactagggctatatacaaaagctatacccttgagggttttttttttttcttttgatttcctcaggaccttagagggaaaacaaacagtagcagctaatattctcaagtatattgctgcttagaaagatcctcaggaacaattagcagcaataagcaagcctttgaaaagatctgaattctttttcctgaaatatttacgatacacaggtgctttttatctgaaatctgttgtgtcctccttttaggcagtctctgtgggcagagagtgggacttgcgaggtggacagctgtggggatcctgggcaagggagtttcagaaggtgtggctcaggggctggtagaaacccccttttgttaggacttgttttttaaaaaagaaagccctaggccaggcgcagtggctgatgcctgtaatcccagcgctttgggaggccgaggagtatggatcacctgaggtcaggagttcaagaccagcctggccaacatggtgaaacccccgtctctactaaaaatacaaaaattagtcaggcatggtggtgggtgcctgtagtccagctactcaggaggctgaggcaggagaattgcttgaacctgggaggtggaggttgcggtgagccgagatcacgccactgcactccagcctaggcaacagagcaagacttcatcttaaaaaaaaaaaaaaaagcccagcattttgcagctttgaagctgctggggatcacgactgtctctgtggcccttacctggccacagatgtaccctggcaacccgctcacagtgccctgcgtgcaggtttatagataacccctgccagacctgctacaaccaagaccttatggtccaggtctcagtttggagaagatttagctgtctaccacttcttgtgtagtgttcctgtgaagttttatttttggttgcaagtatctggaaaacagatgcagatgtttttgtggatgttgttgagacttttgagacttctgtttctaaggtacacatgatgggacccaaactctcctggagagttccattcacttcctgaaacgtgcacctgtttcaggtgcatgtttattcagtgtgcatggatatttaagatttgctggagcaggctgggcggggtggctcacccctgtggtcccgacactttgggaggccaaggcgggtggatcacctgaggtcagggagtttgagaccagcccggccaacagagtgaaaccccgtctctactaaaaatacaaaaattggacgacgcccaccatcatgccccggctggtgcgtcggtataacacagtagagacggggtttcaccatgttagccgggatggtctcgatctcctgacctcgtgatccgcctgcctcggcctcccaaagtgctgg

SEQ ID NO: 459662 - DNA, 3110 bp, Homo sapiens
cggcggctgtgggtaaggcgcggcgcgcggccccgagcgcgccaaccttgccctagccggagcccgctgcggcccagcgcacggccctcaccccgcatcgcgaccccgcgccccgccggccgagcatggtgcgcgctgcgcctcaggcgggcccctggcccgggccgggctcctgctgctgctgctgctgctgctgctgctcggtgctgctggccccgggcgcgcagggggcgcggggccgcggcggcgcggagaagaacagctaccgccgcacggtcaacaccttctcccagagcgtcagcagcctgttcggcgaggacaacgtgcgcgccgctcagaagttcttggccaggctgactgagagatttgtgctgggagtggatatgttcgtggagacactgtggaaagtctggaccgagctcttggatgttcttggacttgacgtctccaacctgtcccagtatttcagcccagcctcggtgtccagcagcccggcccgcgcgctcctgctggtcggcgtcgtcctcctggcctactggttcttgtccctgaccctgggcttcactttcagcgtcctgcacgtggtgttcggccgcttcttctggatcgtgcgggtcgtcctgttttccatgtcctgcgtgtacatcctgcacaagtacgagggcgagccggagaacgcggtgctgccgctgtgcttcgtggtggccgtctacttcatgaccgggcccatgggcttctactggcgaagcagtcccagcggccccagcaaccccagcaaccccagcgtggaggagaagctggagcacctggagaagcaggtcagactgctcaacatccgtctcaaccgggtgctcgagagcctggaccgctccaaggacaagtgaaggtcagccggccgggcgggtccacagttaccagcacgctgtctcagaaaacgaaaacggaggaaaaaaaccccaaaccccaaacaatcttaataaacacgactgagcaagaaagtggcgctgtgtagggctatttccacccacccggcagctcttaggacacattcccagaagagcggaaagatcattgacgtggaactacacacgaagtgtaattagtgggggaaaaaatattttttaaacaaaggatataaccatatttagttgtacagtaagagaaatttatctgtgcatagagcataaagttaattttttcaagcatttaaatacatcttttgtaaggttttttaataaaggcagattgagtcaagtttattaaaactttacatggaggggaagaatatgctaatttgacatttgagaaaagtttaaatgcgagcgtttgttttcacagcttagggattggtgggtgaggtctgtgtgcgttattttcatgttcccaaactgtgagctttatttcatgttatttttggtggatgttgacttagttcatgaatgttgtcacttctaaatgtggacagttgggctgcaggatgcaactcaacctcttttggatcctagagacccctgccaagcccccatcagtcctatttttaaatgaagacatcgccatttctagaagacctgagattttcttccctctgtgcttcgatgtattttaacctcaacattttgaaacggaaaatgcaaggaggggccaagaaatgtcctggggatttgatgccaggaagtacctggtaaggattggagattgctccagaatctactgcatgtcccaatttgcagtttgctcactagggctatatacaaaagctatacccttgagggttttttttttttcttttgatttcctcaggaccttagagggaaaacaaacagtagcagctaatattctcaagtatattgctgcttagaaagatcctcaggaacaattagcagcaataagcaagcctttgaaaagatctgaattctttttcctgaaatatttacgatacacaggtgctttttatctgaaatctgttgtgtcctccttttaggcagtctctgtgggcagagagtgggacttgcgaggtggacagctgtggggatcctgggcaagggagtttcagaaggtgtggctcaggggctggtagaaacccccttttgttaggacttgttttttaaaaaagaaagccctaggccaggcgcagtggctgatgcctgtaatcccagcgctttgggaggccgaggagtatggatcacctgaggtcaggagttcaagaccagcctggccaacatggtgaaacccccgtctctactaaaaatacaaaaattagtcaggcatggtggtgggtgcctgtagtccagctactcaggaggctgaggcaggagaattgcttgaacctgggaggtggaggttgcggtgagccgagatcacgccactgcactccagcctaggcaacagagcaagacttcatcttaaaaaaaaaaaaaaaagcccagcattttgcagctttgaagctgctggggatcacgactgtctctgtggcccttacctggccacagatgtaccctggcaacccgctcacagtgccctgcgtgcaggtttatagataacccctgccagacctgctacaaccaagaccttatggtccaggtctcagtttggagaagatttagctgtctaccacttcttgtgtagtgttcctgtgaagttttatttttggttgcaagtatctggaaaacagatgcagatgtttttgtggatgttgttgagacttttgagacttctgtttctaaggtacacatgatgggacccaaactctcctggagagttccattcacttcctgaaacgtgcacctgtttcaggtgcatgtttattcagtgtgcatggatatttaagatttgctggagcaggctgggcggggtggctcacccctgtggtcccgacactttgggaggccaaggcgggtggatcacctgaggtcagggagtttgagaccagcccggccaacagagtgaaaccccgtctctactaaaaatacaaaaattggacgacgcccaccatcatgccccggctggtgcgtcggtataacacagtagagacggggtttcaccatgttagccgggatggtctcgatctcctgacctcgtgatccgcctgcctcggcctcccaaagtgctgg

SEQ ID NO: 459663 - DNA, 1253 bp, Homo sapiens
cggcggctgtgggtaaggcgcggcgcgcggccccgagcgcgccaaccttgccctagccggagcccgctgcggcccagcgcacggccctcaccccgcatcgcgaccccgcgccccgccggccgagcatggtgcgcgctgcgcctcaggcgggcccctggcccgggccgggctcctgctgctgctgctgctgctgctgctgctcggtgctgctggccccgggcgcgcagggggcgcggggccgcggcggcgcggagaagaacagctaccgccgcacggtcaacaccttctcccagagcgtcagcagcctgttcggcgaggacaacgtgcgcgccgctcagaagttcttggccaggctgactgagagatttgtgctgggagtggatatgttcgtggagacactgtggaaagtctggaccgagctcttggatgttcttggacttgacgtctccaacctgtcccagtatttcagcccagcctcggtgtccagcagcccggcccgcgcgctcctgctggtcggcgtcgtcctcctggcctactggttcttgtccctgaccctgggcttcactttcagcgtcctgcacgtggtgttcggccgcttcttctggatcgtgcgggtcgtcctgttttccatgtcctgcgtgtacatcctgcacaagtacgagggcgagccggagaacgcggtgctgccgctgtgcttcgtggtggccgtctacttcatgaccgggcccatgggcttctactggcgaagcagtcccagcggccccagcaaccccagcaaccccagcgtggaggagaagctggagcacctggagaagcaggtcagactgctcaacatccgtctcaaccgggtgctcgagagcctggaccgctccaaggacaagtgaaggtcagccggccgggcgggtccacagttaccagcacgctgtctcagaaaacgaaaacggaggaaaaaaaccccaaaccccaaacaatcttaataaacacgactgagcaagaaagtggcgctgtgtagggctatttccacccacccggcagctcttaggacacattcccagaagagcggaaagatcattgacgtggaactacacacgaagtgtaattagtgggggaaaaaatattttttaaacaaaggatataaccatatttagttgtacagtaagagaaatttatctgtgcatagagcataaagttaattttttcaagcatttaaatacatcttttgtaaggttttttaataaaggcagattgagtca

SEQ ID NO: 459664 - DNA, 2983 bp, Homo sapiens
cggcggctgtgggtaaggcgcggcgcgcggccccgagcgcgccaaccttgccctagccggagcccgctgcggcccagcgcacggccctcaccccgcatcgcgaccccgcgccccgccggccgagcatggtgcgcgctgcgcctcaggcgggcccctggcccgggccgggctcctgctgctgctgctgctgctgctgctgctcggtgctgctggccccgggcgcgcagggggcgcggggccgcggcggcgcggagaagaacagctaccgccgcacggtcaacaccttctcccagagcgtcagcagcctgttcggcgaggacaacgtgcgcgccgctcagaagttcttggccaggctgactgagagatttgtgctgggagtggatatgttcgtggagacactgtggaaagtctggaccgagctcttggatgttcttggacttgacgcgtcctgcacgtggtgttcggccgcttcttctggatcgtgcgggtcgtcctgttttccatgtcctgcgtgtacatcctgcacaagtacgagggcgagccggagaacgcggtgctgccgctgtgcttcgtggtggccgtctacttcatgaccgggcccatgggcttctactggcgaagcagtcccagcggccccagcaaccccagcaaccccagcgtggaggagaagctggagcacctggagaagcaggtcagactgctcaacatccgtctcaaccgggtgctcgagagcctggaccgctccaaggacaagtgaaggtcagccggccgggcgggtccacagttaccagcacgctgtctcagaaaacgaaaacggaggaaaaaaaccccaaaccccaaacaatcttaataaacacgactgagcaagaaagtggcgctgtgtagggctatttccacccacccggcagctcttaggacacattcccagaagagcggaaagatcattgacgtggaactacacacgaagtgtaattagtgggggaaaaaatattttttaaacaaaggatataaccatatttagttgtacagtaagagaaatttatctgtgcatagagcataaagttaattttttcaagcatttaaatacatcttttgtaaggttttttaataaaggcagattgagtcaagtttattaaaactttacatggaggggaagaatatgctaatttgacatttgagaaaagtttaaatgcgagcgtttgttttcacagcttagggattggtgggtgaggtctgtgtgcgttattttcatgttcccaaactgtgagctttatttcatgttatttttggtggatgttgacttagttcatgaatgttgtcacttctaaatgtggacagttgggctgcaggatgcaactcaacctcttttggatcctagagacccctgccaagcccccatcagtcctatttttaaatgaagacatcgccatttctagaagacctgagattttcttccctctgtgcttcgatgtattttaacctcaacattttgaaacggaaaatgcaaggaggggccaagaaatgtcctggggatttgatgccaggaagtacctggtaaggattggagattgctccagaatctactgcatgtcccaatttgcagtttgctcactagggctatatacaaaagctatacccttgagggttttttttttttcttttgatttcctcaggaccttagagggaaaacaaacagtagcagctaatattctcaagtatattgctgcttagaaagatcctcaggaacaattagcagcaataagcaagcctttgaaaagatctgaattctttttcctgaaatatttacgatacacaggtgctttttatctgaaatctgttgtgtcctccttttaggcagtctctgtgggcagagagtgggacttgcgaggtggacagctgtggggatcctgggcaagggagtttcagaaggtgtggctcaggggctggtagaaacccccttttgttaggacttgttttttaaaaaagaaagccctaggccaggcgcagtggctgatgcctgtaatcccagcgctttgggaggccgaggagtatggatcacctgaggtcaggagttcaagaccagcctggccaacatggtgaaacccccgtctctactaaaaatacaaaaattagtcaggcatggtggtgggtgcctgtagtccagctactcaggaggctgaggcaggagaattgcttgaacctgggaggtggaggttgcggtgagccgagatcacgccactgcactccagcctaggcaacagagcaagacttcatcttaaaaaaaaaaaaaaaagcccagcattttgcagctttgaagctgctggggatcacgactgtctctgtggcccttacctggccacagatgtaccctggcaacccgctcacagtgccctgcgtgcaggtttatagataacccctgccagacctgctacaaccaagaccttatggtccaggtctcagtttggagaagatttagctgtctaccacttcttgtgtagtgttcctgtgaagttttatttttggttgcaagtatctggaaaacagatgcagatgtttttgtggatgttgttgagacttttgagacttctgtttctaaggtacacatgatgggacccaaactctcctggagagttccattcacttcctgaaacgtgcacctgtttcaggtgcatgtttattcagtgtgcatggatatttaagatttgctggagcaggctgggcggggtggctcacccctgtggtcccgacactttgggaggccaaggcgggtggatcacctgaggtcagggagtttgagaccagcccggccaacagagtgaaaccccgtctctactaaaaatacaaaaattggacgacgcccaccatcatgccccggctggtgcgtcggtataacacagtagagacggggtttcaccatgttagccgggatggtctcgatctcctgacctcgtgatccgcctgcctcggcctcccaaagtgctgg

SEQ ID NO: 459665 - DNA, 1130 bp, Homo sapiens
tgtttctctgcaagggagttagagaaagtcggaagcccccagatgagctgctcgtcttgataccacagaaagcagggctccacccccacgggcccaggtgaggacaggcactcctgctttcgccggctgttgcattttccaagaccactgtggcccaccatgcccccgtcctgggcctataaaaaccggagtccctagcacaacagagacacaagccgctggacttagagaggagcacattggcggaagaaggcgcaagcggctgattgtggagagggcctccagaggagagcgcgggcagaagagcaggacaggcacccgctggccgggaggtcattgactggcagaacgacgcggaatttggctggagcagtcggaggagagcccaggacgcccagcagcccgactccagaacaaaaccatctcccttctggctcccccatctgcatccttgctgagccttacttctactcaacaaagccttacacattctcgcagcccacgtatcccctgtcggcatttctgtcttcttttctgagctcaggaagctgacctctgcagattgcatcaagtgggtctgagacccctttcctttggctttcttgcggtttcagccaatgacaaccactgtagcagagcagagggggactcattctgctgaaagccacagctcctatccggtggtcttagagcttgatccatcagatctcatgagacttaagatctatggttttataaaggttaaattcctggtgaccagcaattccaatcaatctgaccagagaaaccagccctttcagtgtgaagaatactctcatcctttcctactggcaggctgtgaatactggcttccaccccaggcacccaccacccacccacaggctctttcacagcaatgcactaagctctctctgcctgggcattccagcagctgggatgttctactggttggtgcttctcacatcttctgtacaaagagagctgatgttcctgagattacttcaatgcccttcaagatccagtgaatccccaatgcctatcacagattccattttcaatgtaattttcagtttaaaactgtttgcaaatttagagttggaaacctcaacttcaagatcagagagtgcctt

SEQ ID NO: 459666 - DNA, 972 bp, Homo sapiens
tgtttctctgcaagggagttagagaaagtcggaagcccccagatgagctgctcgtcttgataccacagaaagcagggctccacccccacgggcccaggtgaggacaggcactcctgctttcgccggctgttgcattttccaagaccactgtggcccaccatgcccccgtcctgggcctataaaaaccggagtccctagcacaacagagacacaagccgctggacttagagaggagcacattggcggaagaaggcgcaagcggctgattgtggagagggcctccagaggagagcgcgggcagaagagcaggacaggcacccgctggccgggaggtcattgactggcagaacgacgcggaatttggctggagcagtcggaggagagcccaggacgcccagcagcccgactccagaacaaaaccatctcccttctggctcccccatctgcatccttgctgagccttacttctactcaacaaagccttacacattctcgcagcccacgtgtgatccgattcttctggtacaccaagatcccctgtcggcatttctgtcttcttttctgagctcaggaagctgacctctgcagattgcatcaagtgggtctgagacccctttcctttggctttcttgcggtttcagccaatgacaaccactgtagcagagcagagggggactcattctgctgaaagccacagctcctatccggtggtcttagagcttggtaggtcctgtaactacctgcatccttgcttgtaggtttaagggtggcagtcacttcccttttgctagccccagaggggctttacagagtcttggtttccttgcccttactttcatataacctccttttatttaaaaaaactgtttaattatcacatttgagtgtcttctttttctggcacatgcagctatgtagattaaaggggtaactgtactttaaaaaaaatcaataaatcagacttttcattac

SEQ ID NO: 459667 - DNA, 626 bp, Homo sapiens
tgtttctctgcaagggagttagagaaagtcggaagcccccagatgagctgctcgtcttgataccacagaaagcagggctccacccccacgggcccaggtgaggacaggcactcctgctttcgccggctgttgcattttccaagaccactgtggcccaccatgcccccgtcctgggcctataaaaaccggagtccctagcacaacagagacacaagccgctggacttagagaggagcacattggcggaagaaggcgcaagcggctgattgtggagagggcctccagaggagagcgcgggcagaagagcaggacaggcacccgctggccgggaggtcattgactggcagaacgacgcggaatttggctggagcagtcggaggagagcccaggacgcccagcagcccgactccagaacaaaaccatctcccttctggctcccccatctgcatccttgctgagccttacttctactcaaccacctggtggttgagggatggagttggggggctggagaggaagataatagcacaaattccagtattaggctggacttcttctgaaggtgcctggcggttgagaatttagctatgggacccagtgtttcttttctgaaggatcccagtagc

SEQ ID NO: 459668 - DNA, 5083 bp, Homo sapiens
ggcattccttgagctcagtgctagccaccttggcgatggggaaggtaggtctctgctagctcccagccttccatggcagtgcaaagggaaccttcccaacaaagtaagagccaaaggctaagatggcagtctgtggtttgtagaaccttctagaagaccacgagacttgagcctctgcctggaatgttctcctcctcttccctcttctccttggctagctctttctacctgccctgtctcaggctgtgggtgtcaggagcagtactcagagcctgtaccagggaccaggagaaatcactcctaaaaccgaggagatggagaaaacagttggaatgtctcagccccgcgctcttgccggccgacaccacagtgtgggaatcgagaatatcggcttcggcttggaatttaaggaggaggagagaaaaaggatagctcggctggtcttcaatgattttcttgtaaaacttttacaagggagacttaggctgtttgatgttcatggtggaaggcaaatgaggaacaaagtcacgttttacatggcagcaggcaaagagaccgtgggaggggaactgccctctataaaaccatcagatctcatgagacttattcactatcatgagaacagcacaggaaaaatccacccccatgattcaattacctcccaccaggtccctcccatgacacatgggaattacaggagctgcaattcaacataggtggagacacaaccatatcaatatctattgtacaatcccatttgaaaaatatataaatacatatctatgaggaagcatgtatgtgtgtgggtacgtgtactcatgaaaacataataaaaagtctggaaaaaaatgtactcgtgaaaacataatacaaagtctggaaaaaactgttaactgtggttacctctggagaagagtgtaggacagtggtgataaagaaagtgttttctttttccacattgtattttttatacttctaaaactctagctctttttttttttttacaataaagatatattacttttataattaaagtgttttttaaatgacctagaaagggagaagagactcagagtgagtcctgacagaattgttcgggtcctaagggaccttggcagggaatgctggttaacccttgatatccttctccccacctccccaccgtcttccatagaacctcaattttacattcccagactcccttgcagctaggtgtggtcatgtgataagttctggccaaagggaagtgagcagaaatgatttgctaacagccagtccgtggccttaaagggaaggggctctggcccaattcagcctccacatgtaaccttgaaatctttaggccaagatggctacattagagagaaatacacttctatcttgtttaagcctctgttattttagatccttgtttcagcagctgaaactttatgcaatcctatacagaaaactagaaattaattagtaaatattaaggagtgtgcccagcctctgccactccttaaagggatgaaaagaaacatgagactcatttcttctgcccaaggggctcaaaacctagcagataaggcaagtctgattcactttttctaattgtgcaggagagtttatcagaggctaacttgtgtgccagacacaggaaggtcttcatttcaatgcagtgcattacatgagtcctgccctgttttatcaaaggatgagaagttggtcatacaaaatataaggtgaaaaaaagagaccatccaaacagaagaaagagatggacaagaggaaaagacttttgggtccaataccttggcaggatgagttttgttggtaaaaataaacaaataaataaataatggcagggcctaatgaccaaggagtgagaagagggagtccctctagctgttgctgagtccttccttgtgccttctatagccactgcaagttaaatatcaagctgcatatacttacaaatgcacccaaatgtccatcaaaaacctatgtgaattgcttgctctagactgagcatcagtctttatccgaggagccctacctttagtgagaaatagtatttaaggaccataatctgggctctctttgttgctgaattggttgctgtttcttaatgtttaagtggaaagtgctgaaagatatttttttaagggaaaatacatcatgagtttaaacaaacaatccaattctaattctattgggtttttacttatttgattttatatatgtatttcttttatgatgaaaatcttgattcctaaagagcaccaacgtaattacttattttgaagacgtaaaatagtatcaaaataacatcagtattaatgctaacaacatgattttaaaggtacaaaatgagagtggatcatcgtcatatcagcaaacggctatcaaagacttctgtaattgtgtcagaggacatagaactaaccaaaagtggctccccactcaccgaaggtggagaaatctgcacagtaaaataataactgctttaaatcaaagcacatcaaatatgttccaatccatgagttcacagtgatacttttctttaaaactctccaccttcatcaacctgattcctgtgtcaccctacctttgatagcctgccatgctccctcctacatgggccatctccttctcagaggaaggaagcatgaagaggctagtggatttggcattcccagcctgaagattggttcttctcatttggccacgcttgacactttctcttccatgcatgttggctataaaagtgcctggaatgcagaaattactatgaatattcatgaagttacattatgaataatacttctgtaaaaatgaatagtcttcaccctgggaaatggaattctttgtccacactttgagtcacttggagattgtcaatagcagtgttcagcaaactatatagcccataggccaaaggtgctccaccatctattctcatatggcctgcaagccaagactggatttcacatctgtaaatgtttgaaaaaaaatcaaaagaagaaaactattttgtgatatataaaattatattaaattcatatttcagtgtctatacagttttattgaaacacagccacactcatttgcttatattttgccaaagtctgctttcatgctacaaggacagtgtcaagtaattgtgatggacacatgacccacacagcctaaaacatttagtatctagccctttacagaaaaagtttgttgaccactggtctgtaggcttgaggttctcctaaatgcattcttggtgattccaaactcttgtctcatagagctgaactgcagtgccatacattgccagtaggctccattttccctccttctgggaagcaggtctaaagtctggaatgcttctctcctccactgtgactgtatagttagggtaagctgaattcacccacagctccaggtctttaagccaatacgtttcacctgtccccacccataatgtctggttcaggtatctgcagccaggtgagagacccccaggaagaaggcctggccccagccccgagcttcaaggctttctatttatatgcgaaattgcttgcgttttcctagttagtggcagatctgcctgtttgatgttaatgagtttgtgaacccaacaaaaacatgaaagacgaggcttttccaaagaggaaaaatagaaaataaaatgccatccaaaatgagacaggcttgaaatccgccttgcatctcaccagcccctttctctgtcttcccaaaggggcacctttcatccaattgaggaaatcaagataaaatgccagcctggtgaatatcctgcaaaaccaaattgatctgatttgcctggacaaagaaaatgaggaatttggctgatcaaagtgggcacagctccctcttaagccccacccaccccatcaggcctcctgtggataagaaacacaaatctctcgcacatcagcgctgctctcatattcattttcaaatagccccttgcatcctggtgcaaatcttagctgtctcctaataacccactttaggacatagatgttctcatctgatattattaaatggaaaggggccgctttctaatctggagagaggcaggggcatttgtaacagccagaatcaaaggcctggtctctttctgttcctaattatcaatagtgttttataatcttattaatattgatacacagtatactgaagatctgttaaggcgtaatgtatgtggaagataattaacaagatccgagtcagatcaatcgcctatttgacagccaacggtgtgtggcttataaattatacatattctaggtattgctcaaaatgtttaaagtttcagtccaatccttccgatccagcgctgggggaaggcatgaacctaaaggtaccgtccccagcctattggagccttctctgcacacgcaggactcactcttacttaaaaatcaaagggttctgttaactgccaagatctacacagagcataaaacacaccttctccttgtaaagtgcagaaaaacaaaaggtgaaatcttgtaagaaaagagatgattaacaaaaggaagctgagtttaatgtttaccatgaacccaccagattagtggtttgggtatacccaaacctgcttataccacgacattgccatgaactaatttaacagaaaagtatggcagccaatgaaataggaagaagcaaagagagcatagtggtatctatgaaaactaaaagcatactttggaattataaaggcaagttgctaaaaaaaaatccttaaaattaaggaattatttgggggtaatagaaatgcattgtagcttgattgtgtttcacagctgtataagactgtatccaactgtttaatgacattgaattatgtgttgtaactagatgcagttgattatatgtaaattattcctccataaagttgataggaaaaatactaagctttggagttaggcaaactgagattgaattttgcctctgcttactggcctctctgagctttggtttagtctttcctagctgcaaagtagagataataaaacctactaattctggttatgtattgctgtgtaactatgtatctcaaaatttaatgact

SEQ ID NO: 459669 - DNA, 875 bp, Homo sapiens
tatcagctgcctcaggaggaaatgcttagcagggagctgggagtcttgacgcaacctgaaaatactcaacgagggaattctttctccatacagcatcttctaaagtttggcctcttttaccaaggacctgccaagatgggcagccttcacaccaaaacagtgaagaaggtagcctgggtcatcatagaaaagtattacatgcaccccggtaatgatttccacatgaacaagcaagtgggtgaagactgtcattatccccagcaagaagctctgcaacaagatagcaggctgagtcacgcatctgaagaagcagattcacaggggcccaataaaagcacacaggtcctcaaattggagaagctgcacacacctgcagaagttcacgccatttgcagcggggaggagcctgttcctgtgtggcgacctgggcttcaatctgtgaggcgggaaacctgctagcaggactcttgctttgtggtctcctgtgagaagaacataccccaggtagcctcttctttgagaagcacaaggaaacacgtggtggtggaactgaacacaacccacagcctggagctaaacccaacctaagccagccaagctcttccaagatcacccaaactcaagttgacctgtagatccatgggcaaggaaagaaatgcctgctgttttaagatctcaagttttaggttgatttgttatgcagcattattgcagtaaaaatgaactaatacactacctaatcccatttttctattcaacagttatttgttgggtagctgatatgtgccacacacttataatacaggcttcagggataccatggttaataaaataaagagggcaaaagtaaatgaacaagataattttgcattttg

SEQ ID NO: 459670 - DNA, 1259 bp, Homo sapiens
  misc_feature (4)..(4): n is a, c, g, or t
  misc_feature (6)..(7): n is a, c, g, or t
  misc_feature (9)..(9): n is a, c, g, or t
cccncnnanaggtcctcggagtccagagtcctcgaagggaaatctgacacaaagaagcaggtgtgagaccggcccctttctcccatgccttagacagggctccagggactgcttcaggggagatgtcagagggcagcagggaccgggaagggaggaagaaagcagagtgacagtgagaggtgggaaaactacaagaggaattgtttgtacgcttggatctggacttttagaactggtcaggacctgacagatcctccagcccagttctcccggctctcaaacactggcatcatttataattccctggaaaatcaccagcaggtaaatgaaggagaaaagaaaagaacaaaatccaccgggaaccagagacttccaggctccaaagacaggcaatctccaccaggaaacacaggagaagccctgaaaagttagtcttctggaagagaaatttacatctacaaaggaaatctccatttgtaagtgtgtcttcttctgcactaggaagagaaggatgactaaatcagagaagtctcttgtcagagaaagcacggacttcagtcttcagactgaagagaatataccttcgttttatgatgatttttctggccatctcatcttaactgggtccaagatggctgctgaggttccagccatcacactaaaattgcatccgactgaaagaggaaaggaagaagaaagtgccctggctcacctttttggagacttcctgaagaatggtaaccgagacctgaaaggctgcacgactcattaccaattaccaattcccagggccatccggttccctggcagaaaagcttccgatgaatttgcgttgcaaattgaaaacatactgtcaatagcaacaagtccaaaagatgtttaccttaatttttccaaggcaggcttttatatgtggatgtttttgtttaaggaccagcattctcgatttcctgctgtttctggggttggtgctgttgttacaaaagggctgtcacaatctcatgatggagaggagaaatgaagtggctacgtgaagactctctggcactggagcctgagacataactttgcatggggcacgggttggcaaatgtcacggctgacacacagccattcaattttcctaagggtttaggcacctgggacatgatcctgttgaagggctccctttgcagataagtaaagtgaggtccagattgataatgtcacttttccaaggaaacccccatagttagcatcatggttgagtctagaagttc

SEQ ID NO: 459671 - DNA, 1604 bp, Homo sapiens
gctggaaccactgagtttacgaggacacgcagcggtagcggcagcggcagcggcagcgcagtcaggaggctggagaacatgtcttgtgtcttgaagcacagtcctgaagaagcaccttacctctgtctgagatcacatcagggaggcagccagctgctcctgacactgagcaagtctgcacacaagcgcttcccttcgaccctgcagaagaggccccgtagaccagttaccagtgaaatagccgtgatggcagccaaggttttgaatgtgtttgcatggattggtttagcccctcgggcttctgttatgcaccataagaagagcattttctgggagctgttgttcctagacacctggtgcccagaggccccaggaaccccatctgaagcaaagccaaaccagccagcccacaaacctgtggcagataccagagaatcaacaaggaggtgtgatgtggtttggatgtttgtccctctcaagtctcatgttgatgtgattctcaatcccttatgaatggtttagcaccgtcccttcgatgatgagggagccctcggaacagccccaccagttaagatccatccctgacttccaactctgtaactagggacaagttaattgactcctcttagcccttagtgtcctcatcaattattacgtggtaataacccctcagagagtcgccgggagaattagctcggcgcggtgcatggggctagaactcagggcccagcaggtctgacaatgcaggtttccccgctcgcctgttgggtttttgaaacgccctcagcggggttttcctcctaattctggtttggaggagccatctctctccatcccgtctgccagcggggtttgcttcacacacagacgtgggcagatggcatcggggacacagggaaacctgaccttagaggaaatggaaaagttggagagacactgagcactgatacgaaataattctcttgctgaaatacacgaaaggagtcccagcagccatattagtatttccacgtcctgtgtcagccccaagtagagagaacttggaatgggaggggaaatggcagccatcaggaaatgaaatgctggcccagagaattctaagcaagtcaatcaccagtccaagtaaggaggtgttttttgtttttgtttttgtttttgtttttgtttttaaatatccacttgccatttgttttacccaattcaaaattttttcccaagaaaaaaaaatacacttgtaaaatgcctcattaacagcaaagatgaattggacctcaacttttgaatgccatgctgctttaaaggaaactgtagaagttcgtggaatgaaagaatactgccagcatgcattcggactattttccatctgtgtggtagagtctgagctgtgtgttctacagaagctccagttggcagaaggacgactttggccctgaattttcatttatttttgtttcaaaaatgaaaggatagttgctatttttccaaaatttagaattttaaatcactacccacttttgatctctgatttaaatcttgttttgagagacacattagacagtctctacatattatattattttgcaagggaaaaaaggagaaagatc

SEQ ID NO: 459672 - DNA, 1308 bp, Homo sapiens
aaagaactgggaacaagtgaagctgattgacgtgtttgcttccccttctgccatgattataagtttcctgaggcctccccacccctatggaactgtgagtcaattcaacctcttcattataaattatcgagtcctggaaaaggacaggaaaatgtgggaaagtttggaacttcctggagacttaaagggctcagaagacagaaagatgtgggaaagtttggaacttcctagagacttgttaaatggctttgaccaaaatgctgacagtgataaggacaatgaagtccaggatgagattgtctcagatagagatgagaaacttcttgggacatggtggcctgcattcccactgcttcggctccagtcatgtctaagaggggccaatgcacagcttgagtcattgcttcagaggatgcaagcccaagccctagcagcttctacatggtcttggccctgtgtatgtgcaggagataagaactgagcttccctacttttaaagttttgggacttggaattgcttcctggctcctcagcttgcagacagcctattgtgggacttcaccttatgatcatgtctcagcaggacagcttatctctgctccatgtggcctaactggggttggatgacccacctccaagatggcttactttcatgaatggtgacctcacactgggagcctgaaaccagccatggtgagagtattgatggacagaaatcagcaaatgctacaaatcaggactctactcctccccagagctgatgaataagtgagtgaggaagaaagtggccccaaatgaagttgttgtggaaataggcagggctggatcattcacggccttgcaggtcatggtgaggagttgagattgagttgcctttagaaagtctacgaggacaaaagtaaaagctgtgagatcctctggttgacaaagaagtccagacaacagatgatgacagcttggaccacactagtgacagcaataatggaaaaaagccttcaatggattgcacgaagcccaaccatactggggaaggcaatctacttcactcagtctacacaataactcccttctttttctgctgattcagaggcatgttcaaagtgtccaggtggcactcttatcttgcagttcaatggaatcattgttgtgtctcttggtggaaccatttctccatttggaactaagacttctaggccagcagagaacagggtcataggaacaaggaaaaaaaagttttgctagtgggtcattagcaaattgtgaatgtgaatggaatgtaattgtgaatggtgcaactctcacttttca

SEQ ID NO: 459673 - DNA, 1111 bp, Homo sapiens
attggccagatattttggggactgccattccctctgggtttgcctggtgtgtcctcatgattaggctgtaggaaaggctttccccttctgacacacgcaacgacgtggatgaaacttgaggatattacgttaagtgaaataagacagtcacaaaatgcaggcaggaagacattttcaaattccagaaatgctgacggacctccagcgtttccatgttcctccccacctgaagaatgttaagataagcttaatgtgattataacgagacttatatgcccaacaagcatagtttgggaaagagatttgctttgaatactgtgaaataagctttaatctgtcaggtttaaaaaaaaaagttcctgtgaattaataatgcaaacagcactgtgctttctgagtgcgactataaaagaatttaatgacctcctattgtaaggaggatggccacctcctcggtgggatttcccaagggctcctgctagaatgcgatggatttccctggatggcgtttcacagcggaaaccgtgggattgattttgaacgtaatggtttaaagagtaaaccatctgggtcccatttccatacaacttttgctgacattgatcatcttatcctaggctcttctcaggaagccaagtgccggtcgtgcggtgccttgcgaggtcgttcttggtctgtagagtggctctgtgctgatgggtctacttgtgctccattctcaggcccactaagtgacttctttccagacaaggacttgtttatatctgaggaatctacttccataatacgaaagctggggagctcaccacaggaagtttcaggatgcaaacccaggaagagaagggtggacgctcagaccccatctgtttgcaccaagacatctttgccagcagccttcactttcctcgccttggaccttggccacattattgatttcacaaggtctcaggctccaccgacagccattcagaagaaggccagagtgcatgtggaatcaccgctttgccacatgatgatctgcttaagacaaagtctacactgcagtagagccaggcaggagtttaagaccagcctggccaacatggtgaaaccccatctctactaaaagtat

SEQ ID NO: 459674 - DNA, 3323 bp, Homo sapiens
  misc_feature (6)..(6): n is a, c, g, or t
  misc_feature (8)..(10): n is a, c, g, or t
taagantnnnccaaagagggagttcatgctggatcctacacactacctggacctaaagagctgcagcatggcaccatttggagaggacagccctcactatactacattttaccctgggtaccctggggcccaatataccctattttacccattctggacccccactgatatacacccatatcaacccagagggctgcagcagtgcaatgctggctgtacccagcagtgtgtccaggtcctcagcactctggaccatagtgaattagaaaagggtaaggaagaggagttggtcaacaggaagcagatggttggttatgcaatcatgacagttgaggagtttcatgtctcactgtccaacagcagtgacctgctgtgtttctgctctgtgatattatctgagagacctgatggttggttccctgagaaaggaactcagaatcctattaaacaggagttgatttctagagaagtgcttggaaatgccatcagaactggcagtagaggaggcaagcatagtgtagtagaagaaaaggcctgggatgggatttgggttcccaatctaaattttattgggaacagctagtttgacaagcatagaccagatgtccagttgtcattcattcagcaggagcagcaagattcaatcatgtttttattatattatttcctgaaacttgtggctgtaacaatgaagtttgaggattggtctgtgtaagtatggcagaagtgatgttaagtcgcttatgagattagggtataaaagactaaggcttccatgcttccatcttggtctctgtctctcagagaacagtcatgtgaatgattcttcttgaaagtaaatcttccagccccagtccagtattcaaatgatccagcaacattgcaacttatgagagaccttgagccatccaggtaacatgcttccaaatcctgacccttaaaacctgtaaaataataaatgtggttttaaactcttaagtaatttgttacatagtaataaatagctaatacaccgtcctgactattgtcattctttacaatatttcataagcactagtcattaaactatctgtagtccctaaaatatttatcaatcctttaagcctctataagttcacagatttttatgtgtagatatttattcctctgtcaaatatctaatgcaatattttctctttcaaatttggctagtgtcctttctagagaattttatgacctcaccaatctgaattaagcaccatcgccattcctggtttcatagaagcagatgcccatgtctaacttagcactagtcacactgttatgttcacaagattgtaagctactaagattgggaccttagttttattaagtttacataatgtcagatacattgcctagcaaaaaagaacttgcttaattattgttttttaaaattaaatactaacagaatgaatggttaaacaccattaaataaatatgttagttcagattatatattgatgtatggtcattagtttcctacaaaagagaaatttcatgtttttctatctaaatgtataatgctccctccagccctacagacatactatttttttcaaaagaataaagagacatgaacaatataaattcaaactgcaagacggttgtgtcacatttcctggactatgttgtagcctccgttttgtagctgcacctccaggataacttgtgaatccttagggtcatggaaagaagcccagtaagtggatttctttctgaacagggctgtctttgtttcatcatggagcaccttgtcctcttcatccagcattatgatttgctcttggcctttctctgggacacaatatgtggctcatagttctgaattagaggagaaagatggttttagcattatagttgcaaatataaagcatttctctggatttagcctgttctttaccagggagcttgaagtacctaaggaggaagtcattacatattaaactcagaataaaacacctaaattccaggacatgactaaagtgtgttggtgacaaaaacttctggaaaactaactctgccaattcagaaaatgttactggcctcataaagtaatggtacagatctatagacaatttaaattgccaagagagttttgggtacaagagctctccattttcatccctgtatccacagtggttggaccactgaatgttcttaatacagagagagtaaaagaatgtgcttaaagttgttgttagtgggctggttcagtttcttgactttgctgcaccaacgaatttgagagagagtctaaagtaaaggttaagggacaaaacccatagacattaatgaaggtgtggtcccacaaagtttccctctctctcacaacctgctggttgtgcagcctgctgtctccagatttcccataggcctttgtaggcacctttcttctctcatggatctttgaataataaattgcttctgttatttcatgtgttttgttatgctgcttcctcagtgtctcactctcctctcagtcagggctctcctagaggttgactatattggtaggagtaaactggatacagatcacacaagaaccaccagagtgtctgccagtataaagacatttcctgtgagaaggacactggtcacgggttggacccttaggcttcaggctgtttgcaagggcaaagtagtatcccatgtaaggtgttttcacatttttattcaagtatttgctgaatgcatattatgttgtatagtccatggaaattaaaaatagacgttgtactttcaaggagcttaacatttatttgaataaaacagagcttttataaataaatattatatgttattataataattaaaaaagagaaggtatggaaaagtatatcaaatgctcaaatcattatggaaaacaaaagggaaaaataatgatcaaatctatgtggaaggctgacagagaggacttcatagaggaggtgaccacttagccaagtccagaaaaataagtagggatatcaaagatagattattgaaagggagattattttagatacagagaataaccttaaatatgtttggaagatgttattttttaattattgcagcttaataggtttgatgtattatctcacctttcccttatctttttactgtagtttgatgttaagtgtatagaaaatgctgaggtcagacatttttaaagtatgctatgagaaatgtaggtctatcatttgaaccctagtctcactgtttatgattgtgtcctacatctaaagcttaatttccttatgaaaaatgaagagtaacgtcacccatttttttgttgtgaagtttaagagagacaataaaag

SEQ ID NO: 459675 - DNA, 948 bp, Homo sapiens
ctgtctcactagtatagagactcatggcccactccgaatctactggtgacagcagcttccctgaattcatgggctgcccagggccagattttggctttggaatgacttgtcagtatcgttcagatttcctgaccattggtggatttgacatggaagtgaaaggttggggtggagaagatgttcatctttatcgaaaatacttacatggtgacctcattgtgattcggactccggtttctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatattttaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaagggaaggtctgtggatagcaaac

SEQ ID NO: 459676 - DNA, 1659 bp, Homo sapiens
tcagctgtgggtcagctgtgggttgtctgcaactttgctggccattcctgggctcagatcatcatcacatcatcaccatcatcacctcatcctcatcaccatcatcaccatcatcatggcattatcatcatcatcacctgatcctcatcaccatcattaccatcatcatcacatcatcaccatcatcacctcatcctcatcaccatcatcaccatcatcacattatcaccatcatcacatcatcatcttcatatcattatcattaccatcatcatcacatcatcaccattatcattacatcatcatcacatcatcattatcacattatcatcatcacatcatgattatcaccatcatcatatcatcatcatcatatcattatcatcatcaccacatcatcacatcaccattatcatcaaatcatcatcatcacaccatcaccgtcatcatcacatcagcatcatcatcatattatcgccatcatcacgttatcatcatcaccaccatcatcatatcatcatcacaacaggccatacagaaccctgcagagtgctccactgggaacccaagcagcagcctgacaaccagggaagagcatccggagagctgacgacgtgggggccaggtttaataaggaagaattgtcaaaccattctgtcaaggaacacagataatgagaacatttgtgtagataaggtggagttggatatgtgtgcttgaagccgcaggatgaagacaacatcaggtgattcctggaaccagagcgatctctcagggccgctgcagaccccacatatgctcttccatctgaaggtctcagcccataactgccatcaagaacctgaagacatagcttcctctatgccagacttaaggacatctaaatatctacctctgaacacctatttgaagaaaagattatttcctggaacctaccaattaattgttttactataacaaggaatcatccaacatgttttatttcttcgttttcaaaatgtttggaagtgcctttacagagacattaaatatacggtggaacatacacaacagatcatactgaaaccataggtaatataatgagatagatacattatacaaaaaggtatatagaagcacaatgtcataacagcatgctctgtttataatatctggtgtttaccagggaacaagaatccaattcagaaatgtggaaagtaagggataacaccttttcaaatgccagacaaaacttgtccccactgtttgctgccttgcaatcaccccaaagcacactactggctgggctgtgtaggtttggccactcactatgttctgcagctgagatccggtccacctgcctgagaagagtctgaggctgggaactgatacctaagatgcacatttcaattttgagacaacagcatgccctgtagacacacattaaacatgagcagtattgtaaaaattatttgccatgggaagacacacactacctccctctaagagcacgggtctgttgcatgatacacgctatgtggatgtgactatctttcagtgttttatagccacttatttttccctaggtttgatcatttccttatgacttaattctccactctcagcctttcatagttatggtgtttgcttatgcccacaaataatgtgtggggaatacct

SEQ ID NO: 459677 - DNA, 3557 bp, Homo sapiens
ctatgttgcctgttgatcctgtgaaagaaaattttatgttcttaaagggaaaacttttttcaattgccttcccaactcctttcaaatcaagagtacctcttgtagcagtttcaaaggaagttctagaagatattttggaccttgatttatctgtctcagaaacagacgattttatccagcttgtaagtggcgaaaagacagtgtttggatccattccactggctcatccctatgggggccagcagaggtgtcctgttttcactgtcacggacatcaagccggcactttctgtctgccagaagtgttattacttccacatggctgttgacacaggccccatcatctctgacattgaaatgccacttacaattcattatttattagaactatatttggcaaaaatttaaacaatcttttattggtacataaaataaggaggcatcacacaattcagggtgccttccatgaagtggaatatggtatatacaacaggacgatgcttacatgtgataaatggattcaaagaatggataaatatagttgggaagttcaatatcttaaaaaactgctataaataaagcacttatatttgctactttattttcctaataacaaaactacactaaaatgattaatctgtaattattgacatatatataataaatctagatataataaaaatatgtttctaataaaatgtacatgtaaatcaacaagcacagataaaaagtttctcttctgaaaatgctaaaagttcacagaatatactaatccacaaaaaataaaaattaaaatatagaaagtgaaaaattattttaatctgtgcaaaattcatattcctgctcttccccaaaattatttcattaataataaacttttactaataacattgtacttgttcaatgcagaaatcaaagataataaaaaggaaaaacattttatattaaaacaaatgccctcaaataacaaattttatcatatttcgtacataatttcagataacacaagaccatcatctgtatgtataaacaaactgaactttacccttacttggtacaccaaaatacattttcaaatgtcaacatacttctgtatatgtttctacattcagtggtcacatattatcccacgctgtaaattcactgaaatgtatttataaaagccattgtatggattcttcttaatacactgatattttaagcagcgctcaaaaaagaaattgtgtgtatgtttccttattttctaaaaatatcttaatgtaatagaattgatcaccaacaggcatatacaattttttaaatatggtacttaccaccaaattgtctatttgaaaagtcatctgcaacttaaactttaagcagcagtataaatatcactgctctttatcctcataaactttgtggatagaaaacagtatttgattcctgttttaacttaaatgccttctctaacgaggaacactaaatattgtttcctgtgtgcataagtcacttgcagatctagaagaaggagtttgcccaattttaaattagaggcaaagtacttttcttagatctgcaatttacatctctaatttaaattgcccaattttaaatagaggatttttttgttgatttgagtgaattctctgtaaaatgaagatttttaaatctgctatatatacacacatgcacatacatgtgtagtaaatattttacaagtatgctgccttttattttttctcaaatgcagggtaatttttgttttgctaaattaaccttcacaatgcttatttctgagagtcttagaaaggttttgtcaacataaaaatgtatctgtgtaaataggcatttatattttcttctgattttttttcattttgtatattaaaaatttttaatctatattccatcaggaacttatttcttttatgtactgtaactttggcatttttttctagagatcatcaaacccaagagagtctagattttctcctgttattttccagaagttttatagttttgtatttgacatttaggtccgtgattcattttgacttaatttttgtgagaaggtaagatctgattcattttttttacatgtgggtattcagttgttccagcaccactttctgaagaaaccaacctttgtttcatcatgttgcctttactttttcatcaaagattaattaaatatatcgatgtgtcgctatttctaaactctctgtcttgtttcattaacctgtctattctttcatcaatatgatactgccttgattaccgtagccttacagtaagtcttgaagttgagtagtgcctgtctgtcctccagctttgttctccttcaatattgtgttagctattcaaggtctttttcttccccatataagctttagaattactttttctatatccataaaataatttgcttccattttgattagaagtgcattgaatctgtacattggtaagaaatgacatcctgatgatactgagttattctattcatgaatatgatgtatcttctccatctcttcagttctttttttatttccatcatcacatatggacagtttatgaaattacataactccctctaccttgaccaaaggacagtgatgaattcctcgttctgcagccaacaagtcacctctgagggccatgtgtctaaacatagacaggagggacacctgttgcttcagccaacacctgctggcatgtgctgaggatgctggtgctgctggctttcccagccctgcccccggggctgctttgggtgtgtgcctcttgactttagtgagaatgtactttttcatccctaccatgggtgaaaagttttcacaaataaaaactttttaaaataatgccaacttttgtattagatagaggtgctgcgtgtgcaggccccagtgtgtgttgtttccctctatgtgtccatgtgttctcatcatttagctcccacttacaagtgagaacatgctgtatttggttttctgttcctgaattcctttgcaagataatggtctccacctccgtccatgcccttgcaaaggtacatatacaccatggaataccatacagccataaaatcaacttattaattaaagtacttttgatgtcttaataatgttgaccctgcctaatcatgtaatgtcataatttttcatttatacaaatctatttttaggtttttaagaaacatttcgcaccaattccatactaattaaattattttaaataattttctttaaaatgttggcattatctcttttccatctatgaacacaagacattctcattaattcaattaacataatttgttgtgttaatgaatttcctaacgcgatgagtctcacctgcatttctggaataaatggacttcctaatgatctaatattttaaagggttggcacaatggtttttaacattcaaaaattttactttcatattaatatgctctaattatgtataatactccatgcggcatcaaacaagtaaagttatcatatcagtttttttcatttttaaaatagttcagttttattctgctagtaccataaaaacaatgtaaacacaagc

SEQ ID NO: 459678 - DNA, 1082 bp, Homo sapiens
ctcctcctccataagctaggaggcagaaggaactcgaggccagcctgggcaacatggcaaaacacaggctctacaaaaaaacacaaaaattagccggggtgtggtgacaagtgcctgcaatcccagctacttgggaggctgaggtggaaggatcacctgagcccagggaggtaggctgaggctgcatgattctcctgcctcagcctcccaagtaactgggattacaggtatgcgccaccatgcccggctaattttgtatttttagtagagacagggtttctccacgttggtcaggctagtctcgaactcctgatctcaggtgatccgcccagctcggcctcccaaagtgctgggattacaggtgtgagccactaagcctggcccatattttttaaaagattaaaacttttattatttcaggctgggcatggtggctcagagcaagactgtctcaaaaaaaaaattattattttgaataaataaataaaaataataagaaaaaagaatgggtcagaattgtggtacaaagagctacccagatctacacatactaaaaggaaagtggtcatctatcctatgcgccttcctgtgatccaggtgctactggactatggatcaaatcagctgacatggagaacccagacaaacctgcccctcaaggcaatcacagaagacaaggaagacctgggctttgagctttctaacttctgtggtatgaacctgggaatggcactcttcagtgagattagctcgtgcactggtcgaagccctcaggaaccagaaccacccattaacaagtggctgggaggaagggggccgcttttgggcattgttagatgtgctgctacacagactgtggacaagggaatgctgggtgttttgaaggaggcaagcagccaagtctgtagctctccacctctgaattcactcagagatggcagggaagaaaagatggctccaagaggaatacagctcctacccaacaaatcctaaaaggcagctctaactggcaataggaatggcggcataaacgaagacccaaagaagaaacccacccaggatacctctcatcagtagaattt

SEQ ID NO: 459679 - DNA, 2855 bp, Homo sapiens
aatcccaccagggctgggcctgaacatgaggtgggtcggcacatgccctcccaggctcatgtctgggtgtacatccctcagggggcctgcagagaggaaaatggcaaagcgcagactacaccttgtctcagaaagagcaaggatgccctgcagtggaatagcacttaccagtgcattctgggacaaaaggaaaaaggcagggaggagaaagcagatggtggccataatatcaataatggccattccctgagggcctgcgatgagctagccatggttctaggccccagagaatgcaaagcaggtgagaagaccaagacaggaacaaacttgcgggtgtcctgcattgtccagatcttccaggactattgggggaccaatgctgagcacttggtcctgaaagattttcactgcagtggacagctccactttggtagagtggagctaaaaatatctggaccacctgctcacagggtcatgagaatcaaaggagaaaccacatatgagggtgtccaacagatgtcaggaatgactttcattctgttctagcagttaaggagcaagagttcctgcctggagaaggcatctcccaagttctagggccttgtgtcttcctcacttgctgctgccctcaaagtcagcctaatttgtacctgaacctcagccctctgccttggtggtaatcagtgtttccttggcttgcctttctctgccttacataccttgctctctgctgtgccaatgtccaccatgcgtcgacctcgccctggttgtactttagacaaagttcttgcaatgccatctgcctccagttctgcatttggagagcaaaacttgtctcctagctggagatctcaagcccaacccaaagcacaatgtctagaacttagtaagatcttagccttaaagggtccaacatataggaagtcctcaggaaatccatgttaatttaaatggaattgaaagcaggtatgtttcccttctttctacagcctctgtacccaaagattggatgaaccagtggcaagaaaatgccaggtggaaacatcccaacagacagtccatgagcgatggtggaactctgtgctgcaccacccacatgcctcgcagctgagtccttctccagaactttccttcacctggaggaaggtgcctagttcaagcttaggattcatcctgccaagcctccctcggatgctgaggagaagccactctatgagatgttcaaggaggcctcatcacggacctatccggctgagaagttccattggtccagctccttcactacccagcacaggtaatgacaacgcacttgaggaaactcgataggttggctaccttgaaatggagaaggaggtcaagaaacacatatcctaactttcagaaggaactgtctgggataattaatcaacacatcaccaacaccaagggattgttttatatcagaagacgtataattaaaaaaaaacaatagcaggcttgttgtgtgttttgtttctaaggaatgttaattatgtttggcaccttgacacatccaaagttctcccccaatatttagaaatcaaacagaacttggcttcgagatctttcttagccaacagaacttggcttcgaggtctggacttagcacaggcagggtcgtagaaacaaaatgggcctccaacaggtctttgaatgggcctgtgattgctgtactagtgaggaaggcacttgcaattgctaaattgcactcactattgcttaattacacctttggatcagcacctaatttgcttagggtgcaactgagctgccatgggtgtaattgcttgtatgctacttgacaatacagccactgccagaggagactggagcctcacttggctctgctcagagaggctacagccccatagctgtggtttccagggccacagaccccccagcagcccagaacagcagaaggcagccctggctagctagctgctcgctggaagcaacctgcatgccagaaaccttagaaaggtccttcggaggtgttcacagagcgactaggaggacactcccaggctaaccctcccagtgggttcctccctagtgggccctctctgggaggcagctctaggacatgagcaactccacctaggttctgcctcagctatcctggttactctgggctgccagctcctgctggggcctggttcccatggttaatctgtgctgcgacatagcaggggagatagtggctaaagctgctggcacccaagggggacaggaccatgaccacaggcacccaaggccccaggtaagagagcaaagccctcctcctgagacccctgtagccctgctgatgtccacagtatggccagactggcaacatcaagattcatgtcccacagaggaagggggaggcatccacgtttccccctaaacacacacacacacagaggccacacaccacacccagccagaattgcatacgtatttttagttctacttagcatttgctgctttggggaatgtttctggaaattttggagagcatcttgttaaatgagacccacagatcctagaagtgttcttgctgtatacctgaaattacatgagcttagtcaggggagctgggcagggtgggaatggcagaaatgggcagcatcaccaggctccacccagtaggagagcccccttcccaggaccagggctggagagtctggtttacctggatccaacagggatctcatctttggggaaagtggagactgaattctggacagagctcagagtccatgccagctgggcagcagtcaccacacaggcgtctgctcatcctgtggggcatcccctcttgggacagtcaaattattaaagaatcgtggtactgc

SEQ ID NO: 459680 - DNA, 1445 bp, Homo sapiens
agctactgcgcccgagaggcagcgctcagacagcggggaggaggcggccgcggagcccccggagatggagggtgaaggcctgctttcaaagtatcccacgtcgttcagcaaagattcgtcatttagaattcagacctgccaagaccacggatgctttgtctcagctcggatatcttcatttctccttcttacagtttccttgtttccgaggaaaaacacaagatcttgacaactgcaatcacctggtaaccaatcatgaatctggtatggaccactttcaccctgcaccctgtcaggcagtttccatcttctcacaatcttcacaagaatcctacagaaacaagacgtatcccccgatttactgatgatgatccttcagcccagagatgcactctccatcggctgaacccaactggaagtcggagggtaaagggcccatgactcagtccgttcaggctgacccgcctggggctcagagcataacagacaagggtggggaagaaaaaagaatggacttggagaagcaaatgggaaatattcaggcacttctgatctcagtttggccagtcggctcccctctctctgactgtaaacacagagatacagaaactgtcattagaaatgagtagtgttaatgatccatgacagaaagctcgtgaatttctactgctgaggaggcttgagcttttctgttttcattctttctacacatcgggagcggagctccccaatgcctttctgatacatcgctacttctgcttcacctaatcaaaggcacttactgctgctcagaacctcaggcctccaactgaacaatgaacaggttttctctccatcaccccctgttctctagtataaaaacttcgggccctcagggcctgtggccacaagtggagcaattagatatgggcatccagaaaacctccattagtgaagcctacagatgttcatcagagactcctgtcaatgctttatgggtgtacagatattcggatgaaacctcgtgcttcgtgcttgcactgcaagctctcttcatccaagcgctcctgtcggggctgtccgtgagaaaccatcctcccttcatgcatggtgccctcctcaccctcctgatgccccacttctccccttcttttcttctagcatctttcataaaatatcagtccacaaaccttctcacgggcaaggagaacaggcttttcagcaatatgagaaattgcataactgaacaatagaaacattcaccttcttgttagctaggaccaaaaaatgctaatattttaggtggattccagaatctctcacacagagtctggggtacagacacagaaggttaattcagacaaaggaggcaagggtggctaaagaaaaaaaaaaaagcaaggaaccagcttgtgtcagggtttgatacacaatgtttatcaaacaatgcttatcaaatgttattt

SEQ ID NO: 459681 - DNA, 1894 bp, Homo sapiens
agttaccaaatgtctacatcagatgcatatttcatctgcatcttgttattgggccgcaagaaacagcagcctaaccctcagtttggcctggaaacagaatgtggcatgccagccaggagagaccaggacggtgctgtgtccagcagccagaggcttgtgaccagacagtgttcaggaggatcccagcagctgccagtgagattttcccgggaacccttttgaagggtcctgtgggtaaaaaatgcacatctctttcactactggggaagaacggagatcaagagcagacatgctcaaaagggagtgacatgaatggatttacattttgaaaagcctcttctggcatgttgtgggaagtcagggaccctgaatggagggaccggctggagctgcggcagaggaacataaattctcctgggcacatggcaccactcacatatcacagtgcgcactgggaatggtggctgtggtggggtctcaaggaagccaacataaacttcaaggagaggtgctttgtgcatcccagctgtcctgtggacagtccagaagatagtggtggcaaatggccaacttctgcagccctcgccctgaaggacatgtgccagacctggttctggaggttcctcattggctgggcaggacccatttattcactgacaaggaagaagccctgggttgggcaaggaagtgccaaaatgccagcaggagtcacttggaagctctgtgtaacagctcttaatgaatcagtacagaattagtttgatatttcaacacctagaggatccctagaagatgtttgggtttgctaaacattaactctgtgagaagaaacactcataatcaaacccaatattattaaagtgaggactaagcaacattgtttctcactcacaatgctagctcaccttctatgtgtgactgggagtagctgtggctagcaaccatttggctcttaaatctgtctatatctgtgtattcgtatgtatctcatatatatgtgcatatatgtgtagatacttttaggcagaaatcaacatgcataacagaaactcgttctcctcctctacccacatttactgctgaacagccaaaattttagactccatttagtttcagactcttatcagaatgacctagccagccagcaccttcttataaattctatgtacaagatactttgtggtgatctaactccttagctacattttcaccattttatcttgctatgacactctatgttcttgccatattgaactacgtatagatccttgaacaagcactttattattaataagattttctctccttggaatgtctctcaggcccccttcatttataggttgttgcgggaagtcagggaccccaaatggagggactggctggagctgcagcagaggaacatagattgtgaagatttcatggacatttatcagttcccaaataatacttttataatttcttatgcctgtctttactttaatctcttaatcctgttatctttctaagctgaggatgtacgtcacctcaggaccactgaggtgttacctgtacaaattgattgtaaaacctgtgtttgaacactataaaatcagcgcaccttgaaaaagaacagtgatttttagggaacaagggaagacaaccataaggtctgactgcctgcagggatcataatgtaaaaatatctagtaaacaattgtaaaaagaaaattataaagggaaattctaaaactgctgaattgttatcatttcaatgaacaaactgtagttttatatgatactttactttcaaattttaatcagctatcatttgaaacaaatgcaaacacatgtgtccaacacaaaaacaaaagttggaatcagctgcttcatgtatttgcaatatatgtgtcccttt

SEQ ID NO: 459682 - DNA, 1254 bp, Homo sapiens
tggagctgatggatgagtttggcatttttcttttcaatttttttttttttgagctgagggggagaacttcttccccttctagaatgtaaagctccctgaggggaggacttgtggattctgttcactgctatattcctagcacctagaacaatgccaggcacatgacaagctttcaataaatacgtgttgaataaataaatatatagagagacataattttagtggcaaaatgaagactagactctattattattattattttgagacagagtctcactctgttgcccagactggacggcagctgggcaacaagagcgaaactccatctcaaaaaaaaaaaaaaagagtattagcatgcttttacattcccttcacgcttatatgttgactttatttgcctctttttgttttaattaattttaatatacaaccttttattttggaataattttagatttacaaagaagttgcaaaacagtaaagagagttcctgtatacccctcatccagttttagcttcccctgatgttatcatcttacattgttgtggtacatttgtcaaaactaaggaaccatcattgctatattactatttaactcaactccagatttcatttggatttcaccagctttccctttactgtcttttttttctattctaggacctagtccagggcaccacattgcatttgaaatcttacgctaactgctatcgtcttacagaaagttctcaagacttacggctgctaacaccttctctcattttccagtactaatgtacccttttcttcagaataattcaccgtcagatatggcagaccagggggagaagaaggagcctgaggaaatggaaggaaagaaaggtgacaaaaaagagacaaattcagaagatgattatgtcaaagtgaaggaattagattttaaaaaaaggaaagcagcagcaaatacacagaaggaaatgggcaatgccacatactgtgacaagcagtatgaatgtacaggtgacaagagcacacagaagtactgctgtcttagacctgaggttgcagatgacttctcagaagaagtgatatctgagctaaagtttagaagagggataggaattaagaaaaatcctgaagtatcagaatccaaggagagttataagacaaaagcaggagctgcagaatataaaactggcacagctccctttctttttaggtagagctgatgtgaggacattttacacatgttacttagttatcttatttcctcc

SEQ ID NO: 459683 - DNA, 6142 bp, Homo sapiens
tccagaatagggaaatccagagagatagaaagtggatttatggctgcctagggctggagctgggacctgttctgggagtgagtgccacatggttaaatcggtgctgagagaaccttagccatcccaagcattgatgaaagaatcattgttaccagggggagtgggtttgctgacctgtaaccactcaaacctttccctgccctgactgtggggcagtgactcagagctggaactgtgttcctgcctggttgccagattttgtgtggggggtggagaggaacgagaatgaatgagcaggaacaagtggctgctggatttgtaacaccttgggaggcagctgctcaagaaccgaaattgagagacagcaggcaggctgggagtctccctccctgtctgacctgaacctaagatttaataaggtggtgcagctggggaagacactatccgaacgtggagcccaaagggagggtgagtgtgtcccctgccttttccggtgggctctggcacctgagctggaaattcttgggcttttcttagtgtggcggggttctgacagactaagtgtgtctcagaggaaaggcccacatttctccccctgtgaaatctttgatgaccagggtcaccagacattgctgactgacctgtcgtgtctgtactccttccattcacacgaattctcatccatcttctctctttctctttagccataaccagcagaccacagcattcaggcatcctgtgacgggacagttttctccagaaaatagtgaattcattcttcaagaagagccgaatccacatatgtcgaagcaagacagaaaccaaagaccgtccagcatggtcagtgaaacatccacggctgggaccgcctccaccctggaggccaagcctggacccaagatcataaagtccagcagtaaagtccacagctttgggaagagagaccaggccattcggaggaaccccaatgttcccgtggtggtgaggggctggctgcacaagcaggacagttctgggatgaggctgtggaaaaggaggtggtttgtgcttgctgattactgcttattttactataaagacagccgagaagaagcggtcctcgggagcatccccttgcccagctacgtgatctctcctgtggcccctgaggatcgcataagccgcaaatattcctttaaggctgtgcacacggggatgcgagcgctcatctataacagctccacagcgggctctcaggccgagcagtcaggcatgaggacctactacttcagtgccgacacccaggaggacatgaacgcttgggtcagggccatgaaccaggctgcacaggtgctgtctcgatcgtcactgaagagggatatggagaaggtggagcggcaggctgtcccccaggccaaccacacagagtcctgtcatgaatgtggccgggtgggacccggacatacgagagattgtcctcatcgtggccatgatgacattgtcaacttcgagaggcaggagcaggagggagagcagtaccgttcccagagggacccactggagggcaagcgggaccggagcaaggccaggtctccgtactcgccagccgaggaggatgccttgtttatggatttacccactggcccaagaggccagcaggcacagccccaacgggcagagaagaatggaatgctgcctgcctcatatggcccaggagaacagaatgggactggtgggtaccagcgggcctttcctcccaggaccaaccctgaaaaacacagccaaaggaagagcaatctggcccaggtggagcactgggcaagggcccagaaaggggatagcaggagtcttcccttggaccagacgcttcctcgccagggtcctggccaatccctgtccttcccagaaaactaccagactcttcccaagagcacccgacacccctcggggggctcctcgccacctccccgaaacctgccaagtgactacaagtatgcgcaggaccgagccagccacctgaagatgtcgagtgaagagcgccgggcgcaccgggatggcaccgtgtggcagctctacgagtggcagcagcgccagcagttccggcacggcagccccacagcgcccatctgccttggctccccagagttcaccgaccagggccggagcaggagcatgctagaggtgccccgctccatctctgtgcctccatctccctcggacatccctcccccaggacccccaagggtcttcccaccccggcggccacacacaccagcagagcgagtcacagtgaagccaccggaccagaggaggagtgtggacatctcgctgggggattctccaaggagggcacggggccacgctgtcaagaactcatctcatgtggaccgacgttccatgccctccatgggttacatgacccacaccgtcagcgctcccagtttacatggaaaatcggctgatgatacctacctccagctgaagaaagacctggagtacctggatctaaagatgacaggccgggaccttctcaaggatcgaagtctgaagcctgtgaagatcgctgagagcgacactgacgtcaaactgagcatcttctgtgaacaagacagggtcctccaggacttggaagacaagatacgagcccttaaagagaacaaagaccagctagaatctgtgctggaggtgttgcacagacagatggagcagtaccgagaccagccccagcacttggagaagattgcctaccagcagaagttgctgcaggaggaccttgtccatatccgagctgagctctccagagagtccactgagatggaaaatgcttggaacgaatacctgaagttggagaatgatgtggaacagctgaagcagaccctgcaggagcaacacagaagagccttttttttccaggagaaatcgcagatacagaaagatctatggagaattgaagatgtcactgcaggcctgagtgcaaataaagagaacttcagaattctagtggagtcagtaaaaaatccggagagaaaaacggtgcctttgtttcctcacccgcctgtgccttcactctcaacttctgagagcaagccgcccccacagcccagtcctcccaccagccctgtgcggacccctctggaggttcgactcttcccccagctgcaaacctacgtgccgtaccgacctcacccaccccagctgaggaaagtgacatccccccttcagtcaccaactaaggcgaagcccaaagttactgtcagaactggaagagccctggaagatgatctaacccaactctcccattttgcagttgggaaaactgaggcccaccaagaagaagtgagcgtgctgagtagggtggagtttgtgatctgcagagaggtgtgtggctgtggacgaagctgtccccatgcaaacctttgtgcaaatccgcagggggctctcctgcagttacacagcctgtgggcaatttttgccaacaaaggcttggaggagacttacctgggcattgtgtgtgcctggacctctgatgaggtcagtgcacagtgctgggtaaaacacatgagttctgctgccctggtcttcaccatctacctgcttccagccatagtccagggcccagagctggacccaggatatggcccagcacccagccagagagtcactgtggatttcagcatcttgagatctccttcccaatcccagatccaagaggtggactggagctctagccctaaaacaggagagggaaaattccaaaacaaacagcaggaatgtctggggcagatggctgccaacatagggcagaatgctgccagctgggacagggcactctgtccttgttcaggtccccaccttgctgaaggcgccagagctcgtgtagggccaatgagccggctcaggctgagcactgctgagtgggtagatgttactctccagcaggaagatgaagcacctcccaggcccccactccccgaactctacagcccagaggaccagcccccggctgtgccgcctctgccaagagaggccaccatcatccggcacacatctgtgcggggcctcaagcggcagtcagacgagaggaagcgagaccgggagctggggcagtgtgtgaatggggattccagggtggagctgcggtcgtatgtcagtgagcctgagctggcgaccctcagcggggacatggcccagccctccctaggacttgtgggccctgagagcaggtaccagacgctgccaggcagagggctctcagggtccacgtcaaggctccagcagtcgtccaccattgctccctacgtcacactccggaggggtctcaatgccgaaagcagcaaggcgaccttccctagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcacacctcccagtgagagagctgtccattgacctacatggttcagagaacaccccacggggctgtttgtccacgacccaggctggacgaatgcctggtcagagggtgacctgaaccagagctggagtgaggatcaaacaggcccaggagcctgaggaaatacccagtcagtcctcccagccgcgatggagaggggcctttgcaggcgttcggaatctcggctgaattcaggacctgggaatacagggttcagagaggagaggaggaagatggtgacatgatttggttagaagcacaagcaaactgatcagcctcccagacctgccagcagatgctgtgtgagggtgatggagcacggggtcacacccctgccccaagggccactggtctccctgggcttgcagtgcagaggcctcagggtgtctgggattgctggggaggcctgtgctgccccctggtggcgcttcctggcgctgcgccctgtccacagtcaccttaggtccctttggaaacattccatttgacttttccctgttgtttgaaatcccatgtttccctaaacctctagcctgattgttctttccctaattcattgcacaagctcctttgcttttagtgttaccgctcattgcctctctaatcctgcctgattgtgtttacagaagcttctgatttgcattgaacatgctctaactggcctgtgctacttattaccgggcttgtaatagcggttcttgtctccatagcctgttgagtgttcccagatgtgactcacctttctgctgccctcttcatgcaggcctactgactcataattcacttgtcccaaaagccaccccacaagcctgagccaacctgctgcctgacgccacagtcattggcagaggtctgggcattattaatttataaaaatccatgctttacacctggacagtagacagggacttcagagattgcacgtttgaatacattctcccaagactgaggttgttcggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgcttaataataatggattggcgtggttcttccccaggataccttatagagtctagtgaacttttcctgtttgtggaaacaatcaggctgggtttaaatgaggacttgtctctatttggagcatttgtgagcgtgtaaggaaatgagtgttttctttgtgaatcattaaattgattttttcatctttgg

SEQ ID NO: 459684 - DNA, 4513 bp, Homo sapiens
tgcgactctagagtgaagcaccgcaggtagctcaatggaatgctgcctgcctcatatggcccaggagaacagaatgggactggtgggtaccagcgggcctttcctcccaggaccaaccctgaaaaacacagccaaaggaagagcaatctggcccaggtggagcactgggcaagggcccagaaaggggatagcaggagtcttcccttggaccagacgcttcctcgccagggtcctggccaatccctgtccttcccagaaaactaccagactcttcccaagagcacccgacacccctcggggggctcctcgccacctccccgaaacctgccaagtgactacaagtatgcgcaggaccgagccagccacctgaagatgtcgagtgaagagcgccgggcgcaccgggatggcaccgtgtggcagctctacgagtggcagcagcgccagcagttccggcacggcagccccacagcgcccatctgccttggctccccagagttcaccgaccagggccggagcaggagcatgctagaggtgccccgctccatctctgtgcctccatctccctcggacatccctcccccaggacccccaagggtcttcccaccccggcggccacacacaccagcagagcgagtcacagtgaagccaccggaccagaggaggagtgtggacatctcgctgggggattctccaaggagggcacggggccacgctgtcaagaactcatctcatgtggaccgacgttccatgccctccatgggttacatgacccacaccgtcagcgctcccagtttacatggaaaatcggctgatgatacctacctccagctgaagaaagacctggagtacctggatctaaagatgacaggccgggaccttctcaaggatcgaagtctgaagcctgtgaagatcgctgagagcgacactgacgtcaaactgagcatcttctgtgaacaagacagggtcctccaggacttggaagacaagatacgagcccttaaagagaacaaagaccagctagaatctgtgctggaggtgttgcacagacagatggagcagtaccgagaccagccccagcacttggagaagattgcctaccagcagaagttgctgcaggaggaccttgtccatatccgagctgagctctccagagagtccactgagatggaaaatgcttggaacgaatacctgaagttggagaatgatgtggaacagctgaagcagaccctgcaggagcaacacagaagagccttttttttccaggagaaatcgcagatacagaaagatctatggagaattgaagatgtcactgcaggcctgagtgcaaataaagagaacttcagaattctagtggagtcagtaaaaaatccggagagaaaaacggtgcctttgtttcctcacccgcctgtgccttcactctcaacttctgagagcaagccgcccccacagcccagtcctcccaccagccctgtgcggacccctctggaggttcgactcttcccccagctgcaaacctacgtgccgtaccgacctcacccaccccagctgaggaaagtgacatccccccttcagtcaccaactaaggcgaagcccaaagttactgtcagaactggaagagccctggaagatgatctaacccaactctcccattttgcagttgggaaaactgaggcccaccaagaagaagtgagcgtgctgagtagggtggagtttgtgatctgcagagaggtgtgtggctgtggacgaagctgtccccatgcaaacctttgtgcaaatccgcagggggctctcctgcagttacacagcctgtgggcaatttttgccaacaaaggcttggaggagacttacctgggcattgtgtgtgcctggacctctgatgaggtcagtgcacagtgctgggtaaaacacatgagttctgctgccctggtcttcaccatctacctgcttccagccatagtccagggcccagagctggacccaggatatggcccagcacccagccagagagtcactgtggatttcagcatcttgagatctccttcccaatcccagatccaagaggtggactggagctctagccctaaaacaggagagggaaaattccaaaacaaacagcaggaatgtctggggcagatggctgccaacatagggcagaatgctgccagctgggacagggcactctgtccttgttcaggtccccaccttgctgaaggcgccagagctcgtgtagggccaatgagccggctcaggctgagcactgctgagtgggtagatgttactctccagcaggaagatgaagcacctcccaggcccccactccccgaactctacagcccagaggaccagcccccggctgtgccgcctctgccaagagaggccaccatcatccggcacacatctgtgcggggcctcaagcggcagtcagacgagaggaagcgagaccgggagctggggcagtgtgtgaatggggattccagggtggagctgcggtcgtatgtcagtgagcctgagctggcgaccctcagcggggacatggcccagccctccctaggacttgtgggccctgagagcaggtaccagacgctgccaggcagagggctctcagggtccacgtcaaggctccagcagtcgtccaccattgctccctacgtcacactccggaggggtctcaatgccgaaagcagcaaggcgaccttccctagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcacacctcccagtgagagagctgtccattgacctacatggttcagagaacaccccacggggctgtttgtccacgacccaggctggacgaatgcctggtcagagggtgacctgaaccagagctggagtgaggatcaaacaggcccaggagcctgaggaaatacccagtcagtcctcccagccgcgatggagaggggcctttgcaggcgttcggaatctcggctgaattcaggacctgggaatacagggttcagagaggagaggaggaagatggtgacatgatttggttagaagcacaagcaaactgatcagcctcccagacctgccagcagatgctgtgtgagggtgatggagcacggggtcacacccctgccccaagggccactggtctccctgggcttgcagtgcagaggcctcagggtgtctgggattgctggggaggcctgtgctgccccctggtggcgcttcctggcgctgcgccctgtccacagtcaccttaggtccctttggaaacattccatttgacttttccctgttgtttgaaatcccatgtttccctaaacctctagcctgattgttctttccctaattcattgcacaagctcctttgcttttagtgttaccgctcattgcctctctaatcctgcctgattgtgtttacagaagcttctgatttgcattgaacatgctctaactggcctgtgctacttattaccgggcttgtaatagcggttcttgtctccatagcctgttgagtgttcccagatgtgactcacctttctgctgccctcttcatgcaggcctactgactcataattcacttgtcccaaaagccaccccacaagcctgagccaacctgctgcctgacgccacagtcattggcagaggtctgggcattattaatttataaaaatccatgctttacacctggacagtagacagggacttcagagattgcacgtttgaatacattctcccaagactgaggttgttcggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgcttaataataatggattggcgtggttcttccccaggataccttatagagtctagtgaacttttcctgtttgtggaaacaatcaggctgggtttaaatgaggacttgtctctatttggagcatttgtgagcgtgtaaggaaatgagtgttttctttgtgaatcattaaattgattttttcatctttgg

SEQ ID NO: 459685 - DNA, 378 bp, Homo sapiens
gttgcagtgagccgagatcatgctcttgactccagcttgggcaacaagagcgaaactccgtctcaaaaaaaaaaataaataaataaaaagaatgggtagagctttgcctgtgtgtgggttgggggaggatggacattacaaggggaggaaacaacttggctgaagttctggaagcagtgggacagatgagcccagggaaactgcccagaaggttgttctgatgcatttttccattcaaagacagccgagaagaagcggtcctcgggagcatccccttgcccagctacgtgatctctcctgtggcccctgaggatcgcataagccgcaaatattcctttaaggtactgcccctgcacctctaatgcagccattctgtct

SEQ ID NO: 459686 - DNA, 479 bp, Homo sapiens
actccttccattcacacgaattctcatccatcttctctctttctctttagccataaccagcagaccacagcattcaggcatcctgtgacgggacagttttctccagaaaatagtgaattcattcttcaagaagagtaagtctttttatgtattctccttatctgggcagagtatgggagactaaaggcatttgctgaaaacaaaacttactggactgttttctctgagacagaggggcttggggtgagtgggttggttgattcaaacaggaatatgagaagaattttatttttcaaccttcacacttctttcagtggcaagatatggaagaggagagttgatacagggatgtgctatgatgggtattgtcagagcctctttaaagttccctttcccctgaatgaaccctttctcctgctatatcttctggcacattagccctgtttgaagaggacccactcatctgggtgaaaatatag

SEQ ID NO: 459687 - DNA, 5213 bp, Homo sapiens
ggcttcacggaggagggcgccagctacttcatcgagccgaatccacatatgtcgaagcaagacagaaaccaaagaccgtccagcatggtcagtgaaacatccacggctgggaccgcctccaccctggaggccaagcctggacccaagatcataaagtccagcagtaaagtccacagctttgggaagagagaccaggccattcggaggaaccccaatgttcccgtggtggtgaggggctggctgcacaagcaggacagttctgggatgaggctgtggaaaaggaggtggtttgtgcttgctgattactgcttattttactataaagacagccgagaagaagcggtcctcgggagcatccccttgcccagctacgtgatctctcctgtggcccctgaggatcgcataagccgcaaatattcctttaagggatatggagaaggtggagcggcaggctgtcccccaggccaaccacacagagtcctgtcatgaatgtggccgggtgggacccggacatacgagagattgtcctcatcgtggccatgatgacattgtcaacttcgagaggcaggagcaggagggagagcagtaccgttcccagagggacccactggagggcaagcgggaccggagcaaggccaggtctccgtactcgccagccgaggaggatgccttgtttatggatttacccactggcccaagaggccagcaggcacagccccaacgggcagagaagaatggaatgctgcctgcctcatatggcccaggagaacagaatgggactggtgggtaccagcgggcctttcctcccaggaccaaccctgaaaaacacagccaaaggaagagcaatctggcccaggtggagcactgggcaagggcccagaaaggggatagcaggagtcttcccttggaccagacgcttcctcgccagggtcctggccaatccctgtccttcccagaaaactaccagactcttcccaagagcacccgacacccctcggggggctcctcgccacctccccgaaacctgccaagtgactacaagtatgcgcaggaccgagccagccacctgaagatgtcgagtgaagagcgccgggcgcaccgggatggcaccgtgtggcagctctacgagtggcagcagcgccagcagttccggcacggcagccccacagcgcccatctgccttggctccccagagttcaccgaccagggccggagcaggagcatgctagaggtgccccgctccatctctgtgcctccatctccctcggacatccctcccccaggacccccaagggtcttcccaccccggcggccacacacaccagcagagcgagtcacagtgaagccaccggaccagaggaggagtgtggacatctcgctgggggattctccaaggagggcacggggccacgctgtcaagaactcatctcatgtggaccgacgttccatgccctccatgggttacatgacccacaccgtcagcgctcccagtttacatggaaaatcggctgatgatacctacctccagctgaagaaagacctggagtacctggatctaaagatgacaggccgggaccttctcaaggatcgaagtctgaagcctgtgaagatcgctgagagcgacactgacgtcaaactgagcatcttctgtgaacaagacagggtcctccaggacttggaagacaagatacgagcccttaaagagaacaaagaccagctagaatctgtgctggaggtgttgcacagacagatggagcagtaccgagaccagccccagcacttggagaagattgcctaccagcagaagttgctgcaggaggaccttgtccatatccgagctgagctctccagagagtccactgagatggaaaatgcttggaacgaatacctgaagttggagaatgatgtggaacagctgaagcagaccctgcaggagcaacacagaagagccttttttttccaggagaaatcgcagatacagaaagatctatggagaattgaagatgtcactgcaggcctgagtgcaaataaagagaacttcagaattctagtggagtcagtaaaaaatccggagagaaaaacggtgcctttgtttcctcacccgcctgtgccttcactctcaacttctgagagcaagccgcccccacagcccagtcctcccaccagccctgtgcggacccctctggaggttcgactcttcccccagctgcaaacctacgtgccgtaccgacctcacccaccccagctgaggaaagtgacatccccccttcagtcaccaactaaggcgaagcccaaagttactgtcagaactggaagagccctggaagatgatctaacccaactctcccattttgcagttgggaaaactgaggcccaccaagaagaagtgagcgtgctgagtagggtggagtttgtgatctgcagagaggtgtgtggctgtggacgaagctgtccccatgcaaacctttgtgcaaatccgcagggggctctcctgcagttacacagcctgtgggcaatttttgccaacaaaggcttggaggagacttacctgggcattgtgtgtgcctggacctctgatgaggtcagtgcacagtgctgggtaaaacacatgagttctgctgccctggtcttcaccatctacctgcttccagccatagtccagggcccagagctggacccaggatatggcccagcacccagccagagagtcactgtggatttcagcatcttgagatctccttcccaatcccagatccaagaggtggactggagctctagccctaaaacaggagagggaaaattccaaaacaaacagcaggaatgtctggggcagatggctgccaacatagggcagaatgctgccagctgggacagggcactctgtccttgttcaggtccccaccttgctgaaggcgccagagctcgtgtagggccaatgagccggctcaggctgagcactgctgagtgggtagatgttactctccagcaggaagatgaagcacctcccaggcccccactccccgaactctacagcccagaggaccagcccccggctgtgccgcctctgccaagagaggccaccatcatccggcacacatctgtgcggggcctcaagcggcagtcagacgagaggaagcgagaccgggagctggggcagtgtgtgaatggggattccagggtggagctgcggtcgtatgtcagtgagcctgagctggcgaccctcagcggggacatggcccagccctccctaggacttgtgggccctgagagcaggtaccagacgctgccaggcagagggctctcagggtccacgtcaaggctccagcagtcgtccaccattgctccctacgtcacactccggaggggtctcaatgccgaaagcagcaaggcgaccttccctagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcacacctcccagtgagagagctgtccattgacctacatggttcagagaacaccccacggggctgtttgtccacgacccaggctggacgaatgcctggtcagagggtgacctgaaccagagctggagtgaggatcaaacaggcccaggagcctgaggaaatacccagtcagtcctcccagccgcgatggagaggggcctttgcaggcgttcggaatctcggctgaattcaggacctgggaatacagggttcagagaggagaggaggaagatggtgacatgatttggttagaagcacaagcaaactgatcagcctcccagacctgccagcagatgctgtgtgagggtgatggagcacggggtcacacccctgccccaagggccactggtctccctgggcttgcagtgcagaggcctcagggtgtctgggattgctggggaggcctgtgctgccccctggtggcgcttcctggcgctgcgccctgtccacagtcaccttaggtccctttggaaacattccatttgacttttccctgttgtttgaaatcccatgtttccctaaacctctagcctgattgttctttccctaattcattgcacaagctcctttgcttttagtgttaccgctcattgcctctctaatcctgcctgattgtgtttacagaagcttctgatttgcattgaacatgctctaactggcctgtgctacttattaccgggcttgtaatagcggttcttgtctccatagcctgttgagtgttcccagatgtgactcacctttctgctgccctcttcatgcaggcctactgactcataattcacttgtcccaaaagccaccccacaagcctgagccaacctgctgcctgacgccacagtcattggcagaggtctgggcattattaatttataaaaatccatgctttacacctggacagtagacagggacttcagagattgcacgtttgaatacattctcccaagactgaggttgttcggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgcttaataataatggattggcgtggttcttccccaggataccttatagagtctagtgaacttttcctgtttgtggaaacaatcaggctgggtttaaatgaggacttgtctctatttggagcatttgtgagcgtgtaaggaaatgagtgttttctttgtgaatcattaaattgattttttcatctttgg

SEQ ID NO: 459688 - DNA, 307 bp, Homo sapiens
ggcttcacggaggagggcgccagctacttcatcgagccgaatccacatatgtcgaagcaagacagaaaccaaagaccgtccagcatggtcagtgaaacatccacggctgggaccgcctccaccctggaggccaagcctggacccaagatcataaagtccagcagtaaagtccacagctttgggaagagagaccaggccattcggaggaaccccaatgttcccgtggtggtgaggggctggctgcacaagcaggtgaggaagccgaggagtgagaatcctggaggaaatggctctggctgagttttct

SEQ ID NO: 459689 - DNA, 651 bp, Homo sapiens
cttttcttgtacagcttaaattttcggatcccaataatgtacctatggtgaacaagttgttgcaactggagctcaatgatgaatttataggaaattatactacggacgagaatggcgaagctcaattttccattgacacttcagacatatttgatccagagttcaacctaaaagccacatatgttcgacctaagagctgctatcttcccagctggttgacgcctcagtacttggatgctcacttcttagtctcacgcttttactcccgaacgaacagcttcctgaagattgttccagaaccaaagcagcttgaatgtaatcaccagaaggttgttactgtgcattactccctaaacagtgaagcatatgaggatgattccaatgtaaagttcttctatttgatgatggtaaaaggagctatcttactcagtggacaaaaggaaatcagaaacaaaggtatacataatgtattcattttaaaatatgtgctctaacttcattttttcttgttaaggatatatagacattatatatatggggattatatatattaagaaaatatatttatatatagtcaaacatatatgtgtgtgtgtatatatatatgtgtgtatatatgtatgtgtatatatatatagtgaaaagaagaac

SEQ ID NO: 459690 - DNA, 1904 bp, Homo sapiens
gcagggggcgcgtggtcaagagccgccctcgacctggcctggtcggtcctggcccggcgtaggtgacgatggcggggaccgcgaggcgccggacacccgaggccacgagcagcgtcgcccctcgctttttcgcgcccctccagccctgcagtccttcctctaagtccgtctgcccctcaccgattgaaagtggccccgagaatattggatgacctactgatgtgttgacagagtgatctggtgtcaggactgtaaaatacgcctatgaaaactgggggagaggaataaaacaagctggcagaacgtttttcatcgttgaagctgcgtgatgcgagcatatgtgctcatcatacagtctctttacttgtgtatctgaaattttccataataaaaagtttaaagaagtgaaccagcgattgcctctagggaggacaagtcttgctctgtcgcccaggctggaatgtagtggaggttgcagtgagccaagatcacaccattgcactccagtctgggcaacaagagcaaaactttttctcaaaaatactaataagttatgttcaactcttctatatctttaataatttcttttgtctgcttgacctataatggcaaaacatgcatgaaaacctcccactataagagtaatctttttcatttctccctgtagttctatttttctttctgcattttgaggctattttattgggcacatactgtacaagttagaattgctatctcttcctggtagaattgaaagcttttaaagtaatatgggagataaattgcaaaaattgcctgaattttccactcactcctccctgtagccacaccttttgcaatgtgacttggcagctcctcccagaatctcagctggattttaactcaccttggcctaaagaaaatgacagaagtgataaagtcctcagcctgagccttaagaaaccttaaacgcttccacattctctttgggatccctgcttctgccatgagaacagggctgggctaaatcaagacggtgcctgatgccctacctagcccctctccagcacacaggagccccgggcccttggcaatcatgtctgcgcagcttggaccccatatccaaaaggggagcacgccccaatttactctcaccccaccagggacacccgaccccgcgtggtccgggctacccaaggacgtcccgaggcgtggcggagactttggcggctgagtgcaggccgggctgcggcccagcgggacctgggcgaggcctgcgacctgggcggggccagggttgggctctgccagagctgcgccgcagccgccctgcccgggcctccccgcccccacctgtgacctggattccgcggttcctgcgcgggggtggagggcgtaaaggacacgcgcaaataaaggtctgtggcccaggaaaacttcaagtcctgaaatcggtgcaccaaggatactttaaggcgaggggtcggggctgtgtaatcatttacccggttcgtccgtgtacaccggcctctctagcttacaccaacacatgtttactggggcttagcaaccgcagccatggcagccccaacgacgtgaacatccgcacctctgagcctccccctgagaagtaccttcgaggtgaggcctgcgcagccccaggaagagggtgtgggcgcaaacctgaggtggggagcaaggcccgccggctacacggttcctgccatcctcgctgcgccctttctcccatgctcgcggcctccatccggcagaaactggcacagcaaacccgacagccacagacctgtggccccttccttccctcctcgcctcctcggcaacccttgaaagcactcgagtacgaagttataattgcaattataattagctgagtccaacttgggcttccccaggtcttggcttcc

SEQ ID NO: 459691 - DNA, 1983 bp, Homo sapiens
gcagggggcgcgtggtcaagagccgccctcgacctggcctggtcggtcctggcccggcgtaggtgacgatggcggggaccgcgaggcgccggacacccgaggccacgagcagcgtcgcccctcgctttttcgcgcccctccagccctgcagtccttcctctaagtccgtctgcccctcaccgattgaaagtggccccgagaatattggatggtattgagcaattatcattaactttgttgggtgtggtaacggtaatgtggttatggttttttgtttttttttttttaagacctactgatgtgttgacagagtgatctggtgtcaggactgtaaaatacgcctatgaaaactgggggagaggaataaaacaagctggcagaacgtttttcatcgttgaagctgcgtgatgcgagcatatgtgctcatcatacagtctctttacttgtgtatctgaaattttccataataaaaagtttaaagaagtgaaccagcgattgcctctagggaggacaagtcttgctctgtcgcccaggctggaatgtagtggaggttgcagtgagccaagatcacaccattgcactccagtctgggcaacaagagcaaaactttttctcaaaaatactaataagttatgttcaactcttctatatctttaataatttcttttgtctgcttgacctataatggcaaaacatgcatgaaaacctcccactataagagtaatctttttcatttctccctgtagttctatttttctttctgcattttgaggctattttattgggcacatactgtacaagttagaattgctatctcttcctggtagaattgaaagcttttaaagtaatatgggagataaattgcaaaaattgcctgaattttccactcactcctccctgtagccacaccttttgcaatgtgacttggcagctcctcccagaatctcagctggattttaactcaccttggcctaaagaaaatgacagaagtgataaagtcctcagcctgagccttaagaaaccttaaacgcttccacattctctttgggatccctgcttctgccatgagaacagggctgggctaaatcaagacggtgcctgatgccctacctagcccctctccagcacacaggagccccgggcccttggcaatcatgtctgcgcagcttggaccccatatccaaaaggggagcacgccccaatttactctcaccccaccagggacacccgaccccgcgtggtccgggctacccaaggacgtcccgaggcgtggcggagactttggcggctgagtgcaggccgggctgcggcccagcgggacctgggcgaggcctgcgacctgggcggggccagggttgggctctgccagagctgcgccgcagccgccctgcccgggcctccccgcccccacctgtgacctggattccgcggttcctgcgcgggggtggagggcgtaaaggacacgcgcaaataaaggtctgtggcccaggaaaacttcaagtcctgaaatcggtgcaccaaggatactttaaggcgaggggtcggggctgtgtaatcatttacccggttcgtccgtgtacaccggcctctctagcttacaccaacacatgtttactggggcttagcaaccgcagccatggcagccccaacgacgtgaacatccgcacctctgagcctccccctgagaagtaccttcgaggtgaggcctgcgcagccccaggaagagggtgtgggcgcaaacctgaggtggggagcaaggcccgccggctacacggttcctgccatcctcgctgcgccctttctcccatgctcgcggcctccatccggcagaaactggcacagcaaacccgacagccacagacctgtggccccttccttccctcctcgcctcctcggcaacccttgaaagcactcgagtacgaagttataattgcaattataattagctgagtccaacttgggcttccccaggtcttggcttcc

SEQ ID NO: 459692 - DNA, 1262 bp, Homo sapiens
ctagggatcatcaacttacaatgaatgatgctaaaattactgaaaccaaatctgcctcgcgcagtgtctgggattcatagaaccctcttccccccgctcctgaatcagactgggcaggctccaaagcagtggagtctggcgctactcccaccgccacctcgtggatctcagaaaggctccaaacaccgcaccctcagctggccctgcttggggctggcattgggggacagcgtgttccgggcgcctcttctcctctgtgctagggccttcgcctttgctggctgcccactcatagatgtcagagccgcaggaaggctccgcagaagccctgtgcgggccctgcctggggctggctttggtgcacatgcgacaggccagcgtggtattcaaaaattatatattcattttatgtttttgaaaataacacacatattcaaactagcacgtgtaatagagaaatttcctaaaatttgtacactgagtaaaccatatttttctaatgatttcgttgatagagcagctttctagatgcagccctgttcacatgtgactggtatttaccttctttcatcaaacatgtctttagaatcgactcaaggcaagatgcagtagagaaatgtaagagccaactagaggagccatttaactactaggtgcatcttctccagcaagttcttcagcatcctttccagaagcattcgacagccaaggaagcaggctacgcctcacctactccttcctgggctaaagatctcagacttagttgcttaatttgggaaaaataaattaaagaagtcttctatcattatacgcaacatagaataatctgtttaagaaattatttttgatcctccacattttgatgccaatcccacatttggtaataatgattatatatgcaaatatttttagccgattaaattggaacatattctttgaaacaacttcatgatgatttttgttctaatcatttcatgtttgttgaccacttccctcttttgattgttcatttttgtaaaatgtcacatgctagcttcttatgaagttttaaattttgttaacaagcagtggtgttgaatttcatcaaaagcctttttgatatttattgaaataattatttgatttttctcctatgagtttttccaataaaaaatgatactgattgaacaataggttaaaattaaagtttcatcaaagaccgccagaatataatagctctgaaagtccaaatcaccatacgtaggttttcatagcaaatatcc

SEQ ID NO: 459693 - DNA, 861 bp, Homo sapiens
actatattaaaattactgtaacccaatgtgcttcatgcactatctggcatccaaaggatcctctttcgcccatgttggggttttcgaaactggaaagaagactgatttctgcagagcagctttctagatgcagccctgttcacatgtgactggtatttaccttctttcatcaaacatgtctttagaatcgactcaaggcaagatgcagtagagaaatgtaagagccaactagaggagccatttaactactaggtgcatcttctccagcaagttcttcagcatcctttccagaagcattcgacagccaaggaagcaggctacgcctcacctactccttcctgggctaaagatctcagacttagttgcttaatttgggaaaaataaattaaagaagtcttctatcattatacgcaacatagaataatctgtttaagaaattatttttgatcctccacattttgatgccaatcccacatttggtaataatgattatatatgcaaatatttttagccgattaaattggaacatattctttgaaacaacttcatgatgatttttgttctaatcatttcatgtttgttgaccacttccctcttttgattgttcatttttgtaaaatgtcacatgctagcttcttatgaagttttaaattttgttaacaagcagtggtgttgaatttcatcaaaagcctttttgatatttattgaaataattatttgatttttctcctatgagtttttccaataaaaaatgatactgattgaacaataggttaaaattaaagtttcatcaaagaccgccagaatataatagctctgaaagtccaaatcaccatacgtaggttttcatagcaaatatcc

SEQ ID NO: 459694 - DNA, 2066 bp, Homo sapiens
gggaaggacatcctgacaggaaagggggcaaaaatgggatacagaggatgctgggtaacttttaaatccagcagttatgaggatttgggaaagattccctgggtagtggtaatgtcgcatgaattcccttacatctggaggcatttcagaggagatgggaacctgggaaggaccaggttaattcagaattggtggactagaagaaaagtacgacaagaacatggacctgaaaggaaaataagtttcccacaatgggaaaaggactataaccttcagccgatgaatgcctatggactcttcgatgaatacttagaaatgattcttcagtttggattcacaactatctttgtggcagcttttcccctagcaccacttctggccttactgaataacataattgaaattcgacttgatgcttacaaatttgtcacacagtggaggagacctttagcttcaagggccaaagacataggaatttggtatggaattcttgaaggcattggaattctctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaattccatgtcaccaacaacacagacaagaccctgtttacaactttttctttccttttttttaattttagacctttctgagaagattattatatatgacatatctatagctatgtgtatggccatagatgtatttctgtgtgtacatatgtatagtcatgtattcctgcatatgtacatacaaatacagagatatataaagtacatagaaattccttacttgtaaatagccaaaaagtactgacatgagtgaattttcacatttaaatagtcatcaatatgaagccatgattaatgcttgtataatgtgatgcaataaaatttaaaataaatttctgcacatggaatattttcagctggctcttctgacattctgttgtatttttgtctcatagaataagagaaatcacagaataagtaagtggaatctttaatgtgaggagaatatctgagggactgtgcaagaaatcagatgtttgtttattgcataaatgcatgcaaaaacaaacaatatagccaaatatcagcgtatgtttctgatgaacttttttccccagtcttgatggtggaatattttaaatataagccaaaatgaatatgcc

SEQ ID NO: 459695 - DNA, 696 bp, Homo sapiens
agccttcgggacttggggttgcaatgaatcttaggttttttccaggagtcttttattcctccagcgtctccgtgcgcctgtccgctccaacacctgacattttccttcaactccaccctcccctccccgagtccacagacacacacccacccacacgcctcttcccttcccctccaccctcagtcagcggcagagtcagtccatccaataggcaggagcccaaaagactgtccacggacagctctgctccatttcctgtggtctattcttgcacagttaggtctacaagccaggttcaaggccaccaactgaggcacctgtcccgagacaggaccattctaatctgccctgaaaaggacatcccattgatcatactaaatttgtggatggatacctatctgttgaccagaccctccctcttcaatgaaaactgcctctccttccactccatctgtgaggcacccttggatgctgacatgtgcttacataggacttcctgtccacagccagaattagccagaattcactgacccatggttggactcctaaaatactcaagatgagagacatgttacttttctttactatagtaactatcaaatgcatcccataaccttatgttgtaaatgtcaaatatgcacaataaaatttatttgaaaaaataaagctggaaaattgaaagtaatgaatgttcag

SEQ ID NO: 459696 - DNA, 850 bp, Homo sapiens
  misc_feature (780)..(780): n is a, c, g, or t
  misc_feature (783)..(783): n is a, c, g, or t
agcggggggttgggtaatttttttcttctgtagatacggagtctccctgcgttgcccaggctgatctagaactcttgggctcaagcctaccgcactcctgagctcaagccgcggcctcccgaagtgctgggattacagatgtgagccactgcgcctggccagtttcatccttttatcctgtaatctgtcaccatgaccctgacaaaaggttccttcacctactccagtggggaggaatatcgtggcgagtggaaggagggccgcaggcatggttttggtcaactgatgtttgcagatggtggcacctacctgggtcattttgagaatgggctctttaatggctttggggtattgaccttctcagatggttcaaggtatgagggggagtttgcccagggcaagtttaatggcgtcggagtcttcattcgatatgacaacatgacctttgagggggaatttaaaaatggcagagtagatggttttggcctgctgactttccctgatggttctcatggaatcccccgcaatgaaggtctctttgagaacaacaagctgctgcgacgtgagaagtgttctgccattgttcagcgggcccagagcgcctccaagtcagccagaaatctcactgcctgacagcgcagtgggcaccagctgataagtattgggtaaagccagtgcccctgttgttgattcgaggtgaacaaatgaatcagagctgagatgagttgacaatgacagtggagcagaggccttgtatgtgccctgtcacctgccattccnaanggggcccgaaatgtggggatggtggcacgaccgcacagctaggggttgattcctacctttggtggga

SEQ ID NO: 459697 - DNA, 2460 bp, Homo sapiens
agcggggggttgggtaatttttttcttctgtagatacggagtctccctgcgttgcccaggctgatctagaactcttgggctcaagcctaccgcactcctgagctcaagccgcggcctcccgaagtgctgggattacagatgtgagccactgcgcctggccagtttcatccttttatcctgtaatctgtcaccatgaccctgacaaaaggttccttcacctactccagtggggaggaatatcgtggcgagtggaaggagggccgcaggcatggttttggtcaactgatgtttgcagatggtggcacctacctgggtcattttgagaatgggctctttaatggctttggggtattgaccttctcagatggttcaaggtatgagggggagtttgcccagggcaagtttaatggcgtcggagtcttcattcgatatgacaacatgacctttgagggggaatttaaaaatggcagagtagatggttttggcctgctgactttccctgatggttctcatggaatcccccgcaatgaaggtctctttgagaacaacaagctgctgcgacgtgagaagtgttctgccattgttcagcgggcccagagcgcctccaagtcagccagaaatctcactgcctgacagcgcagtgggcaccagctgataagtattgggtaaagccagtgcccctgttgttgattcgaggtgaacaaatgaatcagagctgagatgagttgacaatgacagtggagcagaggccttgtatgtgccctgtcacctgccattccagaactggaccacagaaaagtgctgaggatgctggccagcagaccctgcagcagtcattggtggttctgtctttccctaacccttatgtgctggaggacagaggagccacctcttctcactggttgatactctgttcctaagacctcaggttacccagtgtagcctgctgtgacccttctgcttcattttctgccaagtgatacagaaccttcgttctgctgctttggggacaggtgatcctagccccagcttagggccagtgctctgtgccactctggagaaatagggaaaagataggggtggctcagtacagcagccctgtgaaagtcaaggccagagcttttcttttttaatttttttattattattattattattttattttttatttttgagatggagttttactctcgcccaggctagagtgcagtggcatgatctcagctcactgcaacttctgcctcccaggttcaagcaattcccctgcctcagcttcctgagtagctgggactacaggagcgcgccaccacacccagctaatttttgtatttttttttagtagagacggggtttcaccatattggccaggctggtctcaaactcctgacctcgtgatccacccgccttggtctcccaaagtgctgggattacaggcgtgagccaccacgctcagcctttaattttattattataaaaaattgagccagggtcttgctatgtggctcaggctcatctcaaaatcctgggctcaagtgatcctcctgcctgggcctgccaaagtgctaggattgcaggtgtgagccactgtgcctggctggcagagcttttccatatgttactcctcatgctggttggaatcatggctgcaggcttccacttggtctgatcagactggtattcattcctgcctatgtccccgtgaaggattcggtaagagtgctatttcctcctccctttagaagacaggctgtcttctttcatcaacttagagcagataatccccatgtgtgcctctctccttccttagatggggaacaggatccctttttgggacaatcaagaaaaaaactcatgtaaacagtaatcttattacttgtatttgtgactaactccagggaaaagggtagaatatttaggccacttcaggcactaccatggagtgaactgaattcatacggatggcttgggctgacacagtttcttcccagtggaccaataaatcagactcacccgaacccctggggttttggtagaattggacctactctaggactgtggggaactaaaggagcatttggctcactgtagctcttctatcatgagccttgaccgtcaggccgcaatcagaccttactgatgggatctctgcagtttattacgtaggcctcccgttaccctggtacccaaatacgtcccccacctctagctccctagcctcacattgaatgtctcttcaacagcagattgtggtggaagttatagccgtgtgcctctatttattctctgaattgtactgtagaaaaaggtgtttataaagaataaagaaatcaccagaactgcctatacctagttttcctgactttctggccctgcgtcttcatgaatatcaacccatttgctgtttgtaaaagttaatcgggttagcccttggaactgaccctgcacactttatcaagtcat

SEQ ID NO: 459698 - DNA, 848 bp, Homo sapiens
atctagacctcaataatcaactgatgcctggctcttgtggcccaggcgcgttacaatttacaaagctgcctctctgaagctggatttaggatctgccttaaactccgcggcggggcccttgacagcagtggggactggagcaagatcagagccgctcgcgttgatggtcactgttgcttcgggcgcaggtttggttttctttggggttgccatttcaactagacggcctctgggtaggccagatctggatcctctgtctttatctgcgttgcagaggtgggaccacccctctttcacatagtcagcccgggttcgcaaacactcggccccgcacaaagatggcgtggagccgggctgggccaatgcggagtggcgttgctcccggttgcctaggtaacagccaatgggcagcgggaattgtacccagtgcggtcgcccaggatggcggcgtcaagtggggcaatcgctggtggaggtggcggagagcaaggtggcagccgggagcccatcagaggaaaagtccgaggcgctggaaccctgcgtccaggcgtgacggtcatcccgaaaggccggccccagtttcatccttttatcctgtaatctgtcaccatgaccctgacaaaaggttccttcacctactccagtggggaggaatatcgtggcgagtggaaggagggtgagaaggacccctggggagtatccatgatgaacacttcatttgctggaggacaaatacatcaggatatatagccaactttatggatcttcattttcaactccaggatttaattccatatagtgcctgccattcctttattccattttaggattaaataaaggaatttgaa

SEQ ID NO: 459699 - DNA, 2877 bp, Homo sapiens
atctagacctcaataatcaactgatgcctggctcttgtggcccaggcgcgttacaatttacaaagctgcctctctgaagctggatttaggatctgccttaaactccgcggcggggcccttgacagcagtggggactggagcaagatcagagccgctcgcgttgatggtcactgttgcttcgggcgcaggtttggttttctttggggttgccatttcaactagacggcctctgggtaggccagatctggatcctctgtctttatctgcgttgcagaggtgggaccacccctctttcacatagtcagcccgggttcgcaaacactcggccccgcacaaagatggcgtggagccgggctgggccaatgcggagtggcgttgctcccggttgcctaggtaacagccaatgggcagcgggaattgtacccagtgcggtcgcccaggatggcggcgtcaagtggggcaatcgctggtggaggtggcggagagcaaggtggcagccgggagcccatcagaggaaaagtccgaggcgctggaaccctgcgtccaggcgtgacggtcatcccgaaaggccggccccagtttcatccttttatcctgtaatctgtcaccatgaccctgacaaaaggttccttcacctactccagtggggaggaatatcgtggcgagtggaaggagggccgcaggcatggttttggtcaactgatgtttgcagatggtggcacctacctgggtcattttgagaatgggctctttaatggctttggggtattgaccttctcagatggttcaaggtatgagggggagtttgcccagggcaagtttaatggcgtcggagtcttcattcgatatgacaacatgacctttgagggggaatttaaaaatggcagagtagatggttttggcctgctgactttccctgatggttctcatggaatcccccgcaatgaaggtctctttgagaacaacaagctgctgcgacgtgagaagtgttctgccattgttcagcgggcccagagcgcctccaagtcagccagaaatctcactgcctgacagcgcagtgggcaccagctgataagtattgggtaaagccagtgcccctgttgttgattcgaggtgaacaaatgaatcagagctgagatgagttgacaatgacagtggagcagaggccttgtatgtgccctgtcacctgccattccagaactggaccacagaaaagtgctgaggatgctggccagcagaccctgcagcagtcattggtggttctgtctttccctaacccttatgtgctggaggacagaggagccacctcttctcactggttgatactctgttcctaagacctcaggttacccagtgtagcctgctgtgacccttctgcttcattttctgccaagtgatacagaaccttcgttctgctgctttggggacaggtgatcctagccccagcttagggccagtgctctgtgccactctggagaaatagggaaaagataggggtggctcagtacagcagccctgtgaaagtcaaggccagagcttttcttttttaatttttttattattattattattattttattttttatttttgagatggagttttactctcgcccaggctagagtgcagtggcatgatctcagctcactgcaacttctgcctcccaggttcaagcaattcccctgcctcagcttcctgagtagctgggactacaggagcgcgccaccacacccagctaatttttgtatttttttttagtagagacggggtttcaccatattggccaggctggtctcaaactcctgacctcgtgatccacccgccttggtctcccaaagtgctgggattacaggcgtgagccaccacgctcagcctttaattttattattataaaaaattgagccagggtcttgctatgtggctcaggctcatctcaaaatcctgggctcaagtgatcctcctgcctgggcctgccaaagtgctaggattgcaggtgtgagccactgtgcctggctggcagagcttttccatatgttactcctcatgctggttggaatcatggctgcaggcttccacttggtctgatcagactggtattcattcctgcctatgtccccgtgaaggattcggtaagagtgctatttcctcctccctttagaagacaggctgtcttctttcatcaacttagagcagataatccccatgtgtgcctctctccttccttagatggggaacaggatccctttttgggacaatcaagaaaaaaactcatgtaaacagtaatcttattacttgtatttgtgactaactccagggaaaagggtagaatatttaggccacttcaggcactaccatggagtgaactgaattcatacggatggcttgggctgacacagtttcttcccagtggaccaataaatcagactcacccgaacccctggggttttggtagaattggacctactctaggactgtggggaactaaaggagcatttggctcactgtagctcttctatcatgagccttgaccgtcaggccgcaatcagaccttactgatgggatctctgcagtttattacgtaggcctcccgttaccctggtacccaaatacgtcccccacctctagctccctagcctcacattgaatgtctcttcaacagcagattgtggtggaagttatagccgtgtgcctctatttattctctgaattgtactgtagaaaaaggtgtttataaagaataaagaaatcaccagaactgcctatacctagttttcctgactttctggccctgcgtcttcatgaatatcaacccatttgctgtttgtaaaagttaatcgggttagcccttggaactgaccctgcacactttatcaagtcat

SEQ ID NO: 459700 - DNA, 2753 bp, Homo sapiens
atctagacctcaataatcaactgatgcctggctcttgtggcccaggcgcgttacaatttacaaagctgcctctctgaagctggatttaggatctgccttaaactccgcggcggggcccttgacagcagtggggactggagcaagatcagagccgctcgcgttgatggtcactgttgcttcgggcgcaggtttggttttctttggggttgccatttcaactagacggcctctgggtaggccagatctggatcctctgtctttatctgcgttgcagaggtgggaccacccctctttcacatagtcagcccgggttcgcaaacactcggccccgcacaaagatggcgtggagccgggctgggccaatgcggagtggcgttgctcccggttgcctaggtaacagccaatgggcagcgggaattgtacccagtgcggtcgcccaggatggcggcgtcaagtggggcaatcgctggtggaggtggcggagagcaaggtggcagccgggagcccatcagaggaaaagtccgaggcgctggaaccctgcgtccaggcgtgacggtcatcccgaaaggccggccccagtttcatccttttatcctgtaatctgtcaccatgaccctgacaaaaggttccttcacctactccagtggggaggaatatcgtggcgagtggaaggagggccgcaggcatggttttggtcaactgatgtttgcagatggtggcacctacctgggtcattttgagaatgggctctttaatggctttggggtattgaccttctcagatggttcaaggtatgagggggagtttgcccagggcaagtttaatggcgtcggagtcttcattcgatatgacaacatgacctttgagggggaatttaaaaatggcagagtagatggttttggcctgctgactttccctgatggttctcatggaatcccccgcaatgaaggtctctttgagaacaacaagctgctgcgacgtgagaagtgttctgccattgttcagcgggcccagagcgcctccaagtcagccagaaatctcactgcctgacagcgcagtgggcaccagctgataagtattgggtaaagccagtgcccctgttgttgattcgaggtgaacaaatgaatcagagctgagatgagttgacaatgacagtggagcagaggccttgtatgtgccctgtcacctgccattccagaactggaccacagaaaagtgctgaggatgctggccagcagaccctgcagcagtcattggtggttctgtctttccctaacccttatgtgctggaggacagaggagccacctcttctcactggttgatactctgttcctaagacctcaggttacccagtgtagcctgctgtgacccttctgcttcattttctgccaagtgatacagaaccttcgttctgctgctttggggacaggtgatcctagccccagcttagggccagtgctctgtgccactctggagaaatagggaaaagataggggtggctcagtacagcagccctgtgaaagtcaaggccagagcttttcttttttaatttttttattattattattattattttattttttatttttgagatggagttttactctcgcccaggctagagtgcagtggcatgatctcagctcactgcaacttctgcctcccaggttcaagcaattcccctgcctcagcttcctgagtagctgggactacaggagcgcgccaccacacccagctaatttttgtatttttttttagtagagacggggtttcaccatattggccaggctggtctcaaactcctgacctcgtgatccacccgccttggtctcccaaagtgctgggattacaggcgtgagccaccacgctcagcctttaattttattattataaaaaattgagccagggtcttgctatgtggctcaggctcatctcaaaatcctgggctcaagtgatcctcctgcctgggcctgccaaagtgctaggattgcaggtgtgagccactgtgcctggctggcagagcttttccatatgttactcctcatgctggttggaatcatggctgcaggcttccacttggtctgatcagactggtattcattcctgcctatgtccccgtgaaggattcggtaagagtgctatttcctcctccctttagaagacaggctgtcttctttcatcaacttagagcagataatccccatgtgtgcctctctccttccttagatggggaacaggatccctttttgggacaatcaagaaaaaaactcatgtaaacagtaatcttattacttgtatttgtgactaactccagggaaaagggtagaatatttaggccacttcaggcactaccatggagtgaactgaattcatacggatggcttgggctgacacagtttcttcccagtggaccaataaatcagactcacccgaacccctggggttttggtagaattggacctactctaggactgtggggaactaaaggagcatttggctcactgtagctcttctatcatgagccttgaccgtcaggccgcaatcagaccttactgatgggatctctgcagtttattacgtaggcctcccgttaccctggtacccaaatacgtcccccacctctagctccctagcctcacattgaatgtctcttcaacagcagattgtggtggaagttatagccgtgtgcctctatttattctctgaattgtactgtagaatagtcgtagaagataaagcacctcggggggggtgg

SEQ ID NO: 459701 - DNA, 2780 bp, Homo sapiens
atctagacctcaataatcaactgatgcctggctcttgtggcccaggcgcgttacaatttacaaagctgcctctctgaagctggatttaggatctgccttaaactccgcggcggggcccttgacagcagtggggactggagcaagatcagagccgctcgcgttgatggtcactgttgcttcgggcgcaggtttggttttctttggggttgccatttcaactagacggcctctgggtaggccagatctggatcctctgtctttatctgcgttgcagaggtgggaccacccctctttcacatagtcagcccgggttcgcaaacactcggccccgcacaaagatggcgtggagccgggctgggccaatgcggagtggcgttgctcccggttgcctaggtaacagccaatgggcagcgggaattgtacccagtgcggtcgcccaggatggcggcgtcaagtggggcaatcgctggtggaggtggcggagagcaaggtggcagccgggagcccatcagaggaaaagtccgaggcgctggaaccctgcgtccaggcgtgacggtcatcccgaaaggccggccccaggccgcaggcatggttttggtcaactgatgtttgcagatggtggcacctacctgggtcattttgagaatgggctctttaatggctttggggtattgaccttctcagatggttcaaggtatgagggggagtttgcccagggcaagtttaatggcgtcggagtcttcattcgatatgacaacatgacctttgagggggaatttaaaaatggcagagtagatggttttggcctgctgactttccctgatggttctcatggaatcccccgcaatgaaggtctctttgagaacaacaagctgctgcgacgtgagaagtgttctgccattgttcagcgggcccagagcgcctccaagtcagccagaaatctcactgcctgacagcgcagtgggcaccagctgataagtattgggtaaagccagtgcccctgttgttgattcgaggtgaacaaatgaatcagagctgagatgagttgacaatgacagtggagcagaggccttgtatgtgccctgtcacctgccattccagaactggaccacagaaaagtgctgaggatgctggccagcagaccctgcagcagtcattggtggttctgtctttccctaacccttatgtgctggaggacagaggagccacctcttctcactggttgatactctgttcctaagacctcaggttacccagtgtagcctgctgtgacccttctgcttcattttctgccaagtgatacagaaccttcgttctgctgctttggggacaggtgatcctagccccagcttagggccagtgctctgtgccactctggagaaatagggaaaagataggggtggctcagtacagcagccctgtgaaagtcaaggccagagcttttcttttttaatttttttattattattattattattttattttttatttttgagatggagttttactctcgcccaggctagagtgcagtggcatgatctcagctcactgcaacttctgcctcccaggttcaagcaattcccctgcctcagcttcctgagtagctgggactacaggagcgcgccaccacacccagctaatttttgtatttttttttagtagagacggggtttcaccatattggccaggctggtctcaaactcctgacctcgtgatccacccgccttggtctcccaaagtgctgggattacaggcgtgagccaccacgctcagcctttaattttattattataaaaaattgagccagggtcttgctatgtggctcaggctcatctcaaaatcctgggctcaagtgatcctcctgcctgggcctgccaaagtgctaggattgcaggtgtgagccactgtgcctggctggcagagcttttccatatgttactcctcatgctggttggaatcatggctgcaggcttccacttggtctgatcagactggtattcattcctgcctatgtccccgtgaaggattcggtaagagtgctatttcctcctccctttagaagacaggctgtcttctttcatcaacttagagcagataatccccatgtgtgcctctctccttccttagatggggaacaggatccctttttgggacaatcaagaaaaaaactcatgtaaacagtaatcttattacttgtatttgtgactaactccagggaaaagggtagaatatttaggccacttcaggcactaccatggagtgaactgaattcatacggatggcttgggctgacacagtttcttcccagtggaccaataaatcagactcacccgaacccctggggttttggtagaattggacctactctaggactgtggggaactaaaggagcatttggctcactgtagctcttctatcatgagccttgaccgtcaggccgcaatcagaccttactgatgggatctctgcagtttattacgtaggcctcccgttaccctggtacccaaatacgtcccccacctctagctccctagcctcacattgaatgtctcttcaacagcagattgtggtggaagttatagccgtgtgcctctatttattctctgaattgtactgtagaaaaaggtgtttataaagaataaagaaatcaccagaactgcctatacctagttttcctgactttctggccctgcgtcttcatgaatatcaacccatttgctgtttgtaaaagttaatcgggttagcccttggaactgaccctgcacactttatcaagtcat

SEQ ID NO: 459702 - DNA, 1850 bp, Homo sapiens
aaggaaccactgcagtagacccctgacatttgtgagagctgtatcctgcaatcttgaatactaccatggcacacaatgtcctgcattagggacaatcaagcagccgtgggcgctgcgacccttctctcactgtcagaggggcgggagctctcggcctgcgccgcctccgctgcctgcttggtcgcgggcttgccgggaatggtgacagcccgggccccctcttggccaaagaagtcctcgaaagcgttcggcgcacgggctttgtccagctttttaaaccgtaacaaggaccggggccgggcgcggtggctcacgcctgtaatcccagcattttgggaagtcgaggcggacggattacttgaggtcatgagttcgagaccagcctggccaacacgatggagtcttgctcccatgctggagtgcagtggcgtgatctcggctgactgtaacctccgcctcccgggttcaagtgattctcctgcctcagcctccggagtagctgggattacagcaaagatatccagacgctgtatgcaggaagaactgaatttcagaggacaccgtttgatcttcaacacctggcagtttacaaaacagagacggggtgtcgccatgttgcccaggctggtctcgaactctggagctcaagcgatctgcctgcctcggcctttcaaagtgctgagactacagcctgaagaggagagggggaatcctggtgagaagcatttggaattcaagctcagagaagaagacacggagtcccagctgagaactcaaactggtagaaggaagattatttttccttctctataggtgcttggaggtaacgaggggaaaggagttgaaaggaaggtgacatttcaggtattgatgggacagcacgtgcgaggcctagaggactgaaagttcttgatgggatctgtcagaagaaaacagctgcgtgtacaggggagaagtgggaggggcgggtcggctagcgagctgagacggagctgcgcgtgcgtcgaagtcggggctgtgggggcggggtgggtccggggcgcgctcaccggatcgccggcgagctacggctaccacccgtcatctcttttcagctaatctgcttcgcgctacttttttgaggtgggcacctgggatggaggcaaggaatcacgaagtggcgtctcctcggaaggggcagcctgatgtctttaaccactgaactgtggtttccaactggatgcgctttgggttcagggctaagacacgcgtaggcggtgcagacagttcaattcgtgggcggctttttctctcccctgcgcggttttgcagaactgaggattcacgtttgccacgcagtctctaaatgtaaggagaacttgctttatttaacgaatgtgtattcagctgccaaagaacaagctaatcacccttcctccccacgcccgacttagcctcctcccagccctcgccggatttctgcatcggaattggattggatcacacacaaaagaagagcccaggaactcgttcaccaccttgcaccttgcctgttagttcacggcataatggtaacagagtcttcattaatggaagcaacgttactaccgtgagcccggatagctcagtcggtagagcatcagacttttaatctgagggtccagggttcaagtccctgttcgggcggtatcttttttttcctcattaaaagagtaagaaccaattttaggatcttttgtttgttaacacactgcaaaagaagggaataaagtcctggattgtgtaaactgcgaccccaaacacttctcggagggtaagccctctatggggataggcctttgtgcagagggagagaaacaggtaagtttctc

SEQ ID NO: 459703 - DNA, 1070 bp, Homo sapiens
ataggagaaaccatgcttggcttctgaatattatgactgtttccttctcatgagtgaatgaaggggcaccgatgctcgagttttatttgcttcatggaaaatctgcctctgcatttactttctattataataatttatgtactcatataattatgcctactatatttgagagcatttttacatttccagttccagatagagttctttttacgtggaagctgctcagtaaatttttatcccatcaagtggataataatgctccacttcaaaaccctcaccagttcaaacctctacaaccagtttgttgttgttgttccagcgtgcctgctcaagaaccccatggcactctcttctgcaatttcagtggtacttccactcatctccccactttctacttccctcctatccaggtcttcgctgaaacatgggcactcgtgggaagtgctttctgttccccaggctcagagacaggtctccctatggtgttgcccaggctggtcttgaactcctagcctcaagtgatcctcctgcttcagcctgccaaagtgctggattacaggtgtaagccacctctggacatcttatctgtgaaattttaggcattgatcagtgcagaaagaaccatgaactgcaggatgttctcagagactctgacattatggcccacaagaagctgcccactcagcttctagtcagttaggtgtggacttcatcaatcacagaatgaagactcagacagcctcccaggaggacacaaagtcagcctcagagaggcatggaggtgttaaagagggaagtgcctgctagaatttcagtgggttggatatgctctttaacgatgcacaaatcataggtatacattttctgacaattggaatctattattactcttgaaccagctgttccccaggctgtttcctgtaatggaagggatactttgagtttatatcttttcaatcctacatcctcagaaatctacactgatactaataaagggactcatttctcctataagaacccctatgcgagaaaagtatgtttgggtattgcctaatgcactcataataaat

SEQ ID NO: 459704 - DNA, 1253 bp, Homo sapiens
caagtcctggcccagacctaagcaaccagataagtaaaactgtggttcaaagaggccctgggaccacctgcgaagatcctgggattcatcaggggtctgaaccttggatcacacctgctccggctattctgatgtcatctccatctcctggagacagttgctgcatgagaacaaaggcagggcccagacgaggtctggagggataagcggcagggatctgggcactgagctgaggcactgggcaggcagagccattgccctcgcccctaccatgaacccctacagagatgctgctagaaccttgctttctaaggggtaggagggtctggctgcctctgcctctactcaccccatagacacacaggccttctctccatccagggagaacatagctgccaagagcagtcctgcccccacaccaggctccccagcagtgaggagctgggctgggctgtcctcacccgccctcttggcctcaccctggcccttccctggccctgcctcgggatgccaggacccatagcaggtgcctggacaggcttggggatggaaagggggctgggcacagaaggccagcttctggccaagaacagaactcatagagaaacaagttccagaatcctcttcatcctccttttccccacccactctttagttttgatgggctctgttcctaatatctgtcatccaggcaaggaaggcccatggcccaagatccctcttggaaccatggggccccaagtggcaggtatccccagcctgttgaggcgcatgggccataaatcaccttcccaagccagggggaaagcagcaatccaggagagcttcacggaggtggcaggacgggatgtaggacggaggcaaaccatagactcgcaggcggcgttaggtctccactcagaggtatgtggctggggcagctgctgggggctgcagctggtgtctgtcccagagcccaacggctgtgtgtccccacagccgccctctggatcttgctacatgtgccaccccatcaccaggtcctcgtcaccagctatcccctcagccctgagctgctcctccctcagcccttagagggaggtctgacctccttgagggaagagatgatggtgttgacaaacctctctccaaagaggagacgcaaccagaagggtgattccaggcaggtgtggatgccaggcatggagaggtctgaaatggtcaccgagttcagtgagttccaatctttttttgagcaacggaagcctggtagc

SEQ ID NO: 459705 - DNA, 1499 bp, Homo sapiens
caagtcctggcccagacctaagcaaccaggttccaccctgttccctcttacccaccctacgccagcggctaaaagctgccttggctagctcagaccctgagagctaagggatgggaagggttccggtggggacacatggccagtggctgttcttccatattcatctgtctttaatattcagatgaatggaagtacatgaccttgctagtgttttggggtaggaaaggcaagagagtcctcagaagtcatctaaatcatgcctttttatttttcagataagtaaaactgtggttcaaagaggccctgggaccacctgcgaagatcctgggattcatcaggggtctgaaccttggatcacacctgctccggctattctgatgtcatctccatctcctggagacagttgctgcatgagaacaaaggcagggcccagacgaggtctggagggataagcggcagggatctgggcactgagctgaggcactgggcaggcagagccattgccctcgcccctaccatgaacccctacagagatgctgctagaaccttgctttctaaggggtaggagggtctggctgcctctgcctctactcaccccatagacacacaggccttctctccatccagggagaacatagctgccaagagcagtcctgcccccacaccaggctccccagcagtgaggagctgggctgggctgtcctcacccgccctcttggcctcaccctggcccttccctggccctgcctcgggatgccaggacccatagcaggtgcctggacaggcttggggatggaaagggggctgggcacagaaggccagcttctggccaagaacagaactcatagagaaacaagttccagaatcctcttcatcctccttttccccacccactctttagttttgatgggctctgttcctaatatctgtcatccaggcaaggaaggcccatggcccaagatccctcttggaaccatggggccccaagtggcaggtatccccagcctgttgaggcgcatgggccataaatcaccttcccaagccagggggaaagcagcaatccaggagagcttcacggaggtggcaggacgggatgtaggacggaggcaaaccatagactcgcaggcggcgttaggtctccactcagaggtatgtggctggggcagctgctgggggctgcagctggtgtctgtcccagagcccaacggctgtgtgtccccacagccgccctctggatcttgctacatgtgccaccccatcaccaggtcctcgtcaccagctatcccctcagccctgagctgctcctccctcagcccttagagggaggtctgacctccttgagggaagagatgatggtgttgacaaacctctctccaaagaggagacgcaaccagaagggtgattccaggcaggtgtggatgccaggcatggagaggtctgaaatggtcaccgagttcagtgagttccaatctttttttgagcaacggaagcctggtagc

SEQ ID NO: 459706 - DNA, 1593 bp, Homo sapiens
gagggtgtatacgtcctgtgatattgggagtaatatcaacttctcggcctctgaatatgaggaagaatatcacagggtgggtgtatacctcgtgctctattatgcggagtcgtatctgtctattatggggagtaatatcattctctccctttcaggatattaataacaatttcacaggctgggtgaacacagccggcgatgctgaaattattatcatcctctccccctcttcccctcctggctctcagtccccgcctcacgggttatgtagcgggttatggcaagaagacaaactgcagtttcctgcacagaacagcacaaacaatgatccaagctcagttacaacacaatattggtcatcatttgaccatggacttcaatatcaacccttagaaaccttcctaaaacaggtcagcaaaacaccaagaagcaatatcctgaatgataggaaaatatccttgcttgtgcaaattgtttccacttaatttttttcaacaaatgttaattatatttttactttctaaaaatttttaataaaatatagcctacttggttaaaaatggtgtcaaagcttttctaaaagttaaggcattacataattcagtggcccctgtggctgccatggataattcttttttttctgttcatcttcaaagaagggaattcagaatcaggaaaagatctttggaaattcattagcatatggttttactccgaaactaagaccaaacacaaagagaaatgcagatttttctcatggaaataaaactgcttttttgcattttcaatttgtttccaagtaaggaaaaacatgtcattgtttctcataccccccatttctcctgttttccttcttttcatttgcttttcccagtgtatagcccacagaactagagcgaaagctttctttttggcccgtatataatttgaacagagtatcatcaggtgtctaatgtaccaccaagagtggtgcttacgacaaaaatgtcctctagacttattctatgttcgctgtgtgaatgaagatactaatggtcataaattcctggaacgggagacctcatttcattcatttctatttagaggcttcctagtagagtgcctcatacacaataactggccaataaataattgttgaggaaataaaataagattaataagataataagaatcttattaccaaagattcttcttctcagaaagggtttgttgtgatagctttactattaatatctcactcgtcatagagttacagcttctgcattaaacatattgctattaatatcaggcctacattaatcacctggttggaagaaaagcctccatgggaattcatctgttgggcaagccactgcacaatcttactagcatagatgacattatctgagaaaaaggaagaattttcacatagtctgcataaaagtcatgggttacacataaagaaggatgaaaattccattcccgacctctgtttgtgctgaattgttcccctaaaattatatgttgaagccctaacaccaagtacctcaaaatgtggctgtatttggagataagactttttaaagaggtgattaagttaaaatgaagcttatg

SEQ ID NO: 459707 - DNA, 3408 bp, Homo sapiens
caggccagatgttttgttgatctcacagataactaccatcagagtcttcaaatgggacacattccagagttgcattctaaagatggaggaatgggggctcacagccttatctaatctccaaatgaagaatgggcccatctgacatatcctatgagcacaaagcttaggggactcttcaccgaaacctagacaaatatttgaatgcattttttttttttttttttggaaagggagataacgtccaatgggtctgttttataatgcatttgtgtaaggggaacgggaggaaatgagatttaaaaataaaactgtttacttcagaggcttgggttataaaagcataggtttctctttcaggactctctgaagttggaaagatggactctgggcggctgggcagagactgtgtgcaggttcgtacagctccgggcggttacagttctggtccccggcaatgccaagcaccctgtggaaaagtggcccaggcttcaagcttcagaatcggactcctaccccttaaagctgcaagctagcagaaaaaaagagagctgcaagggagctgtgaaggggaaggggtctcctccggagggagagacgactgggatagcctgtttgggactgagtgtggggaaatgtgacaaattcagccttttcatcgtgcgccctgagccgagcagaagcggggcggtaggagatgattccgcttgctccgagtttccaagctccttgctcctttccaaattgcttgcggcaatgtaattctttccttcggggacaggcagagctccactgtttttctggtttccagggtgtgcccatgagttacccagagtgggtggagcggtggggccactctggaatagccttgcggcagacgcggctgactgccctcgaacagaactggcggatcccaagaaaccaaccacgcggcaagatttggggagcccacagcttctactcagacacccctgcagagtgtttgctcattgctaaaaacgtgcaggcgtcgtagggagtgtccccagaggccattgcctagcttgcctgcaagcccttagtgagcacctgccctgtgcgaggttccgagctccactcacgcaggtcctgccctcaggagctcactgtattgcagagacacaagaggacaccagggtggctgtctgttctgtgctgggggaggccaagggactcctcacctgcccatctctcaggagtttccaacctttccccgccagtccagtctgtgactggcaagttaccaactgcccctcttccttgaaaacagccaccttcctaggtgggtcctgggtctctgagctttcctgagatctagagagaggaggaaaaagtgtctctgtcacagctggggcttccctagctgaccctcctcccccgccacctctggagctgaggttagcaaagccgtgcctacatcagctgagctggggagtttgccggatgagcaggcctggtggggcagtgacgtttgaacatgtcaggtggacagttgtatgtcaggaggtgagaggagaggggttggctggagagagcaggttggattcaccagcacttggagcacccagagggaaggggacccgccagagagggcgaggccagaggaggccagacgagcccgagggcagtgaggtcagcccctccacccgccagcctgcagggatgcctctgggtcaaggctgcatgagcagggtcctgcttggccacttatcagcccctacagccttagaagccaagccccagcccacttcctcctgtcgacagcactggctccaggccagtagctgtagtcatggcctgttgaccaagggctacacgggccagtggcaggaagctgctggggtgggagatgaccatgatgatgatggtggtggtggtgatgatgatgatgatgatgatagtggtggtggtggtggcgattatgtccttcagagctttgatcgcactttcctcatccagggtcgggtaggaatcctgccctgtctagcttgtgggaatctaggaggagggccaagggagagagtggcgaacttccaggcccagagaaatcaggccttccgtgggggctttgcagaaaagagctgcaccaggccttttggctccagttccagaaccttcctccaccagagctttgccaaacttcactcggtgcagctgagcctgcaccctcctggcagggcccaaggccccatagaggttgtatctgaacagacaaagttgctgtcccctctcctgctccctccccacggtggggaattctcttcagtcaaacacaccagctctaaggttctgttgtcatgagtcttagcatccacacctcccactgccctaatgtgtttttttaaccaggagtgttctggaaacagctcaagaactccaagtgttttcaagatttctccacactgtagcatggatcagcgcttcgcttctgtctatggctgtttattgcattgcatggatatgccgcattttgcttatccatcagttgatggacatttgggttgtttccactttggggctcctctgaatcacgctgctgtgaacatcagaaacactgtctcccattgaggcttgattttttatccatcaaccaaatgtggtcctccattatgtggccctgcagtgttcagcccctgtcccccgagaagctcctggcataatctgagcacctcctgacttgcaccacagctgtcaggggctcctcttgtgatccttctcagggctcagcccctgagaagcacctgtcatactcccctgtctctaacccactttggtggtttcttgtggattctttgaagaggtgctaggagaaggcagagccgtctctctaaaatgccaaaaacctttctccttgagacaggcaagttgagatgtctgtatgggaaaacccaaagcaagcctggttagcatggagggcaagcaacagggaagtagatccaaactcagacaactgggtttgaatctcccattttccagccatcgtgaccctgagccagttatcaaatctctcaggagtggcgcttgtgaaccctaaccctaaatgagaatgctaatgccgacctcattagatcatggctaaacccgaggaggggcacactgcaggcacagggaggcaggtgtgttgtgcatcccctcttctctttatttctcagatacaggagtcagaccgctttctgcatttatccctcagggctctgcttcagcatgctttcctctgagaagccacccgcgcacccacttctgactctgctacacgctggtgtgacactcttcgtgttccgccccactcatcccccttgtcatgactgcttctccacttccgcccctctctccagattataagtcccatgagggctagggcgctggctgtcttgtttactattgtgtccccca

SEQ ID NO: 459708 - DNA, 1905 bp, Homo sapiens
ggcgcccgtgcaacggagcgaggatccgcgcgcacgggaagttcttctgctgcagggctggagagcgccggccacgtcctagcctcggtccgactcgtccagcgtatggccctgtggggaaaggactgggtcagagagctgtgccagggccgggctcgccgggacgcgggcagtcactcaccgcggcgggctcatggcgtgcggggtttgggctgcggggatggcctggagggctccgagggctcggagggtgcggcggccgcggcagccacggcgtcctcggcgggtgcggcgggtgcggtgcgttcctggcggctgcgaaagtcctgcagggcgcggcggttctggaaatcgatgagcgccagcgcgatggccgcgttccagcagctctcgcccgcgcagcggaagtcgatctccttgtggtcggtggtgacgatggtgaagtacacgtacttgcccgtgcgctccacgcagtccaccttgaggatggagtggaagcgcagctccttggggcgcgcgcgggggctggcggggaacaggctcaggcggtcggagatgctgatggcggctgcatgacagtgtgaatatgcttagtgtgaatatactcagtgtgaatacgctcagtgtgaatatgctgagtatgctcggtgtgaatatgctcagtgtgaatatgctcagtgtgaatatgctcggtgtgaatacgctcggtgtgaatacgctcggtgtgaatatgctgtgtgaaaatgctcggtgtgaatacgcttggtgtgaatacgcttgtaatatgctcggtgtgaatatgctttgtgtgaatatgctttgtgtgaaaatgcttagtgtgaatacgctcagtgtgaatacgctcggtgtgaatatgctcggtgtgaatatgctcggtgtggtgtgaatatgcttgtaatatgctcggtgtgaatatgctttgtgtgaatatgctttgtgtgaaaatgcttagtgtgaatacgcttagtgtgaatacgctcggtgtgaatatgctcggtgtgaatatgctcggtgtgaatacgcttagtgtgaatacgctcggtgtgaatatgctcggtgtgaatatgctcggtgtggtgtgaatatgcttgtaatatgctcggtgtgaatatgctcagtgtgaaaatgcttagtgtgaatacgcttagtgtgaatatgcttggtgtgaatatgctcggtgtgaatatgcttggtgtgaatatgcttgtaatatgctcggtgtgaatatgctttgtgtgaatatgctgtgaatatgctcagtgtgaaaatgcttagtgtgaatacgcttagtgtgaatacgcttagtgtgaatatgcttagtgtgaatacgcttagtgtgaatatgctcggtgtgaatatgcttagtgtgaatacgctgtgaatacgcttagtgtgaatatgctcggtgtgaatatgctcggtgtgaatatgctcggtgtggtgtgaatatgcttgtaatatgctcggtgtaaatatgctcagtgtgaaaatgcttagtgtgaatacgcttagtgtgaatatgcttggtgtgaatatgctcggtgtgaatatgcttggtgtgaatatgcttgtaatatgctcggtgtgaatatgctttgtgtgaatatgctttgtgtgaatatgctcagtgtgaaaatgcttagtgtgaatacgcttagtgtgaatatgctcggtgtgaatatgctcggtgtgaatatgcttagtgtgaatacgctgtgaatacgcttagtgtgaatatgctgtgtgaatatgcttagtgtaactatgcttagtggcactgaactgtgcactttaaaaaatggttaagaatgtaacttgtgatgtaccctttaccagttttaaaaatgcatttacatatgaatatccatgcaggcgggggtatga

SEQ ID NO: 459709 - DNA, 6863 bp, Homo sapiens
ccagcagtcagcagtcaggtgccggctcacacacgcaaaatgctgtgcaagaggcggtccctttctctatgctggattcagtacagagctgctgcagttcatgaactttcactgttgttgttttttccttgtgcttttcctactgatgcatctcaaggttctacctccttcccaaaggtttccaacaactgtgattccatttttgtgaatgggaaggaaatgaagagcaaagtggacacgattgtgaacttcacccaccagcacttcacctcccagttcgaggtcactgtctgggcacccaggctccccctgcagattgagatctcagacaccgagctgagccagatcaagggctggaggatcccggttgctgccaacagaaggcctacccgggaaagcgatgacgaggacgatgaggagaagaagggacgaggctgctccctgcagtaccagcacgccacagtgcgtgtcctcacccagtttgtggccgagtcacctgacttagggcagctgacctacatgctgggccccgactggcagtttgacatcactgaccttgtgaccgagttcatgaaggtggaggagccgaaaatcgctcagttacaggacggcaggaccctggctggtcgggagccgggaataaccacggtgcaggtcctctcgccgttgtctgactccatcctggctgagaagacggtgattgtcctggatgaccgagtcaccatcgcggagctgggagtgcagctcgtagctggcatgtctctctccctgcagccacaccgagcagacaaaagggccatcgtctccacagctgctgccctggatgttcttcagtccccacagcaggaagcaatagtaagttcttggattttgttcagtgatggttcggtgacacctttagacatttacgatcctaaggattattctgttactgtctcatcattggatgaaatggtggtgtctgtccaggcaaaccttgagtccaaatggccaattgtggttgcagagggtgaaggacaagggcctttgattaagttagaaatgatgataagtgaaccttgtcagaagaccaagaggaagagtgttcttgccgtgggtaaaggaaatgtcaaggtcaaattcgaaccaagtagtgatgagcaccaaggaggcagcaatgatattgagggcataaatcgggaatataaagaccacctcagtaattccatagagcgcgaaggaaaccaggagagagcagtccaggaatggttccaccgtggcacacctgttggccaagaggaaagtaccaacaaaagcacaaccccccagtctcccatggaagggaagaataagttactcaaaagtggtggtccagatgcctttacaagcttccccactcaagggaagtcaccggaccccaataatcctagtgacctcacagtgacctcaagggggctaacggacttggagattggcatgtatgccttgctctgcgtcttctgtctggccattctggtcttcttgatcaactgcgtggcgtttgcctggaaatacagacacaaaaggtttgctgtgagtgagcagggcaacatcccccattcccacgactgggtctggcttgggaatgaagtggaacttttggagaaccctgttgacattacactcccatcagaggagtgcacaaccatgatagacaggggcctgcagttcgaggagaggaacttccttctgaatggcagttcccagaagacttttcatagtcaactactcagaccctctgactatgtctatgagaaagaaattaaaaatgaacctatgaattcttcgggcccaaagaggaagagagtcaagttcacttcctacaccaccatcctcccagaggacggcggcccatacaccaactccatcctgtttgacagcgatgataacatcaagtgggtctgccaagatatggggctgggggattcacaggactttagagactatatggaaagtctgcaagaccagatgtaaactcctttcttatgtttgtattcacctttatgccttctgttttttgaatgctggagcagtgagtttgatcagcaataggggatgatttaacaaagtttgatttgtggaggtctggtgggattcatttctaagcaggtaaaagaggtttggagagctatagaagctgggttttaagtttggaaatgcctctaaaacagccacatgtggggactggagaaattctaagacaacagttttatggactgcctggtacgagctcagtgcaaatgtattaaacctgaccccacagacattgttagtcatctcgtgacaaatggccatgtggaattagaaaagatttgggtgttgatttttctatttctagaccttttaaagcacagtggacacttattgccccttggcctgagtttagacatacatgaaagatgactgaatgtagctatcctgatttgtcatgagcgctgctcattatttttatatacatttgcacctgcacctgttcctttgacctctggaattctttttgaaacatgaagagaagaaatttcagtcttttccttgagctctgtttgatttacacatgagttttcttccctgggatttgccatgccatgttatttcctgggtctccatgcaggatgtcaggtttttccagttttctgcacttcatcatctagggatggtatccaagaagcttattctcactttgttttttccttccttttgttgttgaactttcttgtataacactgggacaaagggttttacttaaaatgttaatatacagtgagggagggccatctctttactgttttctatgtgaagtttcaaacatttggaaaaaagttgtcaatcacaaacatttatttttattctctgcttgttgaaaactcatggggaactcctggagtgcatttctgagggtaaaaaggccccaacatagctgtatttatacaagtgctttgtggccaacacaatttactatccaaactgaagtcttaaagtagaattgacctacacagaaaggaaattgcctaggcaatagatgcagattacactttccattttaccagaacaaaagtttttttttttttaaataagtagaatgacagttcaagttagcaatatatagaaatccatccatacaatgaccaaaataaataaataaataaaactcaatcatgactttggcagagataaaacattgacaagggtgtgcatttgtggagagaagcagtgggtttccccccaaaatccatacaaataaatgactattccagaactcaagaagcagctattatagaaaaaaaaattaaaaaccacagctattgaaaaattaaaacggcaagagaaaaaaagaaacaactcctgcataatgtttaaataaaaatgttattttaatagcatcatgaatggtcttaaggcaaaaatttcagattagcaaaatgtgatgacatatttattaagattgtattattggaaatgtagacactggactagtatgcctcattatgagctttactgagccatttgcatctctaagaaatatgattttaaaggcccaaagtaggaaggatctgcagggggtcacctgaagcagtgccctgactccaaatggctgataactgagctaatccaaggagaggcgttcagttgttctcttattatagatttccttgggtgggaacatgacaaccccgcctcctctagccatgacgtggcagccaaaaagttcttcctgtatctctggcccacaggactgtagtgtgtttgggaacagtgctgaaattgcaagtgatgtaggcctgacctccagagcccagcgttcagttagttgtataaaatggggcttaggaaccgaagctgatgaagttccaaaagtagttcagtttgatgggataaggaagcaaggagagccaggcattagctgcaaaaggagcttgcagagagatggctgacactttatgggaagattcctcagtcagccaaaagcttttcaaagagtttggtgcagaggtagctcagagccaaccatccaggaccgaagaaagctcatgtgctgattgacacatagctatccaggtgagtcggctccttctatgaggcttttcaatcgtctctccctttggatctctggcattccagaaagactgggaattcatttctgaaaatgatgaacctccgctgaaacggggaggaaatctcttacacacatacagcagggtcctgcccactggtaaagtgagacgttgggtagggggtgtaactggggaggaggtgaaggaaattatccctgccatggggagtgttattcaggaacataaaaattagagcattccctctgatggcagtgcttgacggggtgcagggaacaaactggggagcgttcaaacatgccagtggtttctcagcagggctggaaactggccacagtcctgaagatgcttcttgtgacaacttagagtcactgggagtcacacagctcctgtgtagccgcctttgctcctctgtgttaaaacccagtcagttcaaaataacaatcaaatggaaggccatgggggaagggttccttccaccatataacccacacccagatgtatataaacgcatatacatacatatacccgtgtgtgtgtgtgtgtgtgtgtgtgtgtgtgtgaatactgaagagccagacaacaaactatttagtaagaatcaacagtgactgtcaattgttctcagatttggcatggatactatttctcatgaaataatgtcattaaagtatttcctcctctaaatatttcctgaagatcataaaccatgggttatagcaccttgttttccagctagtcaatatacaactattaggtgctgtgccccaaaatatctaaaatgggggtaaagatataaactattaagccatgaaatctaattttctggggaccatgcatttgcctggattttccaggattttatggctgatagacccaaattattagtcttgataaacaacctgaaccaaacatttataaagtcccttcctctcccatgggaatggaatgctcagactcctgctgagggagacaccagcaagcctcttgagaaggcaccagacagtgaactctgtggtcacatgaagggaggttcagatgctagacgaccagcgtatgacctggaaccattgaggattgcaaccgctgcctccagggtccagatgtgctgcagtagagggcagagcacaggaatcaagaagcagctgccacaccaaagaactgatgcttaaacacacaggtgtgttgcatttgagagaaggcaagaagaaaagacaatagaaggttaccctggaaaaacaacacctagcaaacctcagaatactccatgtgtcccaagagaaggaataattgtctttctagctgttatatattgcacactggccaggataaattcccagactataataatcctgactatgtagacggaagtttctatttataaagtcatgcagggggaaagttgattaatttttgtcccattgccacatctgtagactaagtaatttttaacttgctaacttttagaatgtccacctttgtgcattttggtagcattcttgtttcattattttagaaaggggtcttcccattactgggatgtcggggccctgtcagagaactattattaaggctctgtgagggaactgttcagtctcacagcaaggaccacagagcgtggtttcatctgaaccctacaagtcagggacaccagtgtgttttctactcgagttacctaaaaatggtctcaattttccatttcattctctgtaaatgacacaatagatggtttatagactcagcagccctcaccttttattaaaattatatatgtgtgatgtaatgcatatcacctgtcatgtaaagggacggtatggatggtggaaaagttatgctaaaatatggattgcagatatttttgtatgtaatataggcaatataatgaaacaccgagttttttaaagtgaaagcatgcaaaatcgtagcttttaaatgtacagacatcccactcaaaaatatctaaactgatagtgggaaaaacatttgagacctagtaacatcatgaaatgcactgaatttggaattctggcctagaaaggctgtggcttatgttgggattgatgatggaatctgccagaacattttcatcttattcttcttgacttttggatttttttcttttctttttttctggaaatatttcggaaataaagtgacttcatttttcagcataaaagtatattctaaccacagggtaacacatcgtttttaacatgaaaataaacatttaaacattcttcagttgtttcattattttatctgcatgttccataaagcagctgtatggttggctataatatagatttattttttcttttcagccagagattttaatacccttgatgcagtaataaatggacatcaaaagaaaacatttcttaaaagttgccaacgtattttaccttgaaaacatttcttatttgttatcctagtaggctggggaaagcttctctccagatgtctcagaaaaagatctcctgtttctcatggccccgtccagggtcaaaccatgttgaaagtcagtgctgaaatgcatgatgctgcgggtgtttgagagcctttgacctctgtccaccctttggtctttgctcgtcaatggcttggtcttgtatatgtatctggggcaggggctttgtactgggcccagggtgctgagctttccagaacaggcagagctctagagacctaagaaaaccacaggacaggcggggattctttttgagaggctgaagtagatgtttcagctgaaagatgggtggtacgcttgccagtgcc

SEQ ID NO: 459710 - DNA, 5469 bp, Homo sapiens
catgcacgctgcaggctgcctgggaggagggaaactatgccccagacgtccgttgtcttctccagcatccttgggcccagctgtagcggacaggtgcagcctggcatgggggagcgtggaggcggggccggtggcggctccggggacctcatcttccaagatggacacctcatctctgggtccctggaggccctgatggagcaccttgttcccacggtggactattaccccgataggacgtacatcttcacctttctcctgagctcccgggtctttatgccccctcatgacctgctggcccgcgtggggcagatctgcgtggagcagaagcagcagctggaagccgggcctgaaaaggccaagctgaagtctttctcagccaagatcgtgcagctcctgaaggagtggaccgaggccttcccctatgacttccaggatgagaaggccatggccgagctgaaagccatcacacaccgtgtcacccagtgtgatgaggagaatggcacagtgaagaaggccattgcccagatgacacagagcctgttgctgtccttggctgcccggagccagctccaggaactgcgagagaagctccggccaccggctgtagacaaggggcccatcctcaagaccaagccaccagccgcccagaaggacatcctgggcgtgtgctgcgaccccctggtgctggcccagcagctgactcacattgagctggacagggtcagcagcatttaccctgaggacttgatgcagatcgtcagccacatggactccttggacaaccacaggtgccgaggggacctgaccaagacctacagcctggaggcctatgacaactggttcaactgcctgagcatgctggtggccactgaggtgtgccgggtggtgaagaagaaacaccggacccgcatgttggagttcttcattgatgtggcccgggagtgcttcaacatcgggaacttcaactccatgatggccatcatctctggcatgaacctcagtcctgtggcaaggctgaagaaaacttggtccaaggtcaagacagccaagtttgatgtcttggagaggggcatctggagcaggtcggaggggcatggggctgtgatgctcaccaggtcctccctgtgcccacagcatcacatggacccgtccagcaacttctgcaactaccgtacagccctgcagggggccacgcagaggtcccagatggccaacagcagccgtgaaaagatcgtcatccctgtgttcaacctcttcgttaaggacatctacttcctgcacaaaatccataccaaccacctgcccaacgggcacattaactttaagaaattctgggagatctccagacagatccatgagttcatgacatggacacaggtagagtgtcctttcgagaaggacaagaagattcagagttacctgctcacggcgcccatctacagcgaggaagctctcttcgtcgcctcctttgaaagtgagggtcccgagaaccacatggaaaaagacagctggaagaccctcaggaccacccttctgaacagagcctgaggcggatgcagcccgcgacgccagaggaagcacgtgcactaactgggtttaaattttgactgatgtgggttgagatgaggaggcctcactggttggggtccattttgtatataacttttatgagaaaaaaatggtaattatttcacgcatcaacctttggcacttacaaagttttttttgtttattttaaataacagggcagggccctgctttggggagggggaggggagagtatcatgggagatggtatccatgataacatcttattctaatgaaatgtagatttttattttctacttttgattattaacatcttatgaaaaaaatattttaaaaaacccagccaaaaccaacgtgagccctgcctgctcggacgcctttccagccagtgtctctgacgtcggggttagtgccttagagggtactggggtctggtcttcctgctctgtggtttgggctgcggtgagtcccactccacctgggcgcctgccctcaggagcctgggctgcgaggctccataggagggctggtggctgggaggtcgcgtccgcacacttctggaagtgagcctttgagtacgggctgtccaaagtttacattttcattttcctttcagggatttgtggggtcagggaggggcagggggcacctggcagcatattttctgtgacaatgtgtccagcaaatcattcttcaactacattttagaaaggaggaaatctaaaataaggtaagggagggaagcatggagttgtcagttttctgggctgtgactgaaagacacactgagctgtgatgaagaaaaatacatggccgactccagggtggtgacatttagagctagtcttgaaacctatcatctacagaggggagggcagccaacagccctcttcccacctgggtaggcagcgccctaattggaattggaaacagaaaattcgccaggccatactgctggagcccattcagataaaactgcccaatactgagaggtgttttctacacccagctagaggagcacactccattttcccatgtctgacttcgtggtgtgagccctgggccctactgaccatggcgcaggacagctgtccttcagaaagcacacggtcaatccacgtggaccgtctccctcgcaggaactccgcatccttgtccctctgcattcccagtttccgcaggagccttgatcaatggggaagcctgggtgaggatgggccaggtcccaattcccaaagctcctggaagagcctgaagacattgggaaaggctgggcctggggaggaggcagccctgggcccgctgcccatgcctctggtcctgggtggagcaggaatagttccactgtattgtcacagtgtgtttgcactttctgaggttctagctagtacagattgtatattgatagtacatattgctttgtttatgtctttgagatgagaaaggcttaaaacttgagaatatatatttggaatacagccttagaacggtttctgtacacacccacgtgcacttcacgggtgatcagttctagtacctacttgaaacagtgtctgtctgctactttattttcccaatttgatacataccctgatttgatgttttggtatttgagatgaactctgagtatgaagctgtaccataatgcaggacgtcagttttggtgtgactggacatacttgcttcaataaaagaatacatcactcccctcccttgcctgctgtgtgtgtacagtgagggggtggccttgctgctggccggagacatgggtcccctggggcagggaggagggtgaggctgccaggcctgctgtggccttcccaggagggactgggcaagagacttttgtctccagctggcaacactttgtgtgacaaagggctttccactgaataaggtgagactcgaaagaagctataggaggcacgttcagtcctgctttcctcattgtgagctccaaaaagatgtcactggctgctgtattgcatggtcacataagtaagtaagttcaggatacctagttaagccaggctgtatggactgtgttactgcagaggagtcagatggcctctctgggggcaggggaggttggagagcccctggacgcgatcctgcagggcagcctgcagaatgcaggtctggaggggccactcctggtgtcatgagttttatactcaagcgcaacagagaagaggggttcactgggggagcacatgagagctcgggaattgaaggaaaaaaactaaggctccagaacaggacatggtactcccctctgctcctccaacctgcccattcccacggttctcaggcctggacagggtggggactgcaccccagggataactcagctcatctttcactatgtgctcagtgtcatcattcccacgaggtgagcgccacccaacagaaacctttctggggtaagggaatgtcctgtatctgtgctgtccagtacagcagctgccaaccatatgtgggtcctgtctgctgggatgtggctagtgtgacccaggggctgaatttgggatgtgaatttggacagccaggggcccgtgttggacagaagctgggcctcggggccttgccaccccatgcagtgggcagtgcaggacaggtgctcgggtgtctgtggagcaaatggggacatggagatgatgcttgagcttttagtgaatgacattttttaggtctttaaatccaatggcatccctaatttcctggtgaagaagttatttttggaagtgttcatctgcctcagctgaagaagggggagtgcataatttgctctggccttggatacaacctcgagctgggagggccatcccctgccatgggcagttcctccagggcagtggctttcaagtgtgggtccttgggaacctgtttgaatgtccattcttaggcctctccacacacctcctgaattggcaatacggtgggggcctagtccaatccctgggccacacagtacgtgtgagaagcactcggtgggtgatagtctgtgtgccttgtgaccagtacatccctgtgtgatggctgagtgtcacccttcacaaacgttgcaggaacaaatggatgtcagagtgtcagatgtagcagaatgataagctaaggatctgtagtaagccatggagacttctgtgacacacactgcttgtgacacacaccgaccacgcccatacgagaacatagaccctgctcctcagggaggcacaaggcagcagggagggagcaaggagccggggaaactggagtgagagctggtttcagcccccagctggagaagcttggacaagctgtttaccttatagcctccatgtttttcatctgatcacggctctcttgcagggccgtggtagcagacagagcaggcacctggttcattgtcagcacagtcagtgctcgctgtagactggccttggtgccgaggacgccaagcagcacttctgcaaaaggccacagcaccttttgggaaaagtgaagcaaaggcttctaagaagcaaaggcagacagagcaggcacctggttcattgtcagcacagtcggtgcttgctatggactggccctggtgctgcggacgccaagcagcacttctgcaaaaggccacagcaccttttgggaaaagtgaagcaaaggcccccttctcaaaggaacacctggggtcctggtcaatacgaagcatgttagcattcacctaacatgtcactgttcacctaacagtcactgttcaatccaaccagcataaaaatataaatgggaaagaattcccacaaatttgcattcaaaacttcaagaagcaaaacttacaatccatctgcaggccagtttagaccacgttaacacaatttcaatctttattcccaacaaggaagtcaggatactgtgaggaaggtgaggggctgctgaacaccccac

SEQ ID NO: 459711 - DNA, 5519 bp, Homo sapiens
agcggggcggtggtcgcgcgctgctcggggcccgactgcggcgcgagggcggcgcgggagcgacgctggcccggaccgaggaaactatgccccagacgtccgttgtcttctccagcatccttgggcccagctgtagcggacaggtgcagcctggcatgggggagcgtggaggcggggccggtggcggctccggggacctcatcttccaagatggacacctcatctctgggtccctggaggccctgatggagcaccttgttcccacggtggactattaccccgataggacgtacatcttcacctttctcctgagctcccgggtctttatgccccctcatgacctgctggcccgcgtggggcagatctgcgtggagcagaagcagcagctggaagccgggcctgaaaaggccaagctgaagtctttctcagccaagatcgtgcagctcctgaaggagtggaccgaggccttcccctatgacttccaggatgagaaggccatggccgagctgaaagccatcacacaccgtgtcacccagtgtgatgaggagaatggcacagtgaagaaggccattgcccagatgacacagagcctgttgctgtccttggctgcccggagccagctccaggaactgcgagagaagctccggccaccggctgtagacaaggggcccatcctcaagaccaagccaccagccgcccagaaggacatcctgggcgtgtgctgcgaccccctggtgctggcccagcagctgactcacattgagctggacagggtcagcagcatttaccctgaggacttgatgcagatcgtcagccacatggactccttggacaaccacaggtgccgaggggacctgaccaagacctacagcctggaggcctatgacaactggttcaactgcctgagcatgctggtggccactgaggtgtgccgggtggtgaagaagaaacaccggacccgcatgttggagttcttcattgatgtggcccgggagtgcttcaacatcgggaacttcaactccatgatggccatcatctctggcatgaacctcagtcctgtggcaaggctgaagaaaacttggtccaaggtcaagacagccaagtttgatgtcttggagaggggcatctggagcaggtcggaggggcatggggctgtgatgctcaccaggtcctccctgtgcccacagcatcacatggacccgtccagcaacttctgcaactaccgtacagccctgcagggggccacgcagaggtcccagatggccaacagcagccgtgaaaagatcgtcatccctgtgttcaacctcttcgttaaggacatctacttcctgcacaaaatccataccaaccacctgcccaacgggcacattaactttaagaaattctgggagatctccagacagatccatgagttcatgacatggacacaggtagagtgtcctttcgagaaggacaagaagattcagagttacctgctcacggcgcccatctacagcgaggaagctctcttcgtcgcctcctttgaaagtgagggtcccgagaaccacatggaaaaagacagctggaagaccctcaggaccacccttctgaacagagcctgaggcggatgcagcccgcgacgccagaggaagcacgtgcactaactgggtttaaattttgactgatgtgggttgagatgaggaggcctcactggttggggtccattttgtatataacttttatgagaaaaaaatggtaattatttcacgcatcaacctttggcacttacaaagttttttttgtttattttaaataacagggcagggccctgctttggggagggggaggggagagtatcatgggagatggtatccatgataacatcttattctaatgaaatgtagatttttattttctacttttgattattaacatcttatgaaaaaaatattttaaaaaacccagccaaaaccaacgtgagccctgcctgctcggacgcctttccagccagtgtctctgacgtcggggttagtgccttagagggtactggggtctggtcttcctgctctgtggtttgggctgcggtgagtcccactccacctgggcgcctgccctcaggagcctgggctgcgaggctccataggagggctggtggctgggaggtcgcgtccgcacacttctggaagtgagcctttgagtacgggctgtccaaagtttacattttcattttcctttcagggatttgtggggtcagggaggggcagggggcacctggcagcatattttctgtgacaatgtgtccagcaaatcattcttcaactacattttagaaaggaggaaatctaaaataaggtaagggagggaagcatggagttgtcagttttctgggctgtgactgaaagacacactgagctgtgatgaagaaaaatacatggccgactccagggtggtgacatttagagctagtcttgaaacctatcatctacagaggggagggcagccaacagccctcttcccacctgggtaggcagcgccctaattggaattggaaacagaaaattcgccaggccatactgctggagcccattcagataaaactgcccaatactgagaggtgttttctacacccagctagaggagcacactccattttcccatgtctgacttcgtggtgtgagccctgggccctactgaccatggcgcaggacagctgtccttcagaaagcacacggtcaatccacgtggaccgtctccctcgcaggaactccgcatccttgtccctctgcattcccagtttccgcaggagccttgatcaatggggaagcctgggtgaggatgggccaggtcccaattcccaaagctcctggaagagcctgaagacattgggaaaggctgggcctggggaggaggcagccctgggcccgctgcccatgcctctggtcctgggtggagcaggaatagttccactgtattgtcacagtgtgtttgcactttctgaggttctagctagtacagattgtatattgatagtacatattgctttgtttatgtctttgagatgagaaaggcttaaaacttgagaatatatatttggaatacagccttagaacggtttctgtacacacccacgtgcacttcacgggtgatcagttctagtacctacttgaaacagtgtctgtctgctactttattttcccaatttgatacataccctgatttgatgttttggtatttgagatgaactctgagtatgaagctgtaccataatgcaggacgtcagttttggtgtgactggacatacttgcttcaataaaagaatacatcactcccctcccttgcctgctgtgtgtgtacagtgagggggtggccttgctgctggccggagacatgggtcccctggggcagggaggagggtgaggctgccaggcctgctgtggccttcccaggagggactgggcaagagacttttgtctccagctggcaacactttgtgtgacaaagggctttccactgaataaggtgagactcgaaagaagctataggaggcacgttcagtcctgctttcctcattgtgagctccaaaaagatgtcactggctgctgtattgcatggtcacataagtaagtaagttcaggatacctagttaagccaggctgtatggactgtgttactgcagaggagtcagatggcctctctgggggcaggggaggttggagagcccctggacgcgatcctgcagggcagcctgcagaatgcaggtctggaggggccactcctggtgtcatgagttttatactcaagcgcaacagagaagaggggttcactgggggagcacatgagagctcgggaattgaaggaaaaaaactaaggctccagaacaggacatggtactcccctctgctcctccaacctgcccattcccacggttctcaggcctggacagggtggggactgcaccccagggataactcagctcatctttcactatgtgctcagtgtcatcattcccacgaggtgagcgccacccaacagaaacctttctggggtaagggaatgtcctgtatctgtgctgtccagtacagcagctgccaaccatatgtgggtcctgtctgctgggatgtggctagtgtgacccaggggctgaatttgggatgtgaatttggacagccaggggcccgtgttggacagaagctgggcctcggggccttgccaccccatgcagtgggcagtgcaggacaggtgctcgggtgtctgtggagcaaatggggacatggagatgatgcttgagcttttagtgaatgacattttttaggtctttaaatccaatggcatccctaatttcctggtgaagaagttatttttggaagtgttcatctgcctcagctgaagaagggggagtgcataatttgctctggccttggatacaacctcgagctgggagggccatcccctgccatgggcagttcctccagggcagtggctttcaagtgtgggtccttgggaacctgtttgaatgtccattcttaggcctctccacacacctcctgaattggcaatacggtgggggcctagtccaatccctgggccacacagtacgtgtgagaagcactcggtgggtgatagtctgtgtgccttgtgaccagtacatccctgtgtgatggctgagtgtcacccttcacaaacgttgcaggaacaaatggatgtcagagtgtcagatgtagcagaatgataagctaaggatctgtagtaagccatggagacttctgtgacacacactgcttgtgacacacaccgaccacgcccatacgagaacatagaccctgctcctcagggaggcacaaggcagcagggagggagcaaggagccggggaaactggagtgagagctggtttcagcccccagctggagaagcttggacaagctgtttaccttatagcctccatgtttttcatctgatcacggctctcttgcagggccgtggtagcagacagagcaggcacctggttcattgtcagcacagtcagtgctcgctgtagactggccttggtgccgaggacgccaagcagcacttctgcaaaaggccacagcaccttttgggaaaagtgaagcaaaggcttctaagaagcaaaggcagacagagcaggcacctggttcattgtcagcacagtcggtgcttgctatggactggccctggtgctgcggacgccaagcagcacttctgcaaaaggccacagcaccttttgggaaaagtgaagcaaaggcccccttctcaaaggaacacctggggtcctggtcaatacgaagcatgttagcattcacctaacatgtcactgttcacctaacagtcactgttcaatccaaccagcataaaaatataaatgggaaagaattcccacaaatttgcattcaaaacttcaagaagcaaaacttacaatccatctgcaggccagtttagaccacgttaacacaatttcaatctttattcccaacaaggaagtcaggatactgtgaggaaggtgaggggctgctgaacaccccac

SEQ ID NO: 459712 - DNA, 803 bp, Homo sapiens
cttagagatggggtgggtttttttaatataagtttatttaagtgaaaaagaaagtcaacttaaggggaaggaagaaggaaccaaacaggagtcatgtggcggttcaggtttggccaaaccgcaggtggcacgcagttgggggctgtgcccagcacagggcctggggtgtggcttggggatgtgggaagcttgcaccatttgccatctagtaccctactctgccctgtggggccttactctgtatcccctgctgccccaggccaagctgaagtctttctcagccaagatcgtgcagctcctgaaggagtggaccgaggccttcccctatgacttccaggatgagaaggccatggccgagctgaaagccatcacacaccgtgtcacccagtgtgatgaggagaatggcacagtgaagaaggccattgcccagatgacacagagcctgttgctgtccttggctgcccggagccagctccaggaactgcgagagaagctccggccaccggctgtagacaaggggcccatcctcaagaccaagccaccagccgcccagaaggacatcctgggcgtgtgctgcgaccccctggtgctggcccagcagctgactcacattgagctggacagggtcagcagcatttaccctgaggacttgatgcagatcgtcagccacatggactccttggacaaccacaggccgaggggacctgacaaaaactaaagctggggggctttgaaaattggttcactgactgacaaggttggtggcctgattttccgggggggaaaaaaaaccgggacatttg

SEQ ID NO: 459713 - DNA, 1500 bp, Homo sapiens
tgggtacagagttttagtttgggaagatgaaaatgtctggtgatggacggcaatgatggttgtacaacaatgtgaatgtaccttaatgccgcttaaaatggctaaaatgctgtttgcagacaaggtcccaaagacagcagaaaattttcgtgctctgagcactggagagaaaggattggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccttgggtccatgttttccttgttccctcccatgcctagctggattgcagagttaagtttatgattatgaataaaaaccaatacacaaaaaaacaagaaaagaaattattttagtcagatagagacaaaaggggtcctttggaagttttcgttttttaaagcatctctggaaaagtttcttgtaaagccccagctcttagagccaggctggcaacctttgataagcaaatgatggccattagaaactgggtccacccaaacatggccattcctgcagccttcttgcccttgccccacatgttcctggcaatatggccgcccccgcatatccccacatgtgtagaacatcatggcaccctgtatttgcatattaaaaagctagggtgggagagccagctttttcacgggctacgtgaatgacatgcctggccaaaccaatcccctgagccctatgtaaatcagacaccacctcctccagcctctgtatatatacctggctggagggcactagtaactccaactggtggcaccagaaagtcaggagctgaaaatatacaactatgacccaggttggtcaattaggttctcctataaaattgactgtccatcaactatcaacagaaatactaattcatcactaatttaaattcattaacagatatgacattccaaacaaaattaaaagaaggaaatatatttacgcacaagtaaagtatcgtcctcatcctagaggaaatataaatgaaaggcatttgaaaatgataagcattagaataaagcacaaattctgctgcttggttttcagcctcttcatgacctaggcccaactatctttttttttttttcctt

SEQ ID NO: 459714 - DNA, 1262 bp, Homo sapiens
gacgcgggcctggctgtaatttcactcgccaggacccgcagctcagctacagcacagatcagcaccatgaagcttctcacggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccttgggtccatgttttccttgttccctcccatgcctagctggattgcagagttaagtttatgattatgaataaaaaccaatacacaaaaaaacaagaaaagaaattattttagtcagatagagacaaaaggggtcctttggaagttttcgttttttaaagcatctctggaaaagtttcttgtaaagccccagctcttagagccaggctggcaacctttgataagcaaatgatggccattagaaactgggtccacccaaacatggccattcctgcagccttcttgcccttgccccacatgttcctggcaatatggccgcccccgcatatccccacatgtgtagaacatcatggcaccctgtatttgcatattaaaaagctagggtgggagagccagctttttcacgggctacgtgaatgacatgcctggccaaaccaatcccctgagccctatgtaaatcagacaccacctcctccagcctctgtatatatacctggctggagggcactagtaactccaactggtggcaccagaaagtcaggagctgaaaatatacaactatgacccaggttggtcaattaggttctcctataaaattgactgtccatcaactatcaacagaaatactaattcatcactaatttaaattcattaacagatatgacattccaaacaaaattaaaagaaggaaatatatttacgcacaagtaaagtatcgtcctcatcctagaggaaatataaatgaaaggcatttgaaaatgataagcattagaataaagcacaaattctgctgcttggttttcagcctcttcatgacctaggcccaactatctttttttttttttcctt

SEQ ID NO: 459715 - DNA, 890 bp, Homo sapiens
tgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggattggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccttgggtccatgttttccttgttccctcccatgcctagctggattgcagagttaagtttatgattatgaataaaaaccaatacacaaaaaaaaaaagggggggggctaagtatcccagggcgagttacgcgaccagttttgtcaagggggccaagggggggtaaagaaaggggcgggtaaagtgggggaaggtcggtttggaaactttggggggatggaccaagtagcggataaatggtaggaggttgtgggattgtgttatacg

SEQ ID NO: 459716 - DNA, 1009 bp, Homo sapiens
gtaatcttttaaaagacattttaaatggcaattaaactcacatgtaattgcaacaatgtatacaactcaattaaagtgctaacaacatgaacaactgagaccaagttcacccatgcccaggtcttgatgacctcaccatggcagctccctggcccagggtgattataagatgccagtgattgcaagacttggcctgatttcagaagtgatgatgtggcaacacagacatcttagaattaaggaaatagttttaattcttggtgctctttcttggcattctgaaagtgttcctccagtttgccatctaagatattccttagttttctgccatgtccatttcactcatttactccttcctatatgacttttaattattgtttaataatttaattttcttgggaatatctttctcttgttacaaccagtttcctttatatcttttcttggactccattggccaaattctctttcataagcctgaagcccctaatatttaccctgagactgtattctagttagtagaatgtgaatggaggtgatgtgtgtgacatataggacttccccataagagcctttaatgagttgtcctctgttctctttcccctcttccagctgagtgccatgagaggacagtgacaaccttggggcctcatggtgaaggtggcagaaactttgttagcctgggtgctcagggtggacagctgctcttgccaaccgggaacatttgccttgagctcttttgtaagtgacagataagcttttattgtacttcagccaagatacaaacattggacgtatttgtacagcagctaaaggtactataataatacatattctgaaatcactatgtaccctaaaatattttaacaaaattcttgcaatatttgtatgagaactgctggattttgctttcttaccaaatttgctgttgctactgaaaaaagagaataacttggacaatgaaatgatctcaaatgaggtaataaaatcattactgaattttaaaaat

SEQ ID NO: 459717 - DNA, 1484 bp, Homo sapiens
agaagtcccttccccaggcagggcatgaactcttctgtttctagaaccatttagggaggtgacaacttggcttcgtcccagagattcagagcagcggcgccccctggtggcacgcggtaggatgggcggcaaagaagcactcggcgtgggcggggcgggtgggggtcgcaaggccacttctctccttcctgcaggttctcagagatggaaggtgtcttagaggcgatgtttgagggcagcattagacatttcttcttccggctctctttcagccggcccctccagacgatggccattcctgttgccttggtccgcaggaacgatgggttatgcatgaactttgtagaacatggccttgtcttcaccaacgcggaggagagcccgttcgggctggctcctgagtccctgaggccatgctgcctctcagagaaggctgcgggacctgctgccacagctggcagccaggatggcccaagtggagccggcctgcccagatttgggggtcctagttgttatacgttgtgcctggggccaggctgtgtggctttttcggatccccaagactgggaaggggcgtggagcacgtgtccgttggaaccctgggggaggtcggtgctggaagcgctcatctccacctccagtctgggtgcgctgccgcggttcggggagacgcggccgggaggtggcagcagcggccctctggcagacacggtgcgtgccggggggcggggacgcgggcggctccgggcgggcgtggtccctcttgcgggcgcctgggctggtcgggcggatcccggagagggggagccgcggggacgcagcgacagactcggggtgctggcagcggcagcccacgcctcccagggattgcaggcctgggcgccggggttggaccagtctcccgggcatggcacgccctggttattctgtacccgtgatttgtggcggggcaagacgttaagttgggtgacaccgaggtgagccacggtcctcggcaccagatgaggaaccactgtctcaataagtgacaccagtgatgctgttaaacaaggacaatccggttcatggattgtgacaacgcacgctgacatcaagcagaccctgccgtcaggtacagagggcaccacagtgaccaggaactgctgtcctttcataccaggttttaggaggctttaccagaaggaatggaaaatgctggtgggcagtaagattgaaacagcatctgaggactggttctgcacaaaaccttaaattcttcaaggactttgacatttgtttattcttgtaacaaattaaaacctatcctgtgtgttggttagagatcttcaaactgtaaataccttgaggcaggagtgaggtttttatcttttaaaggacaggcccctactctcctacgtaatgagtttctaaaaatggatgtgagcaccaatcaatatttctctggttgttaaagtcaagaataaaatggtatttttaagctcgca

SEQ ID NO: 459718 - DNA, 1557 bp, Homo sapiens
agaagtcccttccccaggcagggcatgaactcttctgtttctagaaccatttagggaggtgacaacttggcttcgtcccagagattcagagcagcggcgccccctggtggcacgcggtaggatgggcggcaaagaagcactcggcgtgggcggggcgggtgggggtcgcaaggccacttctctccttcctgcaggttctcagagatggaaggtgtcttagaggcgatgtttgagggcagcattagacatttcttcttccggctctctttcagccggcccctccagacgatggccattcctgttgccttggtccgcaggaacgatgggttatgcatgaactttgtagaacatggccttgtcttcaccaacgcggaggagagcccgttcgggctggctcctgagtccctgaggccatgctgcctctcagagaaggctgcgggacctgctgccacagctggcagccaggatggcccaagtggagccggcctgcccagatttgggggtcctagttgttatacgttgtgcctggggccaggctgtgtggctttttcggatccccaagactgggaaggggcgtggagcacgtgtccgttggaaccctgggggaggtcggtgctggaagcgctcatctccacctccagtctgggtgcgctgccgcggttcggggagacgcggccgggaggtggcagcagcggccctctggcagacacggtgcgtgccggggggcggggacgcgggcggctccgggcgggcgtggtccctcttgcgggcgcctgggctggtcgggcggatcccggagagggggagccgcggggacgcagcgacagactcggggtgctggcagcggcagcccacgcctcccagggattgcaggcctgggcgccggggttggaccagtctcccgggcatggcacgccctggttattctgtacccgtgatttgtggcggggcaagacgttaagttgggtgacaccgaggtgagccacggtcctcggcaccagatgaggaaccactgtctcaataaggtctcagtgctgtgtgtgtaatggttaccgtgagagcttccctgcaatccgaatttgtgtgtctcattctcagtgacaccagtgatgctgttaaacaaggacaatccggttcatggattgtgacaacgcacgctgacatcaagcagaccctgccgtcaggtacagagggcaccacagtgaccaggaactgctgtcctttcataccaggttttaggaggctttaccagaaggaatggaaaatgctggtgggcagtaagattgaaacagcatctgaggactggttctgcacaaaaccttaaattcttcaaggactttgacatttgtttattcttgtaacaaattaaaacctatcctgtgtgttggttagagatcttcaaactgtaaataccttgaggcaggagtgaggtttttatcttttaaaggacaggcccctactctcctacgtaatgagtttctaaaaatggatgtgagcaccaatcaatatttctctggttgttaaagtcaagaataaaatggtatttttaagctcgca

SEQ ID NO: 459719 - DNA, 973 bp, Homo sapiens
agaagtcccttccccaggcagggcatgaactcttctgtttctagaaccatttagggaggtgacaacttggcttcgtcccagagattcagagcagcggcgccccctggtggcacgcggtaggatgggcggcaaagaagcactcggcgtgggcggggcgggtgggggtcgcaaggccacttctctccttcctgcaggttctcagagatggaaggtgtcttagaggcgatgtttgagggcagcattagacatttcttcttccggctctctttcagccggcccctccagacgatggccattcctgttgccttggtccgcaggaacgatgggttatgcatgaactttgtagaacatggccttgtcttcaccaacgcggaggagagcccgttcggttccagagaggatgctgcctcatctcgtctctaaaagaggaggaaggggagcaggtcccttcacgttctctggtctcagctgagaactctccctggaagtagcgggccgtgaaatgtttcacaagtgacaccagtgatgctgttaaacaaggacaatccggttcatggattgtgacaacgcacgctgacatcaagcagaccctgccgtcaggtacagagggcaccacagtgaccaggaactgctgtcctttcataccaggttttaggaggctttaccagaaggaatggaaaatgctggtgggcagtaagattgaaacagcatctgaggactggttctgcacaaaaccttaaattcttcaaggactttgacatttgtttattcttgtaacaaattaaaacctatcctgtgtgttggttagagatcttcaaactgtaaataccttgaggcaggagtgaggtttttatcttttaaaggacaggcccctactctcctacgtaatgagtttctaaaaatggatgtgagcaccaatcaatatttctctggttgttaaagtcaagaataaaatggtatttttaagctcgca

SEQ ID NO: 459720 - DNA, 511 bp, Homo sapiens
agaagtcccttccccaggcagggcatgaactcttctgtttctagaaccatttagggaggtgacaacttggcttcgtcccagagattcagagcagcggcgccccctggtggcacgcggtaggatgggcggcaaagaagcactcggcgtgggcggggcgggtgggggtcgcaaggccacttctctccttcctgcaggttctcagagatggaaggtgtcttagaggcgatgtttgagggcagcattagacatttcttcttccggctctctttcagccggcccctccagacgatggccattcctgttgccttggtccgcaggaacgatgggttatgcatgaactttgtagaacatggccttgtcttcaccaacgcggaggagagcccgttcggttccagagaggatgctgcctcatctcgtctctaaaagaggaggaaggggagcaggtcccttcacgttctctggtctcagctgagaactctccccgcaagaagaaaatgatcgggtaccgagc

SEQ ID NO: 459721 - DNA, 3502 bp, Homo sapiens
agaagtcccttccccaggcagggcatgaactcttctgtttctagaaccatttagggaggtgacaacttggcttcgtcccagagattcagagcagcggcgccccctggtggcacgcggtaggatgggcggcaaagaagcactcggcgtgggcggggcgggtgggggtcgcaaggccacttctctccttcctgcaggttctcagagatggaaggtgtcttagaggcgatgtttgagggcagcattagacatttcttcttccggctctctttcagccggcccctccagacgatggccattcctgttgccttggtccgcaggaacgatgggttatgcatgaactttgtagaacatggccttgtcttcaccaacgcggaggagagcccgttcgggctggctcctgagtccctgaggccatgctgcctctcagagaaggctgcgggacctgctgccacagctggcagccaggatggcccaagtggagccggcctgcccagatttgggggtcctagttgttatacgttgtgcctggggccaggctgtgtggctttttcggatccccaagactgggaaggggcgtggagcacgtgtccgttggaaccctgggggaggtcggtgctggaagcgctcatctccacctccagtctgggtgcgctgccgcggttcggggagacgcggccgggaggtggcagcagcggccctctggcagacacggtgcgtgccggggggcggggacgcgggcggctccgggcgggcgtggtccctcttgcgggcgcctgggctggtcgggcggatcccggagagggggagccgcggggacgcagcgacagactcggggtgctggcagcggcagcccacgcctcccagggattgcaggcctgggcgccggggttggaccagtctcccgggcatggcacgccctggttattctgtacccgtgatttgtggcggggcaagacgttaagttgggtgacaccgaggtgagccacggtcctcggcaccagatgaggaaccactgtctcaataaggtctcagtgctgtgtgtgtaatggttaccgtgagagcttccctgcaatccgaatttgtgtgtctcattctcagtgacaccagtgatgctgttaaacaaggacaatccggttcatggattgtgacaacgcacgctgacatcaagcagaccctgccgtcaggtacagagggcaccacagtgaccaggaactgctgtcctttcataccaggttttaggaggctttaccagaaggaatggaaaatgctggtgggcagtaagattgaaacagcatctgaggactggttctgcacaaaaccttaaattcttcaaggactttgacatttgtttattcttgtaacaaattaaaacctatcctgtgtgttggttagagatcttcaaactgtaaataccttgaggcaggagtgaggtttttatcttttaaaggacaggcccctactctcctacgtaatgagtttctaaaaatggatgtgagcaccaatcaatatttctctggttgttaaagtcaagaataaaatggtatttttaagctcgcaactgtgtaggatgaattctgtacacttttatttccctctgttctcctttcctatttgaaagtttattagtttgtggacttgggatcggattattcatgcattattttttgatgttgtatgtctcttggttcttgggtatttttgacacatattctgtcttgtaaccatagttaaacaattgttttagaccaactctctgtgtgtaattggcttcaacactcactgctagtcctttgacgctctgtttttttccattcttgagtaattttaagtcatcacttgggcagttgaaatatattttaaagtgatttaaagaatatgtgagtggcagacattctgaactcttttggttgtctgtcctcaaaaactaaaacttatttgtgagtaaaattttcatctaagtgttttccatataaaaactctgtcagctactgctccattgtagtagacacaaaaaagtcagcacaattttcatccctccctccctcccttctcttccccttccccttcttgccctccttccttccttccttctttccttccttccttccttccttccttccttccttccttccttcctttttcttttgtttctgaatgtacaaagaaaacacttaaaaatttgcttgtaatttaaaaacttgtcaggatatttctggatttgagtgtttcttggttacttttacctggaacctggtgaactgagtccattcctctgtttgccctttctgtacttttttggaaagttttctttaattatatcttcaattattgtttctcttttgattgttctagattcttcttcagaaacataactcttaggctcaatctctattcctggtcttccatagctatcgtcttctttttaaagtactgtattttattgaatctaagctagtatttgttgtaagaagcactattattatatgtacaactaaggaagaaaaaatgctgccaattaaactgtgacataatgccatgattacagtcctgtgaaattgttcctcatttgtaaagtggagataatagaacttatcacatagggctaatttgaaaattaaacaaaatagtacatgcatctcatctagtctggtgcctgacacagtgaccagctacatgcatgttgtttctctgcctctttacaaatgtatatttccagctctcttcctgcagaagcctttctcatctgccctcatctcacactcctcactcatttgctctactatttccttgagaatcatattcacaccattatattgatacatgcttgtttatattaatttatcaataatttgttgagcacaaggaataatatgaatttagcagtgattgtgctccagccatgagcaaggctctaggtattatacgatgtttaaggcactgccatgattttgaagtgtcctggccaattgaaggatgcaattcatgcctccagggactcagaatctacttgggaagtgcaatccataacaaacatgtgagatatgaaaataacgaacaaaacattttatggttgtgtcaaaatgagtgtatagaggagaataagaatgtgtaaattcattcattcatttaaatatttaggtgtttgtgttaggtactgtggcagatgctgggaatataatgatgagtaaaacccacaggatcccagtcctcatggagtttatattctagtagagatgacagacactgaataaatggaatggatccacatataattagttacagttgtaataagtgataggaaagaaaaagtggggggtgggtgcttagtactcagaagatggggcagattgctacagcccagggtaattagagagtaatttgtgggagaggtccaattgaagaatggttgatgagaataactggagaggaaagatggggtccaaaggtcaggacatagaaacagtgttcagatgttaataataatagtttatatctggattac

SEQ ID NO: 459722 - DNA, 3429 bp, Homo sapiens
agaagtcccttccccaggcagggcatgaactcttctgtttctagaaccatttagggaggtgacaacttggcttcgtcccagagattcagagcagcggcgccccctggtggcacgcggtaggatgggcggcaaagaagcactcggcgtgggcggggcgggtgggggtcgcaaggccacttctctccttcctgcaggttctcagagatggaaggtgtcttagaggcgatgtttgagggcagcattagacatttcttcttccggctctctttcagccggcccctccagacgatggccattcctgttgccttggtccgcaggaacgatgggttatgcatgaactttgtagaacatggccttgtcttcaccaacgcggaggagagcccgttcgggctggctcctgagtccctgaggccatgctgcctctcagagaaggctgcgggacctgctgccacagctggcagccaggatggcccaagtggagccggcctgcccagatttgggggtcctagttgttatacgttgtgcctggggccaggctgtgtggctttttcggatccccaagactgggaaggggcgtggagcacgtgtccgttggaaccctgggggaggtcggtgctggaagcgctcatctccacctccagtctgggtgcgctgccgcggttcggggagacgcggccgggaggtggcagcagcggccctctggcagacacggtgcgtgccggggggcggggacgcgggcggctccgggcgggcgtggtccctcttgcgggcgcctgggctggtcgggcggatcccggagagggggagccgcggggacgcagcgacagactcggggtgctggcagcggcagcccacgcctcccagggattgcaggcctgggcgccggggttggaccagtctcccgggcatggcacgccctggttattctgtacccgtgatttgtggcggggcaagacgttaagttgggtgacaccgaggtgagccacggtcctcggcaccagatgaggaaccactgtctcaataagtgacaccagtgatgctgttaaacaaggacaatccggttcatggattgtgacaacgcacgctgacatcaagcagaccctgccgtcaggtacagagggcaccacagtgaccaggaactgctgtcctttcataccaggttttaggaggctttaccagaaggaatggaaaatgctggtgggcagtaagattgaaacagcatctgaggactggttctgcacaaaaccttaaattcttcaaggactttgacatttgtttattcttgtaacaaattaaaacctatcctgtgtgttggttagagatcttcaaactgtaaataccttgaggcaggagtgaggtttttatcttttaaaggacaggcccctactctcctacgtaatgagtttctaaaaatggatgtgagcaccaatcaatatttctctggttgttaaagtcaagaataaaatggtatttttaagctcgcaactgtgtaggatgaattctgtacacttttatttccctctgttctcctttcctatttgaaagtttattagtttgtggacttgggatcggattattcatgcattattttttgatgttgtatgtctcttggttcttgggtatttttgacacatattctgtcttgtaaccatagttaaacaattgttttagaccaactctctgtgtgtaattggcttcaacactcactgctagtcctttgacgctctgtttttttccattcttgagtaattttaagtcatcacttgggcagttgaaatatattttaaagtgatttaaagaatatgtgagtggcagacattctgaactcttttggttgtctgtcctcaaaaactaaaacttatttgtgagtaaaattttcatctaagtgttttccatataaaaactctgtcagctactgctccattgtagtagacacaaaaaagtcagcacaattttcatccctccctccctcccttctcttccccttccccttcttgccctccttccttccttccttctttccttccttccttccttccttccttccttccttccttccttcctttttcttttgtttctgaatgtacaaagaaaacacttaaaaatttgcttgtaatttaaaaacttgtcaggatatttctggatttgagtgtttcttggttacttttacctggaacctggtgaactgagtccattcctctgtttgccctttctgtacttttttggaaagttttctttaattatatcttcaattattgtttctcttttgattgttctagattcttcttcagaaacataactcttaggctcaatctctattcctggtcttccatagctatcgtcttctttttaaagtactgtattttattgaatctaagctagtatttgttgtaagaagcactattattatatgtacaactaaggaagaaaaaatgctgccaattaaactgtgacataatgccatgattacagtcctgtgaaattgttcctcatttgtaaagtggagataatagaacttatcacatagggctaatttgaaaattaaacaaaatagtacatgcatctcatctagtctggtgcctgacacagtgaccagctacatgcatgttgtttctctgcctctttacaaatgtatatttccagctctcttcctgcagaagcctttctcatctgccctcatctcacactcctcactcatttgctctactatttccttgagaatcatattcacaccattatattgatacatgcttgtttatattaatttatcaataatttgttgagcacaaggaataatatgaatttagcagtgattgtgctccagccatgagcaaggctctaggtattatacgatgtttaaggcactgccatgattttgaagtgtcctggccaattgaaggatgcaattcatgcctccagggactcagaatctacttgggaagtgcaatccataacaaacatgtgagatatgaaaataacgaacaaaacattttatggttgtgtcaaaatgagtgtatagaggagaataagaatgtgtaaattcattcattcatttaaatatttaggtgtttgtgttaggtactgtggcagatgctgggaatataatgatgagtaaaacccacaggatcccagtcctcatggagtttatattctagtagagatgacagacactgaataaatggaatggatccacatataattagttacagttgtaataagtgataggaaagaaaaagtggggggtgggtgcttagtactcagaagatggggcagattgctacagcccagggtaattagagagtaatttgtgggagaggtccaattgaagaatggttgatgagaataactggagaggaaagatggggtccaaaggtcaggacatagaaacagtgttcagatgttaataataatagtttatatctggattac

SEQ ID NO: 459723 - DNA, 715 bp, Homo sapiens
  misc_feature (692)..(692): n is a, c, g, or t
gtcttaacaattctaatttttaaaaaaaatattactattttttttcatcagagccattgcactggaaaataattttttattttcatgatagcctaccgttgaatttaccgttctgatattaatgaaacatctctataaagggttgaagtgtcttcccggattgtcaacttattttattttattttcttcaagcaacaattgctaaggaacagaattgtcaatttattaatgaaatatgacgtgtgttgaacaagacaagctgggtcaagcatttgaagatgcttttgaggttctgaggcaacattcaactggagatcttcagtactcgccagattacagaaattacctggctttaatcaaccatcgtcctcatgtcaaaggaaattccagctgctatggagtgttgcctacagaggagcctgtctataattggagaacggtaattgttggagtgcagtggtgcgattatagctcactgaagcttcaaattcctggggtcaagggatcctcctgcctcagcttcccaagtagctgggactatagacatgtgccaccaggcctggaacagtgctgcggacttctattttgaaggaaatattcatcaatctctgcagaacataactgaaaaccagctggtacaacccactcttctccagcaaaaggggggaaaaggcaggaaggaagcttccgantgttttggattaccttccacgga

SEQ ID NO: 459724 - DNA, 822 bp, Homo sapiens
gatggttatgtcttaacaattctaatttttaaaaaaaatattactattttttttcatcagagccattgcactggaaaataattttttattttcatgatagcctaccgttgaatttaccgttctgatattaatgaaacatctctataaagggttgaagtgtcttcccggtaagttctcagcttatgtttttctaaatatcttctaatcactgttcattttttcctttggcctaatgagtgtttctcactgtctgcgtgttcagatgcaagaaatattaagcaatcatagtaatcaataatgttttcaagctttttcttccttttagatttgctacttgtaatagctgcgatagtcttgtggagcattttagtcaaagagaacatgttcatttttaaatatttaattcaaaatacaacattcagtgcttctgcacttttgagtcaaagcagttaattgaaaatcactgacatggcttttaaaaaatatgtgctactgataatattcactaaagaccatgagccgaagagtgatttctggattttcttctattttcttttaactgacatgatgtaatgatttcaaagagccaagcagaattttgatatttaatatgttatgttgatatatgatggatatatataatattggcattagattacatcatctcattttattattcaaagttaaacactaaagagtaaacacattgtgtttgcgggtaaatactaagaagataaatacttgcataaaaagaactgctgggtttacttaatggaatgataagcaattttggacccaccacagttctttttattatgtggg

SEQ ID NO: 459725 - DNA, 1375 bp, Homo sapiens
gtcttaacaattctaatttttaaaaaaaatattactattttttttcatcagagccattgcactggaaaataattttttattttcatgatagcctaccgttgaatttaccgttctgatattaatgaaacatctctataaagggttgaagtgtcttcccggattgtcaacttattttattttattttcttcaagcaacaattgctaaggaacagaattgtcaatttattaatgaaatatgacgtgtgttgaacaagacaagctgggtcaagcatttgaagatgcttttgaggttctgaggcaacattcaactggagatcttcagtactcgccagattacagaaattacctggctttaatcaaccatcgtcctcatgtcaaaggaaattccagctgctatggagtgttgcctacagaggagcctgtctataattggagaacggtaattaacagtgctgcggacttctattttgaaggaaatattcatcaatctctgcagaacataactgaaaaccagctggtacaacccactcttctccagcaaaaggggggaaaaggcaggaagaagctccgactgtttgaataccttcacgaatccctgtataatccggagatggcatcttgtattcagtgggtagataaaaccaaaggcatctttcagtttgtatcaaaaaacaaagaaaaacttgccgagctttgggggaaaagaaaaggcaacaggaagaccatgacttaccagaaaatggccagggcactcagaaattacggaagaagtggggaaattaccaaaatccggaggaagctgacttaccagttcagtgaggccattctccaaagactctctccatcctatttcctggggaaagagatcttctattcacagtgtgttcaacctgatcaagaatatctcagtttaaataactggaatgcaaattataattatacatatgccaattaccatgagctaaatcaccatgattgctaaatatactttcatatttcatggtttactggcatcggaaatctctacaagttttaatgatttctccctccctctctttttttcctcctctgaagaaatttaggatttttctcttaaagcaaatactaaagaggaaaaaaaattaactttattgttgcttttatcaaagaagaaatgcaaattaaaaccacaataagatataatctctcacctgtcacaacgtcttaaaatgtttattattatgtttttaatcatcctgtactttatttcaaaacaatgttttcaaatgaagacacaaaagataagtgttggtaaggatgtagagcaaaggaaacacttgtacactgttggtggaaatgtaaattggtgtagccattatggaaaatggtatggaaa

SEQ ID NO: 459726 - DNA, 732 bp, Homo sapiens
ctcaccagttaaatgacaactgagttgggttcatttgtattcagcagaaatgggaaaggcttgaggcttgtcggccatgaaatatacatgttgaagagcaaaggagagaagtgcttggccgacaaggctaagacctcacacttaggagtgacccaaatgtttcctgaagatggtagaagagtgaaaaatcccacaggctctcctcttccaggaggggaaggtgcgggtgcccattgttgtcatggaatgggaactcacccatcacaatgggcaaaggagtcttctaaaccctcggaggattcttgccactggttccttgcagctgtgactccccagggtaagaggcaaagagccaccaggtcccagctgaggaagccctgtggtcagctcagacagggatgcggactgaagccgaagcaggtgttagtaattgtcgtacctacagacgaggaaaccgagcctccatgaagtgaagtgactcacccacagtcacacagctaatatatgccagagcccacagcagaacccagacgtactgaggccaagttccatgccagcataaaacaggctccagttctccctggattccaggaacaccatctccttcctcgtcccttccatcccagggaaggtctcctggttcttctagcccctctaacttcctctcatctctcctgtaacaacaatgatcagaatgatacctgaggaataaaccataagaaaaatgagcat

SEQ ID NO: 459727 - DNA, 1156 bp, Homo sapiens
ctcaccagttaaatgacaactgagttgggttcatttgtattcagcagaaatgggaaaggcttgaggcttgtcggccatgaaatatacatgttgaagagcaaaggagagaagtgcttggccgacaaggctaagacctcacacttaggagtgacccaaatgtttcctgaagatggtagaagagtgaaaaatcccacaggctctcctcttccaggaggggaaggtgcgggtgcccattgttgtcatggaatgggaactcacccatcacaatgggcaaaggagtcttctaaaccctcggaggattcttgccactggttccttgcagctgtgactccccagggtaagaggcaaagagccaccaggtcccagctgaggaagccctgtggtcagctcagacagggatgcggactgaagccgaagcaggtgttagtaattgtcgtacctacagacgaggaaaccgagcctccatgaagtgaagtgactcacccacagtcacacagctaatatatgccagagcccacagcagaacccagacgtactgaggccaagttccatgccagcataaaacaggctccagttctccctggattccaggaacaccatctccttcctcgtcccttccatcccagggaaggtttacactgaaaattttttgtgatgaaaagatttgaagaagatgacaggagatggagaagcaccagctgatctgcagactccaaggaggtcccaggaagaggtgtcatccactaagatcttctgggacaggaaagccctgtgatacctcttacatcacaccaaacagagccccacaccaagaaaagagctgcccacacctcacagaagccatgttagtggacatttctccactctggaagccttcctgcgtggtggaggccagtgcagaccatcctctgcccagaagagttgcattctaaatgacccctcagagagccctctggatggccgcctctcccacaggtccctgcaatcacataaaaaacactcattgcagccaagatgcacaaagcacagtattgatttcatactcaggtttttccaaaacaaatcataaacccacaccaattatgtccaatcagttttatggataaagaagcctgagactctccaacaggagagcttgagtttcccttctcactct

SEQ ID NO: 459728 - DNA, 1310 bp, Homo sapiens
cagcagaagacaaactggggactgcttaaggcactaactttgataatgggcaatttaaacaacatatgggaacatttagaaaaatctggacaagttaaagaagttggtggactcaagcagttgactgctatgcagccaaaatatatgttcccaacagaaggtgagctgcttcctacaatacacgtgaccattttccccggtccctctagtttgcaaagcctgtttggtggtctcttcacacggacgtgcatgagatttggtgctgtgactcagatcgggggacctccccttgggagatcaatccgctgtcctcctgttctttgctccatgagaaagatccacctacgacctcgggtccttagactgatcagcccaaggaactcatctcaccaatttcaaatcggatctcctcggcttagcggctgaagactgacgctgcctgatcgcctcagaagccccctggaccatcacgcacaccgagcttcgggtaactcttacagtggaggattctcagccgtatgaagacaccctagctggacgatcagttcttgttaagaatctgacccctcaaactctacaacctcgatggaccggaccctacttagtcatctatagtaccccgactgcggtccgcctgcaggatcctccccactgggttcaccgttccagaataaagctatgtccattggacagccagcctaatccgtcctcttcctcctggaagtcacaagtactctcccctacttcccttaaactcactcatatttctgaagaacagtaataacccttataagcctaatacatcccttcattctattaggtctgttcatccttaccctacttttgcaacagggctttatgcagtcacccccactacttacaccgggccccaaaaactagtcatccctactctcttctgtctagtcatactcctattctccattctcaactacttataaatgccctactcttgtttacactgctggtttacactgtttcttcaagccatcacagctgatatctcttggtgctatccccaaaccgccactcttaattccctcttagagtggatagatgatctttgttggcaggagaccctccaatactttcaccctgatgaagttctattctttacttttattctttacttttatactcactcttattctcattcccattcttatgccaccctcttcctctctccagctatctccaccatactatcaaccttaccctttctctcctagccatttctaatccctccttagcgaacaactgctggctttgcatttccctttcttccagcgcct

SEQ ID NO: 459729 - DNA, 1492 bp, Homo sapiens
gagggtctcccaggtcctgcaggagcagttggcttccttcagaggaacaatttctaaatacgtaaatacatggccatacatgtagacacaaaaagggctagaaaatatagtttagctgtgcatctgtgtgctcaggaagataaggagaataaatcaggtagaaaatggcagcagccttcactgattaagagaccaatctggaatcagagccctcactacctttaccccacttacaacaccagaacccacagtattcccttgccaaactcctgtgtttctctggcaatatgcagaccaaggaaaactgaagaaaatacaaccacaagcagatgggaagccataaagcagcaaacaggaaaaagctgtccctccttcctctccagctttgcagtcctcctctcgagccccctgctggaagaccctaccacagaacagcctggggaagcaaaaatgaagtttggtagagttctcaccacaccatcacaaagagagtagggttctagaggttgcctgcattccttgactcctgaatctctatcaccttcagagccagatatttcctgctgagtctttctgaggctgcatcaccctgaccctgactcttccatctccatccttcatgcttaaaggatcctggtgattacattggaccctcccgtacaatctaggatacatttttaaccttaaggtcttcaagggatcaccacactgtcttccacaatggttgaactaattttcacccccaccaatgatgctaccattgaatttaattatgatgctgtcttcaacatggaagttacataagaaaatctgaagccattgtgtatttcagctaggcttcttcttaggaaatagaggtcagcctagtgcagtgaagtctgattggaggtggacaatgaggatcctgccaaggtgctgtccttagcttctgttcagcctaatgtaagttcattccttttgattacagtcatttcaatgactttttttgcccataaaattatgaccacataattcttatagactcttctagcttttcaatgttggggaagaaagctcgcctaataagcaacttttcaacctcagaagcttaagtattatgaagcaataagacccaagatttgatgaaagaaaagccagaatttagtatggctgaagataggtggggatacagaccatggcaggcactggtaatacaaaggtgaacaagattcgggctgcattctaaagtatgaatgaataaaaaagtgtgcttattagaaatgactgaccaaatttagaatctaaagaaatattcaaagcagattcttggtgttcagaaactcaggtatctatctccattctacatcattcctacatcattttcatcccaaatgccaacatatactaatgagattttcaaaaaggaaaaacttgtgtatagtgatactctaaataggtaagtttgacatagattcttaacaaaagtataaaccagattattaacaatggtttt

SEQ ID NO: 459730 - DNA, 1870 bp, Homo sapiens
gcagcagtacagtccagcttcagctcggcatcagagtgaccctgtagctccaactactgggtcctcacagtcagtccactcctgcagaggaaactggagggtgaccaggaaccttcaagtcaatgtgggccacagacaggaaccgtctttaaaagatggttaaatgcccgtggtttacattcacttgtatgtgggaccagtgtgggaaggtcttgtttatgtgggaggggggaccacagataacaaagaacagccccttgcccccctcattgaaaaccagctgtgcatctagacctctgtcttcccacagtgccgccaagctcctggacaagaacccattctcggtcagtaacccgaaccctctgcttccttcacctgccagtctccagctggctcaactgcaggcccagctcaccctccaccggctgaagctggcacagacagctgtcaccaacaacactgcagccgccacagtcctgaaccaagtcctctccaaagtggccatgtcccagcctctcttcaatcaactgaggcatccgtctgtgatcactggcccccacggccatgctggggttccccaacatgctgcagccatacccagtacccggtttccctctaatgcaattgccttttcaccccccagccagacacgaggccccggaccctccatgaaccttcccaaccagccacccagtgccatggtgatgcatcctttcactggggtaatgcctcagacccctggccagccagcagtcatcttgggcattggcaagactgggcctgctccagctacagcaggattctatgagtatggcaaagccagctctggccagacatatggccctgaaacagatggtcagcctggcttcctgccatcctcggcctcaacctcgggcagtgtgacctatgaagggcactacagccacacagggcaggatggtcaagctgccttttccaaagatttttacggacccaactcccaaggttcacatgtggccagcggatttccagctgagcaggctgggggcctgaaaagtgaggtcgggccactgctgcagggcacaaacagccaatgggagagcccccatggattctcgggccaaagcaagcctgatctcacagcaggtcccatgtggcctccaccccacaaccagccctatgagctgtacgaccccgaggaaccaacctcagacaggacacctccttccttcgggggtcggcttaacaacagcaaacagggttttatcggtgctgggcggagggccaaggaggaccaggcgttgctatctgtgcggcccctgcaggctcatgagctgaacgactttcacggtgtggcccccctccacttgccgcatatctgtagcatctgtgacaagaaggtgtttgatttgaaggactgggagctgcatgtgaaagggaagctgcacgctcagaaatgcctggtcttctctgaaaatgctggcatccggtgtatacttggttcggcagagggaacattgtgtgcttctcccaacagcacagctgtttataaccctgctgggaatgaaggtgagcaaggccctacaggtcagcagcttgaagcagaagtgggctacccacaggcacattatgtcctgtctttaataaccaggacttccctgatgtccccttctcacggatgtagaaagcaaacagatcccaagacactaaaatgcattgggcctgctgtctgggcccatcagtattctctgagatacttgagactggagagttggctggcttttgaggtctagacccatttatacctggtacccttcaattttccactctgggaattacacttctctagtttccaagatgacatgaccagaagtgaggtgagcatgtgact

SEQ ID NO: 459731 - DNA, 1765 bp, Homo sapiens
gttctgcagagccagcctgaggttctgatgtctacgagtatgcagacagcgaaggtgcaggccgcgatatataggagcagaggcaccctgaacacgctgtcccccaatgccagctacaagtggatccagctaagagtgcggagggagaagccgtcctgcagctctgagatccacgaagtagaggtggtagtagcaccggaccccactgctttggagcctgcccaatcgaatttgggagccagcgaggttcctgactgcagcacattggccaccagaagacacacaaagctctgcaggtgtcggggcaaggaaggaccaagcgacctgagaagagcagaggtgccccatggggaccacgctgacttgtcgcatgtgcaccaaggccagccccactcagggccctcacagggcttctgcagagccgtcctgaggctctgacatctatgagtcggcggccagcagaggcgcaggccccagcacagaggagcagaggcacccggaacaagctgtcccttaatgccaccccaagcggggccagctcaggatgcggtgtttggagcagtcctgcagctctgcgatccacgaggtggtggtgggagtagcgccagagtccactgctttggagcctgccccgtctgattcaggagtcatgacgaccagaagacgccaaaagaccacaaatttttagaccaagtttataaaattagggatactcctatttcttagacaatcaaacaaatgatcagaaagactagataaatcaccatagtcacaaagcagttcacaatgcatttactgggtaatttctagttaacagtagcaatgatgatcacattgaaaatcttgtattttgtggtggttttctgttacgtaagcctcttgctttgttgaaaccatagattctaagctgctttgtcaaagtgatcattagaaaaatgtgatgtagtgtgtaaatgttagaaaatttctcctgttagtcttgttaatttgattgaacatgtgtgtcattttcaaaaatgtaaatcaaatatatgtgaatgggatatatatgtatacatatgaaatataacttgaattagagagtaggcttagctcatggcaatgttttttctgaaagcacctgcagaaatctctcttatttctagtttgttgatgtttcagagattatggagaaatggcggttctatgaatctcagacactgcatgaggcagatttggtttcagtaattttagcatcattcattgtaaggtgatgatccctaggaacttcatcacagtgagaaacctgaaaggtcctagcagccagcatgaatgaaaggtggggcggggctgctggcagggcagggccttgtgagccatatgcctgtgctctcaagttccaggattgtggggatgcatgcaggggattctggacctgattgtttcctctgaaccaggatgtggtctggttggcagggcaactggccttcacttggtggccttcagtggatgcccacattggttgccttcggttagtgcactcagttggtaccctcagttgtttctcttcagttggtggtcttcaattgttgggcagtggcagaaggaggatgaatccgtttgtgctctctcctcccccagtcacagctctcaggcttgttgcccccaggccctcctaaaataaaccagagatgttggcaggtttttcttagcagactaatcagctcaggatatgggggtgaggcagggtgtagggtgcaggttgctagcacagtgccgccccatg

SEQ ID NO: 459732 - DNA, 1069 bp, Homo sapiens
agaagagcaagagtgccccatggggaccacattgaactgtcgcatgtgcaccaaagccagccccagtcagggccggcacaagggttgtgcagagccagcctgtggctctgacgtctatgagtgtgcagacagcgcagacgcagcccgcaatatacaggagcagagttgccctgaacacgctgtcccacaatgccaaccacaaatggggccagctaagggtgtggtgggagaagccatcctgcagctctgagatccacaaagtggagatagcagtagcaccaactccactgctttggaggctgcccagtcgaatttgggagccagcgagggacctgacagcagcacattggacaccagaagacacccaaagggagaggagtggaagaccttctggtgtgggctgggcagcaattcacttgaaggagaaacagcccgggtgtggagaggtggccatccttggcgggatcctttctaaggagccgagaaatcaacgtagagcttcctctatctgattctctaacaactgcagaccttccatgagtcaagctttgtgtcaaaaggacaaattaaaaggacctataaatggcaccacccagcccaatggacagatgccccaggctgcagattctgtcagtgctgttctcgaagaggcccaggcacatgctgaaacatggaaggataagaagccagccctcgggaaccaccaggagccaggagcacccccggccccccaaggccccaagtccagcctgccccaccccctccggtgcagaggtcctgtgacaccagtggcagccccgccacaccccccaaggccaagggcacaggcagcgtggtcttccccgccccgcccgactacttcctgccgccacagccaccaatgccgcccctggagtacccagagctcccgctgccgtccccggacttcatggagacccccctggacttcgtgctccctcccctcgctgtcgccaagaggcctcctatgccccacccccccaacaggcacgaagcatcaatgttcacaagcagcaaatgaataaaagttaaacgttcttcctactgcaaa

SEQ ID NO: 459733 - DNA, 1303 bp, Homo sapiens
agaagagcaagagtgccccatggggaccacattgaactgtcgcatgtgcaccaaagccagccccagtcagggccggcacaagggttgtgcagagccagcctgtggctctgacgtctatgagtgtgcagacagcgcagacgcagcccgcaatatacaggagcagagttgccctgaacacgctgtcccacaatgccaaccacaaatggggccagctaagggtgtggtgggagaagccatcctgcagctctgagatccacaaagtggagatagcagtagcaccaactccactgctttggaggctgcccagtcgaatttgggagccagcgagggacctgacagcagcacattggacaccagaagacacccaaaggctggaatgctacgtcgcgatgtcagctcgctgcaacccttgcttcctgagttcatgtgatcctcctgcttcagcctcctgagtagctgggattagaggtggagaggagtggaagaccttctggtgtgggctgggcagcaattcacttgaaggagaaacagcccgggtgtggagaggtggccatccttggcgggatcctttctaaggagccgagaaatcaacgtagagcttcctctatctgattctctaacaactgcagaccttccatgagtcaagctttgtgtcaaaaggacaaattaaaaggacctataaatggcaccacccagcccaatggacagatgccccaggctgcagattctgtcagtgctgttctcgaagaggcccaggcacatgctgaaacatggaaggtaaaaccagcaagcagctggcatacattccacccagccgtcccccaggagaattgcttgagctccggagttccagaccagcctgggcaacagaacaagggctcatctctactagaaatcaaaaaattagccaggataagaagccagccctcgggaaccaccaggagccaggagcacccccggccccccaaggccccaagtccagcctgccccaccccctccggtgcagaggtcctgtgacaccagtggcagccccgccacaccccccaaggccaagggcacaggcagcgtggtcttccccgccccgcccgactacttcctgccgccacagccaccaatgccgcccctggagtacccagagctcccgctgccgtccccggacttcatggagacccccctggacttcgtgctccctcccctcgctgtcgccaagaggcctcctatgccccacccccccaacaggcacgaagcatcaatgttcacaagcagcaaatgaataaaagttaaacgttcttcctactgcaaa

SEQ ID NO: 459734 - DNA, 616 bp, Homo sapiens
gtttgctcatctatagaagatgtgattgttgtaaggcttccataaggtaagtgtgtaaaaaccatggcaaaatgcttgtaatttaaaagagagggttattatgaggcttctataaggtaagtgtgtaaaagtctggacaaaatgtctactattttgtaagtgttcaatatgtggataaagtggattatctttctctcctttttagaccacaaatttttagaccaagtttataaaattagggatactcctatttcttagacaatcaaacaaatgatcagaaagactagataaatcaccatagtcacaaagcagttcacaatgcatttactgggtaatttctagttaacagtagcaatgatgatcacattgaaaatcttgtattttgtggtggttttctgttacgtaagcctcttgctttgttgaaaccatagattctaagctgctttgtcaaagtgatcattagaaaaatgtgatgtagtgtgtaaatgttagaaaatttctcctgttagtcttgttaatttgattgaacatgtgtgtcattttcaaaaatgtaaatcaaatatatgtgaatgggatatatatgtatacatatgaaatataacttgaattagagagt

SEQ ID NO: 459735 - DNA, 758 bp, Homo sapiens
tgtgaatattaaacaggacagtggtgctgagcacggctaaagcatctctgcattcacagggagaggagtggaagaccttctggtgtgggctgggcagcaattcacttgaaggagaaacagcccgggtgtggagaggtggccatccttggcgggatcctttctaaggagccgagaaatcaacgtagagcttcctctatctgattctctaacaactgcagaccttccatgagtcaagctttgtgtcaaaaggacaaattaaaaggacctataaatggcaccacccagcccaatggacagatgccccaggctgcagattctgtcagtgctgttctcgaagaggcccaggcacatgctgaaacatggaaggataagaagccagccctcgggaaccaccaggagccaggagcacccccggccccccaaggccccaagtccagcctgccccaccccctccggtgcagaggtcctgtgacaccagtggcagccccgccacaccccccaaggccaagggcacaggcagcgtggtcttccccgccccgcccgactacttcctgccgccacagccaccaatgccgcccctggagtacccagagctcccgctgccgtccccggacttcatggagacccccctggacttcgtgctccctcccctcgctgtcgccaagaggcctcctatgccccacccccccaacaggcacgaagcatcaatgttcacaagcagcaaatgaataaaagttaaacgttcttcctactgcaaa

SEQ ID NO: 459736 - DNA, 505 bp, Homo sapiens
agaagagcaagagtgccccatggggaccacattgaactgtcgcatgtgcaccaaagccagccccagtcagggccggcacaagggttgtgcagagccagcctgtggctctgacgtctatgagtgtgcagacagcgcagacgcagcccgcaatatacaggagcagagttgccctgaacacgctgtcccacaatgccaaccacaaatggggccagctaagggtgtggtgggagaagccatcctgcagctctgagatccacaaagtggagatagcagtagcaccaactccactgctttggaggctgcccagtcgaatttgggagccagcgagggacctgacagcagcacattggacaccagaagacacccaaagacccccctggacttcgtgctccctcccctcgctgtcgccaagaggcctcctatgccccacccccccaacaggcacgaagcatcaatgttcacaagcagcaaatgaataaaagttaaacgttcttcctactgcaaa

SEQ ID NO: 459737 - DNA, 1624 bp, Homo sapiens
gttctgcagagccagcctgaggttctgatgtctacgagtatgcagacagcgaaggtgcaggccgcgatatataggagcagaggcaccctgaacacgctgtcccccaatgccagctacaagtggatccagctaagagtgcggagggagaagccgtcctgcagctctgagatccacgaagtagaggtggtagtagcaccggaccccactgctttggagcctgcccaatcgaatttgggagccagcgaggttcctgactgcagcacattggccaccagaagacacacaaagctctgcaggtgtcggggcaaggaaggaccaagcgacctgagaagagcagaggtgccccatggggaccacgctgacttgtcgcatgtgcaccaaggccagccccactcagggccctcacagggcttctgcagagccgtcctgaggctctgacatctatgagtcggcggccagcagaggcgcaggccccagcacagaggagcagaggcacccggaacaagctgtcccttaatgccaccccaagcggggccagctcaggatgcggtgtttggagcagtcctgcagctctgcgatccacgaggtggtggtgggagtagcgccagagtccactgctttggagcctgccccgtctgattcaggagtcatgacgaccagaagacgccaaaagaccacaaatttttagaccaagtttataaaattagggatactcctatttcttagacaatcaaacaaatgatcagaaagactagataaatcaccatagtcacaaagcagttcacaatgcatttactgggtaatttctagttaacagtagcaatgatgatcacattgaaaatcttgtattttgtggtggttttctgttacgtaagcctcttgctttgttgaaaccatagattctaagctgctttgtcaaagtgatcattagaaaaatgtgatgtagtgtgtaaatgttagaaaatttctcctgttagtcttgttaatttgattgaacatgtgtgtcattttcaaaaatgtaaatcaaatatatgtgaatgggatatatatgtatacatatgaaatataacttgaattagagagtaggcttagctcatggcaatgttttttctgaaagcacctgcagaaatctctcttatttctagtttgttgatgtttcagagattatggagaaatggcggttctatgaatctcagacactgcatgaggcagatttggtttcagtaattttagcatcattcattgtaaggtgatgatccctaggaacttcatcacagtgagaaacctgaaaggtcctagcagccagcatgaatgaaaggtggggcggggctgctggcagggcagggccttgtgagccatatgcctgtgctctcaagttccaggattgtggggatgcatgcaggggattctggacctgattgtttcctctgaaccaatgccgcccctggagtacccagagctcccgctgccgtccccggacttcatggagacccccctggacttcgtgctccctcccctcgctgtcgccaagaggcctcctatgccccacccccccaacaggcacgaagcatcaatgttcacaagcagcaaatgaataaaagttaaacgttcttcctactgcaaa

SEQ ID NO: 459738 - DNA, 1948 bp, Homo sapiens
  misc_feature (1778)..(1778): n is a, c, g, or t
tgtgtagattcgctggaagcagctggaggctccagttctcatctgctcaggtgtccccggcgccttggcgaactcggccactccagttcctcacgtggtgagcactcagggcagcgggtcgattttccgaggtcccatacctgggtttgaggggcgcggctcgcagcggcgggtgcaggggcgactgccagccctcaccccgcctcggggtgcgttcggaggccgacacctggaggacgcctccagtccccgcgggacgccacgcctgcgcgccagggatccgggataagaagtgcgcgccgggctccggctgcgcgccgcggggccaccagtttgcgcgcagggctcaggcgaccgtgcggccatggacacgccacggggcatcggcaccttcgtggtgtgggactacgtggtgttcgcgggcatgctggtcatctcggccgccatcggcatctactacgccttcgctgggggcggccagcagacctccaaggacttcctgatgggcggccgcagaatgaccgcagtgcccgtggcgctgtccctcaccgctagcttcatgtcagccgtcactgtcctgggcaccccctccgaggtctaccgttttggggccatttttagcatctttgccttcacctacttctttgtggtggtcatcagcgcggaggtcttcctcccggtgttctacaaactgggaattaccagcacctacgagtatttagaacttcgatttaacaaatgtgttcgtctctgtggaacagtcctcttcattgttcaaacaattctgtatactggaattgttatttatgcccctgccctggctttgaatcaagtcacaggatttgatctgtggggcgcggtagtggcaacgggggtggtctgcacattctactgcacactgggtggtcttaaagcagttatctggacagatgtttttcaaattgggatcatggtggctggatttgcatccgtgattatacaggctgtggtgatgcaaggtggaatcagcactattttaaatgatgcctatgatggtggaagattaaatttctggaagtaccatgactgtgatccttggacagccaagaaagtgtctgcaccagaccagctcatgccttatttggtactggacattctgcaagattatccaggacttcctggactttttgtggcctgtgcttacagtgggacattaagcacagtgtcctccagtattaatgccttagcagcagtaactgtggaagatctaatcaaaccttacttcagatcgctctcagaaaggtctctgtcttggatttcccaaggaatgagtgtggtgtatggagccctgtgtattggaatggctgcgctggcgtcacttatgggagctttgttgcaggcagcactcagcgtatttggtatggttggtggaccacttatgggcctgttcgctttgggcattttggttccctttgccaactcaattggagcacttgttggtctgatggctggatttgccatttctctatgggttggaattggagctcaaatatatcctccacttcctgagagaacattgccattgcaccttgatatccaaggctgtaacagcacctacaatgagacaaatttgattacaaccacagaaatgccatttactactagtgtttttcaaatatacaatgttcaaaggactccactgatggataactggtattctttatcatatctgtacttcagcactgttggaactttggtaacattattagtggggatacttgtcagtttatcaacaggtnactatttgagtaccagatgaagcagttggcttgcgtttaagctctatctcacacacatatatatgatacatatatatatatatatatatatatatatatatatagagagagagagagagagagagagagagagagagagagagagagagagagagagagagagagactca

SEQ ID NO: 459739 - DNA, 2215 bp, Homo sapiens
tggatgcaccagcaccaagctccagattagtgctcacttaataatggctatcattaccatgactgtgggaacttcctgcctctcagggcctttttataccaagttattcttccaggaaacagaccaaatgggaaacaacagcatggaatttaaaaggcttggtgacctgcacatctggagacaccaaggagggctggcagtgaattacttggctggcaagcagtgtgaagatgaagaagattccaagagcttggatccaggtgccctaagagagacagcaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagtggacctattccaatggacaatggctcaaccggccggctttgaatgatttcatccctacagctgctcttggtctctataacccaaccccagttcccatcttgggaatgaccctaggtggctccacccaattggtagcacctggtatagcacaaagctgccctggcctggtgttagcaatcctaataggtgaaggaaatgaagcaacacctgaggatcctaaggatcccacgtgctgggaaaggttgggtaaccatcccccttctgtgctgcagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacatgatctaaatgcagatgctgctagtaataaatatctaaaactactgtgctttccttggagtgaattcctgcttactctttgttaaaatagccccctgatgagccaggcactctgcgggaacacagattatctgagtctgaacacgccagacttctccacaggtttattttggagtggaaagtatgcagaacacaaattagaaaattcaatcttttgagagattaaaatagggaaggctaccactgaatttctggaattgcttttcaggtccaaacgttatcttaaccttaggcaagctctctggccagccacacccatccctggtaaatgttgtaggacggagatcccccccagtgccctgttgccccttcctgtcatgtttctcaccctccatgccccagtaaactgttgaaaccagagaatgggtcagggaagccccatcccactcccctgaaaatatctgggagactcttggtgtagggacagctataaccaccacttttacctacagagatggtcaaagattagagagttgagagttgggtgagattctacagtagaataatagcacatcatggacagttatagacaaaaagaactagcatcttttatgtgttcgaaccatataattatgaaagcaagatccggcaaaccacatacacatacacatatgactggtgcttttttctaaaagattccagtgggtgtggtagaaaagccttcagctctggggcaaaatgaggcctgaattaaattcaggctttaccccacttcataggcaggcaaatcgtttaacctctgagtttccatttcctgaactataaagggagataataataatcacaggattgttgaggggtatgg

SEQ ID NO: 459740 - DNA, 1639 bp, Homo sapiens
  misc_feature (1364)..(1364): n is a, c, g, or t
  misc_feature (1366)..(1366): n is a, c, g, or t
  misc_feature (1370)..(1370): n is a, c, g, or t
  misc_feature (1372)..(1372): n is a, c, g, or t
tggcctttgacttttacccttggccccttatgaggtaaacacaggctccgagggaccctctaagaacataaggcagagtccatcccccatctgcttgcaactcttccgtgagcccttctcactcagggtcaaagccaaggtgccccccatctctctgacctcatctcccactcactcacgtgccgtgcactgctccagctggccggcttctcctcacggtgctgtgtggtgggcacacgcttgcctcaggccaccaccctggacttggcccagagggccttcccttcccatgcacttgactcactccctcaaagcctgccagtttttcaccaaacgccagtgcattcatctgctatggctgccaagacaaagcacccaggaccaggcggcttggacaacagacactgattgtcccacagtcctcgaggctggagccggagatcaagacccggcctcagatgaaagcccacagctctgcctgctgcccgtgagagcccctgcaggtcccctcctcgctaggtatccatcagccccggcgccagcccgacgtggagccacagcagggcgggtacagagcctgatgggccagcccaacccgaggggaggccaagggcactgcaggccgccaaggctggggagcaggggccccccgggaggacggccagagccaggctggccccaactatgcaggcgaaagcacatggagggcgggtgtcaccgatgccgtcctgcatcggctgcatcgtgtcccccagattcatgcgtcaaagtcctgacccccaggacgtccatgtggttgcatttggagatggacagccccgtgaggaggcggggagaggtggtgtctgcaggcctacgacagaggccccgggagagccctgtggtgctgtggtctccactttcccaactgtccgagcagcaccttcccgccgctgcccagccctgggtgtgctgctgtctagtgatggcaagaacgcccagtgccaccctcagaggcttacaagcctccagggcaggctgcatccagctgtcaagcaaggccagggcgcagggccggggatgtgggggccgggcagtgggacccatgcctgggactcctgtgcctcgggggagccaggaggccccaaggccccaggccgagctcccgactgcctgcacggccctgctgccccatgggctgccctgggaccctgggtgtgggtctggggacagattcaagtccatctctgctgtgagtgtctgtgctgcccaaacgaacgggaggatggactgagggcacagaggggaccctgcggggtgtctgtgggcctgaaggtgctgcagcacccgtcgtccagcgtggagggcagcgggcggggggaggntnggcngngccgcagccatggagggtacagcgcccagaccctggtacgcagctggggcctgagccgcaaaacctcgtgctacagcggctctgagacgcctcctgcctccttctggtcctccatgaaatgaccagagcagcagggacctggcacctcctctgccattcgcaaagttaataatgatgatttgtatctgaaccaaactctgagtttcctaaaaccattcacaaagttaattatgatgatttgtgtctgaaccaagctctgagtttcct

SEQ ID NO: 459741 - DNA, 753 bp, Homo sapiens
aaggaagggagggatggaggaaggaagggagggaggaaggaaagggaagggaagaagggagaagggggagagagaaaaaaatgaaagaaaaggaaaagaaaagaaaagagaaaaggaaagaaaagtaaagagaaagaaaagaaaggagagcccacagaggtgcacagtcacgttgcctgtggaggggtcaagattgcctgtggcggtgacaggctcctcatgggacagtcctcaagtttatggagagcgtgcacagtcttgtgatggccccattttggatgaagcagggtccctgatggtgatggaaagccctgggcaggtggctcttggattctggggaatgagtgtgtcagaagaactgaattctgtcaatgaccacgtaagcttcgaagcagacctttcgcttgttgagccttcagatagacagcagccctagctgacatcttaactgcagtcttgtgacaggtcctcagacaggataagccaaattatacccagactgctgatccacagaaaatgagagagccagacaattatgcatttctttagtcaacaactagctgctaattatttactatgtgtcaagtcttataatgctgaagtgaagaaaagagatttaaagtcatggatgtggtttcctttggaccttaaattctagcacaaaatatgataaacattgtaatcaatgctatcatgtacaggtatgtggtgttatgtgaatatatgggaatacctaattcgtaaactgggttt

SEQ ID NO: 459742 - DNA, 3708 bp, Homo sapiens
agatttggggctagggttgtgggagtggggtgtgaattgaagctaagacattgttagtgggatggcatggaaagagaagatggcaaaaacagaacttttgggtcattaatgggaccagggtgtggggagggaaaagtcaagtttgtgtctgagaattatacaactaactatactaagccatcttctggctatgattgccacgtgtctgaaaatactaacaaggtttctaacaagacgagtcattttcgtgcctttgaactgagtcagtattacttttacgaactttcaggcaacaccgttattgaacgacccagacagatctgtccttatgtaattgtagcttttcgatacagggaatctaaaactatggcaccaccagctcataaaagcatacttgaacgcagtgaaaatgagggagaagagagggattgcagaatattccttcagttgaatttttcctttttatttaaggcaatcatcaaatgcttagaagatcgagggtttttcattttacttacatcatcagccttactatcagaaccagattttggaggcaagcagatgggtctgcatgggttacatttatttcgttcacccctgtcaacaggggtgaaagatttgaaagttgaagatgacatctcaatgaaggtgatacctattttatctacccttaattgtgccctgctagaaacaaagaaatcacttcctgaagaaagaatccatccaaacacattagtaaagcgtcatttccaagaattgtacaaggcggacagaagcccttcattgagtgttgctcctcaggatagaatgaaagaccctacattcttggggaaactgcccagtggttttgacttgattcctccagctgaaaagtgcccttcagagtctttaactcagttgaactcttatttttcagaccctagtgcttacattttggaagtgtctactgctttggacttgctagcagagcatcctcagtctccttgtgtttcagacggaatttgtgatgctggattttccttagttatgactccagatcctgaatttcttgtctcagaggcagaagtgagaaaagaaactgaaacaaaaaaggattctgaagaaatgttgaaagcaaagaagagagtttttccattgagtccagcgtcaaatctgagagtgcagcctaagaggaaggccagcatgccccacatggtgcagagtaaaaaggtgaacttgtgccgcccctttcccaaaagaactgcttccagagcagacaacagctcggactctccaacaactcttaagttagttaaaggacagtttcctcagaaaagaaaaagaggtgcggaagtgctgactgcacagtttgtacagaaaaccaaattggataggaaaaaccaagaagctcctatttctaaagatgttccagtgccaacaaatgctaaaagggcaaggaaacaagagaaatctccagtcaaaactgttccaagggctaagccacctgtgaagaaatctccacaaaaacagagagtaaatatagtaaaaggcaatgagaaccccagaaacagaaagcagctacaacctgtcaaaggagaaactgcttcaaagcttcaatcagaaatttcaagaggttgtcaagaagatgggattagcataaatagtgttcaaccagaaaataccacagcggctcacaatgatcttcctgaaaactccatcgtcaactatgactcccaggccctaaatatgttagccgatctagcattaagctctgctacttcttccacaccagtatctgaggctagaaatcttcactgttcctctgaattgccacaaaatgatgttttgctctctaaagaaaattctttgcgaggtacatctgaccatgaatatcatagaggagttaaaactcaaaaaggtgaattactacctaacccatcttctgataggaagagtaattctggatcagacttaacagttagccaagatgaagaaagcttggttccttgtagtcaggcccctgctaaagcccagtcagcacttactgaggaaatgctagaatcttcagatgcaagccaaagctcttctgtttctgtggaacattcatatgccctgctccttacagaacattcaaagaaacatctacaggagagagagatactaagccctctgtttcccaggaatgggacaaaaagccctgaagcagcaaccccagtggggaaagtcatgccatttcggcatcagcccggccttttgcttcagcaaaagcctcctgacgaccccgtggtgaagcccaaggatcgaccaccgtctgcccgtgtgaaaaaatcttcttgctctcgtatagtgcttagctgtgatgactccgttaagatcactttcaaatgtgaaacagaatatgcattcagtttagacagcaaatataccaacaacccactggagaaaactgtagtaagagcattacatgggccctggaatactgatttgcctgataatgtggaagaagtgaagcttttacttcatatgtgggtagctctgttttacagcaatcagaacaaaatcatacgatcttcccgaaaggttgtagaacacagcaacccagcaaaatatgtgtctataaatagcacgttagaatcttgtgagctccgtgaaattgaggagtcccttggtttggaaaaatgttctgcagactctctgttggagactaacgaaatttccagggctcatgctgctgaagtatccttccgtgatcctaactgcttgcttcctttcattaaaacaccacttacccaaggcttggaactctgtgtacaaaatgaacagaaaaaaacttttgcaagagagtgtgatccagacacccaagaagaccagaatttcatctgttcttacaataatgaggtatgtaaagctgaataccgttaaatgttggcattatttttgaagaaaaaaatgtttatatgtaaaatcacattcaaaacaaggcatttttaaattttaggacagtgaattctcaaggtatgtaaagaactattacaccaaaaacctagttttcatgaagtgtccttgaattgtctgcaggtagagcttacctgccatcccgattgaaaaaaaccagagtagaaaaatgtcacagggtccacatgatctgggagcccagcataatttggggcaaattgcttctttgcctaatttttaaaagaggtgacttaatacctatcaagtcttatgtagaatattgtttaaggatcaaatatagcaataataaatcttagatatactttgataaaccttaaagtaaactaaaattaattgtattaaaattatttttgaagacagatgctggaatagtaaaatgccagacctgtgaaagaagacccattgcaaataactatttgtaaatatggaaaatatactttgttttgttccttgttctcaactgacattcaaccaggccagataatccaaattttacctggagcaaatctaaaagttgttaacaaaattctaagcaaatgaattgacaaaattacctaccttttaaagttttccgcccaaatttattctagaataatattgcttgggtttgggcagcatctctgattcctgtcttaagaaagagtagacagtgttcctatacccggggtcaccggggacttggaggtccttgggtgagcctcatagaacccgtgaatatcttcaagtgattgtcatcatcatgagaattaaaga

SEQ ID NO: 459743 - DNA, 2972 bp, Homo sapiens
agatttggggctagggttgtgggagtggggtgtgaattgaagctaagacattgttagtgggatggcatggaaagagaagatggcaaaaacagaacttttgggtcattaatgggaccagggtgtggggagggaaaagtcaagtttgtgtctgagaattatacaactaactatactaagccatcttctggctatgattgccacgtgtctgaaaatactaacaaggtttctaacaagacgagtcattttcgtgcctttgaactgagtcagtattacttttacgaactttcaggcaacaccgttattgaacgacccagacagatctgtccttatgtaattgtagcttttcgatacagggaatctaaaactatggcaccaccagctcataaaagcatacttgaacgcagtgaaaatgagggagaagagagggattgcagaatattccttcagttgaatttttcctttttatttaaggcaatcatcaaatgcttagaagatcgagggtttttcattttacttacatcatcagccttactatcagaaccagattttggaggcaagcagatgggtctgcatgggttacatttatttcgttcacccctgtcaacaggggtgaaagatttgaaagttgaagatgacatctcaatgaaggtgatacctattttatctacccttaattgtgccctgctagaaacaaagaaatcacttcctgaagaaagaatccatccaaacacattagtaaagcgtcatttccaagaattgtacaaggcggacagaagcccttcattgagtgttgctcctcaggatagaatgaaagaccctacattcttggggaaactgcccagtggttttgacttgattcctccagctgaaaagtgcccttcagagtctttaactcagttgaactcttatttttcagaccctagtgcttacattttggaagtgtctactgctttggacttgctagcagagcatcctcagtctccttgtgtttcagacggaatttgtgatgctggattttccttagttatgactccagatcctgaatttcttgtctcagaggcagaagtgagaaaagaaactgaaacaaaaaaggattctgaagaaatgttgaaagcaaagaagagagtttttccattgagtccagcgtcaaatctgagagtgcagcctaagaggaaggccagcatgccccacatggtgcagagtaaaaaggtgaacttgtgccgcccctttcccaaaagaactgcttccagagcagacaacagctcggactctccaacaactcttaagttagttaaaggacagtttcctcagaaaagaaaaagaggtgcggaagtgctgactgcacagtttgtacagaaaaccaaattggataggaaaaaccaagaagctcctatttctaaagatgttccagtgccaacaaatgctaaaagggcaaggaaacaagagaaatctccagtcaaaactgttccaagggctaagccacctgtgaagaaatctccacaaaaacagagagtaaatatagtaaaaggcaatgagaaccccagaaacagaaagcagctacaacctgtcaaaggagaaactgcttcaaagcttcaatcagaaatttcaagaggttgtcaagaagatgggattagcataaatagtgttcaaccagaaaataccacagcggctcacaatgatcttcctgaaaactccatcgtcaactatgactcccaggccctaaatatgttagccgatctagcattaagctctgctacttcttccacaccagtatctgaggctagaaatcttcactgttcctctgaattgccacaaaatgatgttttgctctctaaagaaaattctttgcgaggtacatctgaccatgaatatcatagaggagttaaaactcaaaaaggtgaattactacctaacccatcttctgataggaagagtaattctggatcagacttaacagttagccaagatgaagaaagcttggttccttgtagtcaggcccctgctaaagcccagtcagcacttactgaggaaatgctagaatcttcagatgcaagccaaagctcttctgtttctgtggaacattcatatgccctgctccttacagaacattcaaagaaacatctacaggagagagagatactaagccctctgtttcccaggaatgggacaaaaagccctgaagcagcaaccccagtggggaaagtcatgccatttcggcatcagcccggccttttgcttcagcaaaagcctcctgacgaccccgtggtgaagcccaaggatcgaccaccgtctgcccgtgtgaaaaaatcttcttgctctcgtatagtgcttagctgtgatgactccgttaagatcactttcaaatgtgaaacagaatatgcattcagtttagacagcaaatataccaacaacccactggagaaaactgtagtaagagcattacatgggccctggaatactgatttgcctgataatgtggaagaagtgaagcttttacttcatatgtgggtagctctgttttacagcaatcagaacaaaatcatacgatcttcccgaaaggttgtagaacacagcaacccagcaaaatatgtgtctataaatagcacgttagaatcttgtgagctccgtgaaattgaggagtcccttggtttggaaaaatgttctgcagactctctgttggagactaacgaaatttccagggctcatgctgctgaagtatccttccgtgatcctaactgcttgcttcctttcattaaaacaccacttacccaaggcttggaactctgtgtacaaaatgaacagaaaaaaacttttgcaagagagtgtgatccagacacccaagaagaccagaatttcatctgttcttacaataatgagaaccttctgaggaaaggaggccatacagaaattgaacctcagcacttctgtcaagctttccacagagagaatgatacactaatcatcatcatcag

SEQ ID NO: 459744 - DNA, 989 bp, Homo sapiens
tatgagcggacatgggtatggtttctagaacaatcagaagacaaatctggtttcagggagaggtaggaggcttctcagcagagattattcggttgaaatctctcagggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacgaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgtatcccggattttcttattaaattgtattttaaactag

SEQ ID NO: 459745 - DNA, 1068 bp, Homo sapiens
tatgagcggacatgggtatggtttctagaacaatcagaagacaaatctggtttcagggagaggtaggaggcttctcagcagagattattcggttgaaatctctcagggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctatggggatacagctgcaggtaaaaaagacaaacatctctgccctcctgctgtggtttttattttggcacattcaaggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacgaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgtatcccggattttcttattaaattgtattttaaactag

SEQ ID NO: 459746 - DNA, 881 bp, Homo sapiens
cagatgatttatggggtgggtggccgcagggaggttactctttgtattacaggctgttttttttaatcaatggccagcaacccactggctggggccagaagcaacaggctctttgtttaatcctgttaacctaggcttcggctgcagccagccccaggccagcagagggatgctggccaatgagaagctgatgctgaaaggtggttacttgtctcatgcctatattaagaataccaaaatatcccacaagacaacaattgagggatcagcgggggctgtcatctcatctgaagtctcaactagggaaggagctgcttccaagctcattcaagtgatcgatggcagaatttggttcctcatgggctgttggactgaagactttagtttatcacagtatgctggctgcagtccccactcagttccttgccataagggcctctccatagagcagcttggcaacagagcagctggcttcatcagagtgaaggaataaactgagccttggtcctagaagatagtgacttgtccgggagcaacctaaagagcagagatatcaatagaacgttcacggtgtgccaggcaatgtgctggatgttcgaggtgtttcattctagtcggctgtgtcccccacttcagtaattgtcaactccatcttcccagttgttaaactaagaagttgagagttatccatgactctgctctttctgcaatatgttacggcctatgcaccagaaaattctttcagcactgccttcaaaatatatcaagaatatgaaaaataacccaaatgtccatcaaaaggtaaatggataaacaaatgtattacctccatacaatggaacactactcgggaataaaaaggaacaaatgattggtacatg

SEQ ID NO: 459747 - DNA, 7387 bp, Homo sapiens
cggggtgccagaaggaaagcatagagttacctaaagcatctgtgatggtccaggaggcttctgtggtgatcgggcagcatcagtctttagccacgaagctgagaagatctgggaaggagtcagtcagagagccttgggccggagttccaggggctctgggagtggctgctgggcgagttggatttccagtggggtcccgcacagatgggacaaggcttaggaggaatcccgggcttcaggcattccttcgcccagtggccagatttccggcacctgaagcaagttcctgggggaggagggtggcagctgctgtgcaggcagcgcctgttccccggcatcaagcacagggaccatgttgcggggaagcgctgcactgagcgcacaccaatgcattcttgttggaaaatgaagcttcagacacggcaaccatccgatttcccaatcttttccccacctttcccccctttctattccacaaaaccgccattgtcgtcccggcccgttctcaatgagctgttgggtacacctcccagacggggtggtggccgggcagaggggctcctcacatcccagtagggacggccgggcagaggcgcccctcacctcccggacggggcggctggccgggcggggggctgacccccccacctccctcccggactgggcggctggccgggcagaggggctcctcacttcccagtaggagcggccgggcagaggcgcccctcacctcccggactgggcggctggccgggcagaggggctcctcacttcccagtaggggcggccgggcagaggtgcccctcacctcccggacggggtggctggccgggcggggggctgaccccccgacctccctcctggacggggcggctggcctggcgggggctgacccccacctccctcccggacggggtggctgccgggcggagacgctcctcacttcccagacggggtggctgccgggcgtaggggctcctcacttctcagacggggcggctgccgggcggaggggctcgtcacttctcagacggggcggttgccaggcggagggtctcctcacttctcagatggggcggccaggcagagacgctcctcacctcccagacgggatgggatgacggccgggaagaggcgctcctcacttcctagatgggatggcggccgggcagagacgctcctcacttcctagacgggatggcggccaggaagaggcgctcctcactttccagactgggcagccaggcagaggggctcctcacaaaggaggaggggccatcatgctgggttggaatgtgggagtgttcctgggaggaggaggaggggtgggaaaggccaccagtctgtggggctgtggagcctggggaatccgaggctggcgtgggagtctggggccctctagcggtggtggtgcatcctcagctcagtgccactcactcatcagctccggctccggtgtcctccttctctcgcacttctatcacgccatccagccaggacatctgcaggacacattacaggcgtcaaagagaaattcctttggttcagaatgggcccaggccttgaagcctgctaagaataccaaagccagaagaacactaaagttctcaaggtccctcaatgatgtgggtgagaaggcgcaggatacttcagaaagttttgcctatgtggaaagaacttgttctgaagggaaattaatactccctcaagatacgtgtctcagaactaacaggtttcatcataaagaaaaaagaaccctgaaccacaaacctcttggcaattccaaacattcttgtgtttcatgcctttctgccggtcgctcaactgcctcagaggtggaagctggcaaggggggcaggcccggcctgctgctggaagagaaggcggatggtgaggccacgtcccgaagccggcaactgctccagtacctgttctcactctcgcacggcttgagcgccagcagcctgcacaggttccatgagctggagagctgcgctgctcgcctgcacactgccaagtcctccagcgggctggcagggagtatgggcttctgctctgacgagatgggagacgacgatgtctttgaggacagcacatctgcaaaactgaagagtagggttctgcgggcgcccctctgctccacggaaaaggacagcgacctggattgtccttctcccttctctgaaaaattaccccccatatctcccgtgtccacgtcaggggatgtctgcagtctccgctccttagtgccagctgtcatcatttctaacatttggatcagagatcccctcactaaaacagcctgagagcctggctccttccaggacgagtgccccaacctgttctctagctgctggaaaagacccctctgtttcttaaaagcctgttaagttccttcaggctagtagctacaccttgttgcatacttccttggaaatagagagtgctttcaaattaatttctcacttattgctattagtggtcccaagaaaaagagatgaaattgcagcatcttgtaatggtgagttttttaggtctaggagagaggtactgtcatctttgtttacttgctgagagacgacagaaatgtgtagttgtggggtatgaaggtaaagtcagtgattatagctaaaaagcaaacgtcatttaaggtcactggtatttttggatgttggaatgcaggttttgttttacatagaaattttccctctaattattttaccatcttatgttctggaaaatgattccatgttgctttaaattcatctttcagtgaagttcttatttcttaccaaaaaatgacagctttgtcatttcttacatcgttttttcctttctgttgccaaatgccctccagactttccatgttggtgcggtaagctagacatttttagtttgtagtgattgttttcgtttgtgtttgtatgtttttgtgcccatagtcacttctgtaatgttcgtttctgagtttcctttggggggattaacctgccactgaagtgtcagcttccctgtcatgggactgtccttggaatgacaggttttccttccaccataggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaaggagttttgccatgagagtgttttgctgcagggaggctggggac

SEQ ID NO: 459748 - DNA, 988 bp, Homo sapiens
  misc_feature (1)..(2): n is a, c, g, or t
  misc_feature (4)..(4): n is a, c, g, or t
  misc_feature (6)..(8): n is a, c, g, or t
nncntnnnagagtgaactgcatctctaactggatgaacgtcacactgttaatggtgaaattttccaagtatattaaatatttggttgctaaggaacgtactgcttggggaaatcaatactggagatatgacagtgacaaggatcaggccctcacagaagatgaacaaggaaaaagctatcccaaattgatttcagaaggatttcctggcatcccaagtcccctagacacggcgttttatgaccgaagacagaagttaatttacttcttcaaggagtcccttgtatttgcatttgatgtcaacagaaatcgagtacttaattcttatccaaagaggattactgaagtttttccagcagtaataccacaaaatcatcctttcagaaatatagattccgcttattactcctatgcatacaactccattttctttttcaaaggcaatgcatactggaaggtagttaatgacaaggacaaacaacagaattcctggcttcctgctaatggcttatttccaaaaaagtttatttcagagaagtggtttgatgtttgtgacgtccatatctccacactgaacatgtaataagaaaaagtaggaaatggagggtcataggacttcgctaaaattctgatactgtttacaaagaaaaccggattttcagtagctgaagaaaatatggcactgtaagttaaaacccaatgggaaaagccttagttgaacttttaaaatacttgatttaaaaacaattgctcaggcaaaacataattcataaactaaaaggtttaaaaaaacaaaaaaacaaaaactaagcatccaatgatctttgcctgctttctactctgtggggctctgcccatcccaactgcttggccacctgatgggagttggaagggcggccagagccctgggtcaagctgtcaaggaaggagatgccacagagatgattttactgagggatttaatgggaaagtcacaggattcaaataaat

SEQ ID NO: 459749 - DNA, 3304 bp, Homo sapiens
ttctcttatgagggaagtatttttattatccctatttaacataaaaggcaaagctcatacaggaaaggagctgtcccaggaaatcaaggcttttctgactggcgtagaccccattctgggccaccaactctcagcccgggaacatgctcgctgtggtcttctcctgctccgttctttgccacctgctcgggctgctgtgcttgaccacttgagaggtgtctttgatgagagtgtccgggcccacctggctgccctggatgaaacccctgtggctggtccacctcacctccgtccacctccaccctctcatgtccctgctggtggacctggtctagaggatgtggttcaggaagtgcagcaggtgctgtctgagtttatccgggccaacccaaaggcctgggcacctgtgattagtgcatggtccattgacctcatggggcaactgagcagcacgtactcaggccagcaccagcgtgttccccacgctactggcgctcttaatgaactgctacagctgtggatgggttgtagggccacgcgtacattaatggacatctatgtgcagtgcctctcggctctcattggtagctgcccagatgcgtgtgtggatgccttgctggatacctctgttcagcattctccacactttgactgggttgtggcacatattggctcctcttttcctggcaccatcatttcccgggttctctcctgtggccttaaggacttttgtgtccatggtggggctggaggtggagctggcagtagtggtggaagctcttctcagaccccctctacagaccccttccctggatctcctgccattcctgcggagaaacgggtgcccaagattgcctcagttgtaggcatcctaggtcacctggcctcccgccacggagatagcatccgacgggagctcctgcgaatgttccatgatagcctggcagggggatctggaggccgcagtggggacccctcccttcaggccacggttccgttcctactgcagctggcagtcatgtcaccagctttgctgggcactgtctctggagagcttgtggattgcctcaagcccccagctgtgctgagccagctgcagcaacaccttcaaggattcccccgagaggagctggacaacatgttgaacctggctgtgcacctggtgagccaggcctctggggcaggtgcctaccgcttgctgcagttcctggtggacacagctatgcctgcttcggtcattaccacccagggcctggctgtgccagacaccgtgcgtgaggcttgtgaccggctaatccagctgctgctgctgcacctgcaaaaactggttcatcaccggggagggtctcctggggaaggggtgctaggcccgcccccacctccccgcttggtgccctttttagatgcgctcaaaaaccatgttggagagctgtgtggagagacgttacgattggaacggaagcgcttcctctggcagcaccagctcttgggcctgctgtctgtctatacccggcctagctgtggacctgaggccttgggccatctgctgagccgagcccgaagccctgaagagttgagtttggccacccagttatatgcagggctagtggtcagcctctctggcctcctgcccctggctttccgaagctgtctggctcgggtgcatgcagggacattacagcctcccttcacggcccggttcctgcgcaacttggcactgctagtagggtgggaacagcagggtggcgagggccctgcagccctaggggcgcactttggggaatctgcctcagcccatctgtctgacctggctcctctcctgctacatcctgaggaggaagtagctgaagctgctgcctctctcctggccatttgtccctttccttctgaagccttatccccctcccagctcctgggactggtaagggctggggtgcaccgcttctttgcctctctgaggctgcatggacccccaggtgtggcctcagcctgtcagcttctcacccgcctgtctcagacatccccagctgggctcaaggctgtcctgcagctgctggttgaaggagccttacatcgaggcaacacagaactgtttggtgggcaagtagatggggacaatgagactctctcagttgtttcagcttctttggcttctgcctccctgttggacactaaccggaggcacactgcagctgtgccaggtcctggagggatttggtcagttttccatgctggagtcatcggccgtggcttaaagccacccaagtttgtccagtcacgaaatcagcaggaagtgatctataacacccagagcctcctcagcctcctggttcactgctgcagtgccccagggggcactgaatgtggggaatgctggggggcacccatcttgagtccagaggcagccaaagcagtggcagtgaccttggtggagagtgtgtgtcccgatgcagctggtgcagagctggcctggccccccgaggaacacgcccgggccaccgtggagcgggatctccgcattggccggcgcttccgcgaacagcccctgctctttgagctgttaaagctggtagcagctgcacccccagccctgtgctactgttccgtgctgcttcgggggctgctggccgccctcttgggccattgggaagcctctcgccaccctgacacgacccactccccctggcacctggaggcatcctgcaccttagtggctgtcatggctgagggaagcctcctgcctccggccctgggtaatatgcatgaagtatttagccaactggcacctttcgaggtgcgtctgctgctgctcagtgtctggggttttctccgggagcatgggcccttgcctcagaagttcatcttccaatcagagcggggtcgcttcattcgggacttctccagggagggtggaggtgagggtggaccccatctggctgtgctgcacagtgtcctccaccgcaacatcgaccgcctaggtcttttctctggccgtttccaggcaccttcaccgtccactctccttcgacaggggacgtagccttttcttgctctggaagcccagggaggttgagcagtgagagagggaagggactaacgtgctccggaagggtggaggtttctcttctaagtccttggtctaaagagcgctgtcacttttttctctcccacttttttttttctaaataaaatttgccaacttgagaaaaccagtccagtgcttctgtcatgctgagagcgtgcaaagtctgacagcgcctggctctggacgttcccgcccctggcctgaagccccgccccctgc

SEQ ID NO: 459750 - DNA, 1686 bp, Homo sapiens
agcggacagtcctgccaggacggcgacagtgaagcacctgggttgagagggagcagcaggtaactgcgcaacccctgcctcccccggccccagcccgtgcctcagcagagccgggtgtggtggggacccgggagtgggtctcactgcgtgtcgcctgccaacaccttcctccaccaccatccttacccagccccagtcccacccagcacacctgggcgagacaacccaggtgcgaaggacaagcgattactaccgaagagcgtgcaaaccaggaagagagcagcctcctggagaggaaaacgtgatcccaggggtagacacgtggcgctgcgtggagagacaggttgacgagacgaggctcttctgaccgtcctacctggcaaaacttgacgacagcttcaggtcgctaccatctggacctctcggagctccctgaaccatgactcagaccctcgacacaagggaagaccctctgaacctgggcggcggtggcggcggcggctgtggctgtggctgggcacactcggcctccttgagctcctggtcgtcctgccatcgaaggcgcccgggtgctccagcgtacaatagaccgcaccgatatagccccaagaccgagtatgggcccccaaggaagcagccgaagcaacagcacggccgggcttttggttccaaccacccgtgtgctctaactgggggtgctggggagggccctggcgcccaccccctccaggattctggaaattcccctgcccggtgcaagtgttccgggtgtatggctgcaccctctctgcttttgctgctgctcctgctggagcgggtcctggaaccctggctgggtgaagcccccaggcaggaagaagcgctggggccgcagaggccgcggcctgcgccaccaccctcgccactcctacccgcggagcccgccagcggatgtgagcacgctgccgcggccgcgccgcccaacaccacccaattcatcatgaaccagatctacgaggacatgaggcagcaggagaaggtggagcgtcagcaggaggcgctgcgggcgcagaaggccacggtgagcggcgaggcctccccagccagatcctccggaaacgacgcgccccctggcggcagcaaggaaacctggggactgcaggaaactctgtatggctttgtgcagaatccctctctagcattcagtcccaacccagaggggaagaatttcacttgcctctggaaatgcctttatcaatcttcgtagaggctgaagaaaagagagagaactttataagctgcacttttttaaacccagagcagataattcccaaagtgccacaggaatccctgttcatggcacaggactttaactgttagacatcagaaaagggattgagaaaagggatggaactgatttgaggctaaactggattagcaatttattaaaaactgattaaaaagtgagttccattaataaacagatctatgtaaacaccttctttggccattataaaatgtttaaaatttgatgcgtatgtgtatgactatgggtgggtggtggggaagctttcaaatataattttactggaactgattaaaggccaagtattttattactaccatttgaatattttcatttggtgttttcccctctagaaaacagagttgctgttgtttttttaaatctggcaatgctgaaaaagc

SEQ ID NO: 459751 - DNA, 1948 bp, Homo sapiens
agcggacagtcctgccaggacggcgacagtgaagcacctgggttgagagggagcagcaggtaactgcgcaacccctgcctcccccggccccagcccgtgcctcagcagagccgggtgtggtggggacccgggagtgggtctcactgcgtgtcgcctgccaacaccttcctccaccaccatccttacccagccccagtcccacccagcacacctgggcgagacaacccaggtgcgaaggacaagcgattactaccgaagagcgtgcaaaccaggaagagagcagcctcctggagaggaaaacgtgatcccaggggtagacacgtggcgctgcgtggagagacaggttgacgagacgaggctcttctgaccgtcctacctggcaaaacttgacgacagcttcaggtcgctaccatctggacctctcggagctccctgaaccatgactcagaccctcgacacaagggaagaccctctgaacctgggcggcggtggcggcggcggctgtggctgtggctgggcacactcggcctccttgagctcctggtcgtcctgccatcgaaggcgcccgggtgctccagcgtacaatagaccgcaccgatatagccccaagaccgagtatgggcccccaaggaagcagccgaagcaacagcacggccgggcttttggttccaaccacccgtgtgctctaactgggggtgctggggagggccctggcgcccaccccctccaggattctggaaattcccctgcccggtgcaagtgttccgggtgtatggctgcaccctctctgcttttgctgctgctcctgctggagcgggtcctggaaccctggctgggtgaagcccccaggcaggaagaagcgctggggccgcagaggccgcggcctgcgccaccaccctcgccactcctacccgcggagcccgccagcggatgtgagcacgctgccgcggccgcgccgcccaacaccacccaattcatcatgaaccagatctacgaggacatgaggcagcaggagaaggtggagcgtcagcaggaggcgctgcgggcgcagaaggccacggtgagcggcgaggcctccccagccagatcctccggaaacgacgcgccccctggcggcagcaaggaaacctggggactgcaggaaactctgtatggctttgtgcagaatccctctctagcattcagtcccaacccagaggaaaaccagtctcttgccccgctgctggtggaagaagaggaggagaagaaaaatgatgatgaggaggagtatgaccaggaggtgtgtgatgcaaaggaggcgagcgaggaggaagaagaggtcgaagatgaggaggaagaggtcgaagatgaggaggaagaagaggtcgaagaggctgaatatgtggaggagggagaggaggagctggaagaggaggagctggaagaggaagaggaggtcctggaggagaacgagcagagaggggaagaatttcacttgcctctggaaatgcctttatcaatcttcgtagaggctgaagaaaagagagagaactttataagctgcacttttttaaacccagagcagataattcccaaagtgccacaggaatccctgttcatggcacaggactttaactgttagacatcagaaaagggattgagaaaagggatggaactgatttgaggctaaactggattagcaatttattaaaaactgattaaaaagtgagttccattaataaacagatctatgtaaacaccttctttggccattataaaatgtttaaaatttgatgcgtatgtgtatgactatgggtgggtggtggggaagctttcaaatataattttactggaactgattaaaggccaagtattttattactaccatttgaatattttcatttggtgttttcccctctagaaaacagagttgctgttgtttttttaaatctggcaatgctgaaaaagc

SEQ ID NO: 459752 - DNA, 998 bp, Homo sapiens
atttcaatatttaatatatggacttcgtaatttgtatcattgcagttttactaatgggaaaaatatcaaaataccttaaggactattatatacattatcacaacactcaaagaatgaaaatcacttattcctttgaaaattgggatactttttattttgagagctgcagaaaaccctatgacgcactacatagctctcacagtaaatttccaggatcaaagttcaaaaacagcggccaatgccttactgtctattccatgggcttcactaggctgtcccttcttaggcctagaacgaaatgggcttcacaaatagaaattattctaatccaaataatatttccccaagtctcacagtgcaaaacaccacagcagagagcacatggtgatcaagaaagacagcattatcataaacatttgtatttcttatgctaacagatcccattcttccagtctgtggcattgtcccaaactgccccatcaaaggttctaaaatatgcttagggcatctctattaagaggatgaggagaaaggaggagggggaagatgctaacaactaaatggttcaatatgatgcagtatttccaatggcgggagacagaaacaatgtcacaaagtgggagaggcactaagaatgagatctggcaccacttactcttgtttctatacaatcgaagtacaacacttctcaattttctaggcgtctttggggagagatcttatctctcttaatggtaccaactcagtaacccaaactgttcaccaatacttcttttaagtagttgtgaggtagggagtccaacacttcccaagagatcctgttagtacattatagcaactacagggaatgttttacaaatgactgtcattataatgttaaatctaacatatatgccaacccccttagtttatacaataactttcctccaaaaatcttaattaaaaataaaatatagctgacttcgttataaagagactcattaaccaggacattgcag

SEQ ID NO: 459753 - DNA, 1312 bp, Homo sapiens
ctttttcctggctcctgggcccaaatgccagtccctctcgaaggtgcctgctgcctcgggaacgctcactcccggctccgcggggcacctcccacctcctcccgggctcagcaccctttggatagaagaagggaaggagggcgaaagaagagcaactcaccagtgttgccaacctggtctgcagacccccgccccacctgtccctcctccagtcgtttaacccttcttggcccacgctggacacgtttatatagatattggctccccccctacggaccgatcccggttcacacaacggagtggcaggcgccggggcggctcgagctgggctgggggctcgccccgcgagcgtcctcgggcggggcctgcgggttcgcgccagagcttccccgctcttcgcaggcgctcagaaagtgggcgaacccaacgcgcagaactgacccgggcttgcgccccgcagtgctcctggcccacccccggccgctggctccctctgccgtccccgccctcgagcttctaggtgcctttctctcgccactccaaggtgaaagaactgggcttttctctcctttgctccgactatttcagggaaactgcagtcgtcgacgcctgcgttggcatcgcaaaagcccaggagggatagcgcagccgagattctccgacagctccccacctctcccggctctctgatctaccacgtcagtggtctcctccaggcagtgcaaaggcagtatctctctgaatcccgggacgtctcagccaaagcagggaagacaccccaagtacgctggaaggctgggtaaggcgcgaagggcagccccattccagtcttcaaagagagctagctgttcaccgctcctctcctccagatttcaccgtgcctgaagaactaccatgcttttcatgtaatatttttaaaaacattaaatactttggattaagagatgatcgagagaacaagtgcgcatatgtatatatatgtgtgtgtgtgtgtgtgtgtatgtatatatactgttttggtgccactcccattccagtaactaggaaataatatgccttttctccaggaagcacttgttttaaatcagtaagctctgaatagacaaaatagtaatgcattttcaacaacttgctcaatatttttaatatttcatcacaaaatccagagatgtacatataattctttacacttattttacagaatcaggcatagtttcttacaggcctaaatcctgaaaaggcaaagggaagattcagcataaatacaacaaagggagaataaagactggatttatattgccatttggaccac

SEQ ID NO: 459754 - DNA, 1935 bp, Homo sapiens
ctcgagctgtaaaagccaaaggtccggtgatgatcccatacccttttttccagtctcatgttgaagatttttatgtagaaggccttcccaaaggaatttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccatgttggccgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagctggacctaccatgaaagacttctgaatccaagaagagaaactgactgggcaacatgttattcagaaacagggccttgccctgtcactcaggatggagttcagtggtcctatcatggctcattatagcctcaaactcccaggctcaagcaatcctaccatgtcagccttcccagtagctgggactacagagacgaggtttcgccatgtttcccagactgttctcaaactcctgagctcaaagcagtccacccaccttggcccccagagttctgggattacaggtgtgagccatcttgctcattctagtttaaacttttgagtggtttgtgtctcctgattggactcctacaaatacagaattgatgctaggaagggtaccaggagatagacgcacacagatgggatttgggaataggtttggttatccaaggagcagtgctgagctccttgcaatgggatatgggatgctggtgatttccaggaagtgagctcacaatgactcaagctgccacatactgttgattgtgaaatgccagttgaagcatatgtcctgcaagcttaggggtgctacaagttgaccactgcagcagtaaagatgactctgaagaatggcgtgggatggttcctttcaaatgcacttgagcagcggtctccaaccacagggccacagagctggagctggatctaccatgaaagacttgtgaatccaggaagagagactgactgggcaacatgttattcaggtacaaaaagatttggactgtaacttaaaaatgatcaaattatgtttcccatgcatcaggtgcaatgggaagctcttctggagagtgagagaagcttccagttaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcagtgcttgccactatgcccaactaatatttggaattttcgtatacgtggattccagaggggtgacagcgaaacgtgagtaagcatggattttggtatatgcagagatggggggctggaactaattctgtatactgagggacgacgactgtatatgtttttacaattacgctgtaggatacatactgttgcatagccttgaaaataataatttttaattgagtgg

SEQ ID NO: 459755 - DNA, 620 bp, Homo sapiens
cccatttaggcccaactcatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggcgaagctcctgccttttggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggcctcccgagtccaaagctcctgcctctcggccgcttcggcaggcccaggctcccgcctgccagtggcctcttcaggcccatggggctcattcctgacaacggcctttccaggcccagtttttcccttccggcggcctctccgggcccagaacctcctcaagtcggcctctccagacccacttgcac

SEQ ID NO: 459756 - DNA, 2225 bp, Homo sapiens
ctcgagctgtaaaagccaaaggtccggtgatgatcccatacccttttttccagtctcatgttgaagatttttatgtagaaggccttcccaaaggaatttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccatgttggccgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagctggacctaccatgaaagacttctgaatccaagaagagaaactgactgggcaacatgttattcagaaacagggccttgccctgtcactcaggatggagttcagtggtcctatcatggctcattatagcctcaaactcccaggctcaagcaatcctaccatgtcagccttcccagtagctgggactacaggaagtgagctcacaatgactcaagctgccacatactgttgattgtgaaatgccagttgaagcatatgtcctgcaagcttaggggtgctacaagttgaccactgcagcagtaaagatgactctgaagaatggcgtgggatggttcctttcaaatgcacttgagcagcggtctccaaccacagggccacagagctggagctggatctaccatgaaagacttgtgaatccaggaagagagactgactgggcaacatgttattcagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcccgcctgccagtggcctcttcaggcccatggggctcattcctgacaacggcctttccaggcccagtttttcccttccggcggcctctccgggcccagaacctcctcaagtcggcctctccagacccacttgcac

SEQ ID NO: 459757 - DNA, 1658 bp, Homo sapiens
aagattcccttgagaacaagtactgtccctagtttcccagtgctggaatatagaaaatggatggacaactggacctaccatgaaagacttctgaatccaagaagagaaactgactgggcaacatgttattcagaaacagggccttgccctgtcactcaggatggagttcagtggtcctatcatggctcattatagcctcaaactcccaggctcaagcaatcctaccatgtcagccttcccagtagctgggactacagagacgaggtttcgccatgtttcccagactgttctcaaactcctgagctcaaagcagtccacccaccttggcccccagagttctgggattacagctggatctaccatgaaagacttgtgaatccaggaagagagactgactgggcaacatgttattcaggtacaaaaagatttggactgtaacttaaaaatgatcaaattatgtttcccatgcatcaggtgcaatgggaagctcttctggagagtgagagaagcttccagttaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcccgcctgccagtggcctcttcaggcccatggggctcattcctgacaacggcctttccaggcccagtttttcccttccggcggcctctccgggcccagaacctcctcaagtcggcctctccagacccacttgcac

SEQ ID NO: 459758 - DNA, 2513 bp, Homo sapiens
ctcgagctgtaaaagccaaaggtccggtgatgatcccatacccttttttccagtctcatgttgaagatttttatgtagaaggccttcccaaaggaatttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccatgttggccgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagctggacctaccatgaaagacttctgaatccaagaagagaaactgactgggcaacatgttattcagaaacagggccttgccctgtcactcaggatggagttcagtggtcctatcatggctcattatagcctcaaactcccaggctcaagcaatcctaccatgtcagccttcccagtagctgggactacagagacgaggtttcgccatgtttcccagactgttctcaaactcctgagctcaaagcagtccacccaccttggcccccagagttctgggattacaggtgtgagccatcttgctcattctagtttaaacttttgagtggtttgtgtctcctgattggactcctacaaatacagaattgatgctaggaagggtaccaggagatagacgcacacagatgggatttgggaataggtttggttatccaaggagcagtgctgagctccttgcaatgggatatgggatgctggtgatttccaggaagtgagctcacaatgactcaagctgccacatactgttgattgtgaaatgccagttgaagcatatgtcctgcaagcttaggggtgctacaagttgaccactgcagcagtaaagatgactctgaagaatggcgtgggatggttcctttcaaatgcacttgagcagcggtctccaaccacagggccacagagctggagctggatctaccatgaaagacttgtgaatccaggaagagagactgactgggcaacatgttattcaggtacaaaaagatttggactgtaacttaaaaatgatcaaattatgtttcccatgcatcaggtgcaatgggaagctcttctggagagtgagagaagcttccagttaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcccgcctgccagtggcctcttcaggcccatggggctcattcctgacaacggcctttccaggcccagtttttcccttccggcggcctctccgggcccagaacctcctcaagtcggcctctccagacccacttgcac

SEQ ID NO: 459759 - DNA, 2129 bp, Homo sapiens
ctcgagctgtaaaagccaaaggtccggtgatgatcccatacccttttttccagtctcatgttgaagatttttatgtagaaggccttcccaaaggaatttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccatgttggccgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagctggacctaccatgaaagacttctgaatccaagaagagaaactgactgggcaacatgttattcagaaacagggccttgccctgtcactcaggatggagttcagtggtcctatcatggctcattatagcctcaaactcccaggctcaagcaatcctaccatgtcagccttcccagtagctgggactacagagacgaggtttcgccatgtttcccagactgttctcaaactcctgagctcaaagcagtccacccaccttggcccccagagttctgggattacaggtgtgagccatcttgctcattctagtttaaacttttgagtggtttgtgtctcctgattggactcctacaaatacagaattgatgctaggaagggtaccaggagatagacgcacacagatgggatttgggaataggtttggttatccaaggagcagtgctgagctccttgcaatgggatatgggatgctggtgatttccaggaagtgagctcacaatgactcaagctgccacatactgttgattgtgaaatgccagttgaagcatatgtcctgcaagcttaggggtgctacaagttgaccactgcagcagtaaagatgactctgaagaatggcgtgggatggttcctttcaaatgcacttgagcagcggtctccaaccacagggccacagagctggagctggatctaccatgaaagacttgtgaatccaggaagagagactgactgggcaacatgttattcaggtgggaacatccagttgcaggaaaacaagcttaacacgcccactgattctacattatgggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgggaccatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcccgcctgccagtggcctcttcaggcccatggggctcattcctgacaacggcctttccaggcccagtttttcccttccggcggcctctccgggcccagaacctcctcaagtcggcctctccagacccacttgcac

SEQ ID NO: 459760 - DNA, 581 bp, Homo sapiens
acgcttccacgccatgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcccgcctgccagtggcctcttcaggcccatggggctcattcctgacaacggcctttccaggcccagtttttcccttccggcggcctctccgggcccagaacctcctcaagtcggcctctccagacccacttgcac

SEQ ID NO: 459761 - DNA, 696 bp, Homo sapiens
aagaaaggaatagataagggaagaggaggcaaaggtgaatatatctgatgaatcggaaaaaaagctccgtagatacaagtcaaacacaactctctctggctctggagtctacattcttatccactgtgcagtgcactgtactgacagaaggggaaaaccctacagtgtgtgatgcacttcctatgtcacagagtatgaagaatgtcacaaggtcacggaatttcagagctgaaagggatcatctagtccaacccattcatttcatgggtagagaactgaaacccagagaaaatagaaatgccaccacctcggtgccagatctcctagatgcccacctacaggaaccctacgaagataaaaattatcacaatttatacccaacatacctaaagaaccctgtccattgtgccctcattggttgtcctcttaacttggacaaatgtaaggcatcttaccagttcttatgcactgcaatggccactagatagatttgatgctaaccatcttaaatcagagttcctccattcttgagctactgatgttgactcatcatgtatgtgcatgcacatgagtttaaagaagagctccagggttctatattgtctaagttttgtttcagaatgtctttctcttgatactatatttgactgaaaataaaacttgagtcatacttcccctccttcagaattgtgtagt

SEQ ID NO: 459762 - DNA, 596 bp, Homo sapiens
aagaaaggaatagataagggaagaggaggcaaaggtgaatatatctgatgaatcggaaaaaaagctccgtagatacaagtcaaacacaactctctctggctctggagtctacattcttatccactgtgcagtgcactgtactgacagaaggggaaaaccctacagtgtgtgatgcacttcctatgtcacagagtatgaagaatgtcacaaggtcacggaatttcagagctgaaagggatcatctagtccaacccattcatttcatgggtagagaactgaaacccagagaaaatagaaatgccaccacctcggtgccagatctcctagatgcccacctacaggtaaggcatcttaccagttcttatgcactgcaatggccactagatagatttgatgctaaccatcttaaatcagagttcctccattcttgagctactgatgttgactcatcatgtatgtgcatgcacatgagtttaaagaagagctccagggttctatattgtctaagttttgtttcagaatgtctttctcttgatactatatttgactgaaaataaaacttgagtcatacttcccctccttcagaattgtgtagt

SEQ ID NO: 459763 - DNA, 3295 bp, Homo sapiens
ccagaaggttgtggggcaagtgtgcagtgtattgtgtactttacaaaagcattgtcaactttatccagaacggagtctagctctgtcaccaggctggagcacagtggcatgatctcgactcactgcaacctccactgaagaaggaattcatgaattttacaagtataatcaaagaccaccaagaaatttttactttttccttcaaaagctaagtgtagtgtagcaccccctgcccatagtctaagttacagaagaatactaactgcctgtttttctttctgtgttgtgagccttatctgttctcaccagtttcacattccttgaggctcagtgagttcctgcgcacctccctagcacagctgcaaagttacaaggttgatatgcatatgttacagaaacatagtttcccaaggatgtggaacatgtagtatagataaatgtaaaagactgatcaactgcctttgttctcgcttgtgtaagtagacttcatgaatcacatagctcccggccactgactgcttaaaaggtggctgcattctttctccagggctcagactttcctggacgctagtcctactgagccaggtgatccccttaataaaggctttcctgaactctcttcagtctctcccgtctctgattgtcccataacatttctgggggcctgtctgggattggagatggcaggtttctgtctcctttgcctaaggagaacggctcccatgtattggagcctcgccctgacagcgcaaacggaaccgactcaggagttgcaggacagtcacaggagcaggctgctgaacttgctgagataccaaggggctctgatacaaggaataaaagctggagggaaaaaggcaacaaacactggaaaggtttcagaggtccatcagaaaccagatgaaagtaccagtgagttctatgagaagctttgtgaggcttaccggctctacacaccttttgacccagaagtggcagggaatcagtgcatggttaatgcggcatttcttatccaagtggcaactaaagtgtttgtaaatcaagatgaagaagcaaagtgggaggccaagcatagagtgaaggaaaaggcagagttcttggctgcagccctgattgaaagagaggctggatttgcaagaggacatggacatggtcgtggatgcagtcatggtaaaggacaagctagggctaggccaggtcaggagaccaggacaggccctgaggagcccatggtctcaatggtagtagggggccgaaaaatagaccttatggtagacacaggtgctgaacactcagctgtgactcaaacaattagggtgttatcaaaactctatgctaatattattggggccacaggacggtgtgagcttggacaggagcgaaaagagattgtctgtagcattcctcagccagacagaaggcagcaagtgcaggaattcctaggggcagctggtttttgccaattatggattcctgactactggctcctagcaaagcctttatatgaggcaaccaaaggaggggaaaaggagcccctccagccagacagaaggcagcaagtgcaggaattcctaggggcagctggtttttgccaattatggattcctgactactggctcctagcaaagcctttatatgaggcaaccaaaggaggggaaaaggagcccctcctttggggaaaagaacaggacatggctttcaaggaaatcaagaaagcttcaatccaggccccagcactaggactgccagacatgacaaagcccttttacctgatgctaagataccaaggactcctatgtgagaatccatacatcaccttagaggctgtgaataccctaaatctggccacactgttaccaatagaatgtgcagaacatggaaagtccctgttatgtgccccagggtaccactgctgtgtagaaacagtggatgaagtattttcaagctgggaagacttaaaggatcaacccttaagaaacccagatgttgaatattttactgatggaagcagcttcatatctgagggtatcaaaaaggccagatatgccgtagtcacattaagctcggtggctgaagcctgccccctaccagtaggaacctcagcgcagaaggtagaactaatagctctcacaagagcactatttctagtgaagggaaagtcagtgaatatctatgctgactcaaaatatgcttttgccaccttgcatgctcatggagccatttacgatgaaagaggactgttaactactgaaggaaaagaaataaagaacaaaaaggaaatagagcagctcctagaggctgtgtgggctccaaaggaagtagcagtcatccattgtaaaggacagcaaacaggaagaagtgataaggctacaggaaacagcaaagcagacaaggaagcaagaaagactgcaatgacagaaaaaacaaagaaagaagagacttatgccatgcccttattagagcctccccttgcagacactcctaattactcgtccaatgagaaggcatcgtttgtgcaggaaaacgggagttatcagaaagaaggctggtggaagttttcagatgggagacttaccattccagaagccattgccccccaatttataaagcagtttcaccaaggaacacacatggggaagacagatttaaagattctcatagggcggtatttcattgtgccatgcctaactgccatgactcgagccatctacgagcagtgtgttacttgtgcccagaataacccaaggcaagggcctacttggcctcaaggaattcaggaaacaggagcagtgccatgtgaaaacctacttgtagactttaccgaactgcctcaggctggaggctatcggtacatgttagtgtttgtctgcaccttttcaagatttggactgcctctaaccttaggctcagaaaatggaccagattttgtggcagaagtaaaaggttgtaaggatgaactggacactgaaacaactgttgaagaagttttgccaagagactcatttaaggtgggaccaggtattgcccatggtccttctctgagtcaggtgtacccctacaaaattaactgggtgttcacctatgagatagtgcatggcccaccacccccactcatatctcaagtaaaaggagatttaaaggaaattggagaactgaccctaggaagacaaatgcaggtattaggtgaggtaatgcaagaagtacaagggtgagtaagagaaagaatacctgttagccttacagatgcaatacattcctttcaacctggggacttcgtatgggttaaatgctggaa

SEQ ID NO: 459764 - DNA, 1735 bp, Homo sapiens
gacccgctaactagatagtgtggaacctctgctctgtgaaaaaactcatagaattcctcatcttatgaacgagagttggttagagaaaagagtcccagacctcaatggctgccgggatagacagaagtacagagattggctgtccttagccaatgcagcagctccatctgcatccctggatccttttatgttctgttacatctttcatactgacttacctccaccagctttctttgcttctagaactataactagactcaagtcccagcaggcccatttaggggcttttagccttctccaaaggagactacaactttttaccaagataactgtgcactggggaaaaggaaataaccagaccttttggagactactggatgcagcttttaattccaggagaacccacacattactgtggcccttcagtcagagtagttgcttatggaggccaattaatcaatggagttttagctcagatccatcttacagtgggcccagtggtccccaagcccatcccatggttattttcccatgaagtaacttcccatttagtcagcactgtactgcaacgctgtgaccacttggggcccacccaatgaaagagagtttgaaacaagtccaaagaagagcaatgaaaataattaaatggttggaaaattgtctgtctaaataaaggtcacagacactgggcctatttaatgcagaaatatgaaggggcaaacctatccacattcctcaaggatgtgaaaagaaataggcagagagatcattttcttcagtttttcaatggaagaaaaaatacattcaaaagacgtcttcaccatacaaggaattctttgttcagactggctactgacattccaaacaaacctacactcaagataaagttatcctctcggaacactcagacattttttttttcttccctatcatcaacttgccaacattaaaggcagttctcacttttagacacaacgtgtttgatgcaaatgcaacttaaagaagattactgtaaggtctcgcctggctggtcttgtattacatcctgattatgcatgtgctgtcacatgagagtggaagccaccaaataagtagctatggtcggtgaaaagtgaaatacgagtctttattattaagtgtccagtaagaggtgtggtgaaaagcaggactcccaaattgaactggtgaaaaatatgaactatctgcaccttacaagaaaataagcaaaaacctttcttctggacatcttaagtagtcttttttttttttttttttttttttagagttgataattaaactgtgaaagagagagcatcgatacactgtcttcaattcttaagcaggcccacttctccactttctaagtttctcactctcattagcaatatatattgcatttagcttcattcctagatggaccatttgtgaagctattgaattattaaaagcaggtaccttttcattgagcctcaatttaaggcttgaacttagagctgttttgctgaattggcaagaggggagaaaaggaaagtaacaagactttcaagtaaattactacctagaacattttttaaagtatttttggtcaaatcaaatatagggagcaccaaattcccagaaagaaagattcccttgaatgtatatttttcacaaattttgtgggtcagctgtctatatttttcatgaaagcctaaaatacttcaaaatgctttctgcatatttatatcacttgtgt

SEQ ID NO: 459765 - DNA, 1127 bp, Homo sapiens
ggagcgctgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctgg

SEQ ID NO: 459766 - DNA, 1213 bp, Homo sapiens
ggagtttgcatggagatggcctctgtcgttaaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagccccacctgctcatctccctgccccaacatcctgtgccatccctgtggtgtgtttgggtcttggccaaagccagacctggcagaactgatggatacctggtgaggcagcggagcccctgggctcccaccccattccctcctcccggggctgcacagcgccattcgcgaacgatttcccaagttactacgcctgg

SEQ ID NO: 459767 - DNA, 2237 bp, Homo sapiens
cgtgtgcaccctagcgtcagcctcgagtttgaccagcaacaggggtcggtgtgtccctctgaatctgagatctatgaggcagtagctggggacaggatggcaggagcgcccatggctgctgctgtgcagcctgctgaggtgactgttgaagttggtgaggacctccacatgcaccacgttcgtgaccgggagatgcctgaagctttggagtttaacctttctgccaatccagaggcaagcacaatattccagaggaactctcaaacagatgctttggagtttaacccttctgccaatccagaggcaagcacaatattccagaggaactctcaaacagatgttgtagaaataagaagaagcaactgtacaaaccattgtgaccttggagatacctcatcatatcacacaaagagatgcagatagatctttgagcatacctgatgaacagttacactcatttgcggtttccaccgtgcacattacgaagaacagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatgacctatccaaggacatggacaccgggctgggtgactccatatgcttcagccccagtatctccagcaccaccggccccaagctcaacccgcccccctctcctcatgccaataaaaagaaacacctaaagaagaaaagcaccaacaactttatgattgtgtctgccactggccaaacgtggcactttgaagccacgacatatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcacccgcctttcccgtgtgcgatctctggagctggatgactggccagttgagctcaggaaggttatgtcatctattggcaatgacctagccaacagcatctgggaagggagcagccagggacagacaaaaccctcagaaaagtccacgagggaagaaaaggaacggtggatcctttccaaatatgaggagaagctctttctggccccactaccctgcactgatctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgaacagcatccaattgacacaggatttcctgtttctcttgagtttttctttctgaaggctcctgtgtctgccggcctaactcatttgaaggagcatacactattgtgtgggagtcatacttattcctaaccattttgaagagattcatctttaaattaatatattacattaaatgtcttccttcagaaaagacaatcttgtgaacatcgcctttggtgactgaacatcacgagatataaaacaggtagaaaaagaaaatatttggggtggctctaactcttaaatcccatgaaataatcccctcttcttt

SEQ ID NO: 459768 - DNA, 1900 bp, Homo sapiens
cacagccatcagcattatcttacaatgacaataatatctgtgaccttggagatacctcatcatatcacacaaagagatgcagatagatctttgagcatacctgatgaacagttacactcatttgcggtttccaccgtgcacattacgaagaacagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatgacctatccaaggacatggacaccgggctgggtgactccatatgcttcagccccagtatctccagcaccaccggccccaagctcaacccgcccccctctcctcatgccaataaaaagaaacacctaaagaagaaaagcaccaacaactttatgattgtgtctgccactggccaaacgtggcactttgaagccacgacatatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcacccgcctttcccgtgtgcgatctctggagctggatgactggccagttgagctcaggaaggttatgtcatctattggcaatgacctagccaacagcatctgggaagggagcagccagggacagacaaaaccctcagaaaagtccacgagggaagaaaaggaacggtggatcctttccaaatatgaggagaagctctttctggccccactaccctgcactgatctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgaacagcatccaattgacacaggatttcctgtttctcttgagtttttctttctgaaggctcctgtgtctgccggcctaactcatttgaaggagcatacactattgtgtgggagtcatacttattcctaaccattttgaagagattcatctttaaattaatatattacattaaatgtcttccttcagaaaagacaatcttgtgaacatcgcctttggtgactgaacatcacgagatataaaacaggtagaaaaagaaaatatttggggtggctctaactcttaaatcccatgaaataatcccctcttcttt

SEQ ID NO: 459769 - DNA, 400 bp, Homo sapiens
cgtgtgcaccctagcgtcagcctcgagtttgaccagcaacaggggtcggtgtgtccctctgaatctgagatctatgaggcagtagctggggacaggatggcaggagcgcccatggctgctgctgtgcagcctgctgaggtgactgttgaagttggtgaggacctccacatgcaccacgttcgtgaccgggagatgcctgaagctttggagtttaacctttctgccaatccagaggcaagcacaatattccagaggaactctcaaacagatgctttggagtttaacccttctgccaatccagaggcaagcacaatattccagaggaactctcaaacagatggtgagacgacattgttttttccgccaagagaaagaataaaagctcttgtttgatcaggtt

SEQ ID NO: 459770 - DNA, 1524 bp, Homo sapiens
aaaatgtgggaagacctgcctttgccaataacaagactccttggaagataagatggccccttactctctctaacaacagacttccaagaggaatttctctatgatcttgttccaggaatgtgtttcccaagaagcaagtctggattcatcttatgtacactcctggcctgtctctgaaattcggggatctgctcagcagaccggaacaacccaggaggcatctgggctctggaaggaaatacaagccagccagttccagcagctttttcccaaagcctggagcaggctctgctctgtagctactagcatttttacgacagtaacctgaggccactcatcttaggtctgattgatgagtaggtcagaaatcatcccagcgtggaaccctccttgactcacgctgtctgggtgaacacacagacccattccactgtttcctggccagcttgacttcactcttcttatttttcttgggctaagaaaagacattctttgctggatataaatatcatgcatttcagaaagttcatatgtacaaataacatggattcgggatcattacagttgttaattttagtaaaataatttttttctttggcttgcttcttgaattctttagtgatcttggacatacaaacacagacttcttgttctaattatctcaggtgcctcctgaccccctcccttgtgtcttcacctccctgaaaagtggatgtttttgtacaggttgtgcatatcggcggctctgtggccaatccagtactatcctatcacgtgctggggacacgatgtggtcagacgtatcgtcgttctcatggtctcaagttcacattgtctctcacacaggtacttggatctgctatagacggccacgggcctcctggatttggtatacaggggtccagacaccttggatttgatatagagggttttgggcctcctggatttggtaaagaaggattcagagtgcctggatttggtatagaaggattcagggctcctgagtttggtatagaggaggcatggctcctggatttggtatagagggattcagggctcctggatttggtatagaggattcagggctcctgggtttggtatagagggattcagggttcctggatttggtatagagggattcagggttcctggatttggtatagagggattcagggctcctgggtttggtatagagggattcagggctcctgggtttgatagaggattcagggctcctggatttggtatgcagggattcagggctcctggatttggtatagaggattcagggctcctggattttgtgtagagggattcagggctcctggatttcgtatagagggattcagggctcctggatttggtgtagagggattcagggctcctgggtttggtatagaggatgcagcgctcctggatttggtatcaaatttcctggatttggtatcaaatttcctgtctcttagactctctttttctttttccattcttccagcttgcctggctgcctcttccctgtatctt

SEQ ID NO: 459771 - DNA, 2593 bp, Homo sapiens
aggtgaaccacagcaaccccttccagagagcagatgcttaatttttaggctgtggtgataactagaataacaggacctaataataatggggcagaaaagaagtcaaggcaagggatccctgcagctctcaagctgttctctctgcataggcttcatagtgggagagcaaaggggcttagtaaatgggcggcaggatggcctgaaaaacactatcaacaacagcaaaactatcaccataatcatcaccaacaccatcagaaacaccaccaacaccatcatcactgtgaccaataccaccatgaacacccacaccatcatgatcaacaccatcaccaacaccatcaaaaatgttgtcagaaataccattactaacagcaaaatgatcattaccatcgtcaacacaatcagaaacaccattatcatcaccaccaacacctgtttttctgatggtgttggtgatgatgatggtgatgatttcactgttggtgatgctgtttctaatggggtttatgatattgttggtattggtgatgttattggtgttgatgagggatatgatttgtacaataataacggtgttggtggtgatgataatggtgtttctgattgtgttgacgatggtaatgatcattttgctgttagtaatggtatttctgacaacatttttgatggtgttggtgatggtgttgatcatgatggtgtgggtgttcatggtggtattggtcacagtgatgatggtgttggtggtgtttctgatggtgttggtgatgattatggtgatagttttgctgttgttgatagtgtttctggtggcatttttgatggtgttgtgtttctgattgtgttggtgatgcttatgatgctggtgatggtggtgatggtgtttctgattgtgatggtgatggttataatgatgaagaaggctgaagactgggtacattgatttcctaaagaagacagagtcactgcttagctctacgtgctactgttcacaagcattcctctccataaaaatagttatggtaacttaaaattgcttttcattttttacattgtatcattaactttgtcgatcttgtgccctgttcttccactgcaaagcagactccttggaagataagatggccccttactctctctaacaacagacttccaagaggaatttctctatgatcttgttccaggaatgtgtttcccaagaagcaagtctggattcatcttatgtacactcctggcctgtctctgaaattcggggatctgctcagcagaccggaacaacccaggaggcatctgggctctggaaggaaatacaagccagccagttccagcagctttttcccaaagcctggagcaggctctgctctgtagctactagcatttttacgacagtaacctgaggccactcatcttaggtctgattgatgagtaggtcagaaatcatcccagcgtggaaccctccttgactcacgctgtctgggtgaacacacagacccattccactgtttcctggccagcttgacttcactcttcttatttttcttgggctaagaaaagacattctttgctggatataaatatcatgcatttcagaaagttcatatgtacaaataacatggattcgggatcattacagttgttaattttagtaaaataatttttttctttggcttgcttcttgaattctttagtgatcttggacatacaaacacagacttcttgttctaattatctcaggtgcctcctgaccccctcccttgtgtcttcacctccctgaaaagtggatgtttttgtacaggttgtgcatatcggcggctctgtggccaatccagtactatcctatcacgtgctggggacacgatgtggtcagacgtatcgtcgttctcatggtctcaagttcacattgtctctcacacaggtacttggatctgctatagacggccacgggcctcctggatttggtatacaggggtccagacaccttggatttgatatagagggttttgggcctcctggatttggtaaagaaggattcagagtgcctggatttggtatagaaggattcagggctcctgagtttggtatagaggaggcatggctcctggatttggtatagagggattcagggctcctggatttggtatagaggattcagggctcctgggtttggtatagagggattcagggttcctggatttggtatagagggattcagggttcctggatttggtatagagggattcagggctcctgggtttggtatagagggattcagggctcctgggtttgatagaggattcagggctcctggatttggtatgcagggattcagggctcctggatttggtatagaggattcagggctcctggattttgtgtagagggattcagggctcctggatttcgtatagagggattcagggctcctggatttggtgtagagggattcagggctcctgggtttggtatagaggatgcagcgctcctggatttggtatcaaatttcctggatttggtatcaaatttcctgtctcttagactctctttttctttttccattcttccagcttgcctggctgcctcttccctgtatctt

SEQ ID NO: 459772 - DNA, 2538 bp, Homo sapiens
ctgactgcagaggcctggaaaaccatggaaaaaatcctattcctcaaagtcgagccctacctcctacgcctcttaaatcaattgccacagtgaccaatttgtcagtcacctaaaggcagctatcctgaccacttaagggagaatacttataatctttatacctaagtaaagattgtgagaggaaagaaatggtttaaagaatatgaatgtgtcacacttctgaggttaatgataaatgaattggtcctgcttacctcaggaaaaactttcaagtctttctgaaaaactaatttaattcagtagtattttctaagatttaggttatgtttttaatcaatttggaaaccaagatttacttatagaaaaaaaggaaaaggacctagataggtttattcacatagaatcccaatttcacttctctggatgataccattttctacaaaagcaattatgttctaaaatttaagtgtgctttcttaggctttatcagttcacagtgtttccttaagaaatatgatccagtattttttcctaagactaaagttgagttactacgtttatgactgagaaatgaatgtttgttagtttgtttgtttacaataagaattttttctttaccattttatttttattttccccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttacaattgcctgaatcctcttttttatggctttctggggaaaaatttaaaaatattttctccagcttctaaaatatatccccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactactttttcataactctgtatactggtgcatttttttccaacaatatgtgccaatctaggaagcccaagaagagaaaatagattgaagcaggtcacaaaagtgtgaatgaagaaaacaagtttcaaggaatttc

SEQ ID NO: 459773 - DNA, 2485 bp, Homo sapiens
actagagctaaaccaggaggcatagaagcaagtaggaaattcagaatgctcagatgtttagaggttgacaagctaagagccaacagaggaaatgagagagaaagtggctggcaaagaataagaaagccagaagggcaagtggtgtcacagaaagccagacaagaaactgacaacagatggatacatcaccatactctacccacagctgataaattcatcagtgagcccttgacctggtgccaaccaattcttacaaccagtgacacctatgaggtggcctggaacagaaggtccagatatggagagcagcaaatgccaaaaatccaaagcagttttatgcttggccatattcaaaaaccagcgaggtggacaatatgggaggagcagagcaggttaagtatcagacttccacactggggatgcttcagcctcctacctcccattaaagagtagatcccagagactggtgccaacttcagtgcttgcacataaaaagagagtgttcaattctgtgagttggggtggagcagggttgcaaagacagaataagctttatataggcaaaaataaacttgagttaagtctcaggtaaataccagtagtatgccagggaaataggaaacacactcgcttcagcctgcaccaaccaaaatgactgctcaaaggccattcagcccctttatcactgtggctcaactttgattttcttcccagttcatccatgattcagacttcttctgtttcaggagctttgcccatgcgttctgccaccttctgccaggaattacacctgtcccatcccgtcgtctcctgaatgtccagagacaggggtctccccgtgttgtccagaacggtcttgaactcctggtcttcaagcaatcttcctgccttggtctctcaaagtgctgggattacaagtgtgagccaccatacccggtcatagcgctcttataaaatgcatcatcacatttattttataaattcagaaacaaaagtctgtatagagaagttttgaagttactagggacctgaaaatcatactgaagatgtctgcaactaaaaactcgaagagttccgaggctagaggggtcaggagatgaataaaaacgttagccccagctgatcacaatgaggttaatcacaatactaattaaaaatactacagatcctaggacaatggtcagaagagtgactatactttcctgtttgcccttggaaaatcgagggctgacttttctacgtgctcagataacctaaattgatagagagaaagctagcagaggataagataaactagttaactgtaaataagattttgctgttggagaatcttcttgttgctctggttttagatagcggaggaagccaaaaaatatctgctttaagttaccaggagttgaagttcatccctgctgaagttaacaggttgcttccctttttctggtgtattcttactttactggcaaagagaaaataaattaataccttattgttaaaaggactgaaggggtctcccttgctgccaataaaaattgctttgtgttgtaaaatttgggttcagcttgtctcctccttatataagcccagttgaatagactgctgagggaaaatcaaagtttaagagcctggcttttcccgtttggcaactttcatttcctgataatatcggataattaacaaattgtgtgttttaatgccctgtctcttgaagcgcatttgggaaaaatacttcttgtgccctctgagtaatggcttaaatggaagaacatgctcaaaagaatgctttttctcaatgcatgaaacacactcagcatttattattttaattgctacacatcatgtgtatactcgttcgtgtaattatatacatatttaaagggcaagaggaaaagattattttaggactctataattcattatgagcaaggcattgaaaatttctaactcaagatgaaaattcataaaaattctttggcaaaaacaccttagtattctcaatacggtaactgacttttttttttttgcgttatgaaataactagatactaccgtgcgttgcttttggataaaaggggaatgctgtttcttagcctttctgtctctttactaaatggataattcaggactgggaaatgcagctctaagtttgttgtttacgaaaaacacatgctaatgtaacagcgtatgaggaattaaagagaaaatgtcaaacgcgccttgacatccaaaatgcatttagctgttggcttttactacagggcctttcactctccagccgaccccctccaagaccaagtgtttttgcgtgttgggctaaaaatagccagccaagcctaacaactagcttctgattggctcagagcaaaggccactcagccaataagagcttctgggaacaaaagcaattcttttgtgtgagatactcaacccacgtcaaaacagcttcaggctgtagaaatgattttggttgagctttaacaaggtaa

SEQ ID NO: 459774 - DNA, 1935 bp, Homo sapiens
ttgagtgtgttgttgaggtctagtatccattctgtatttgaacggcagcgtcgctcgtctgtcctgacgaaacacactcgcttcagcctgcaccaaccaaaatgactgctcaaaggccattcagcccctttatcactgtggctcaactttgattttcttcccagttcatccatgattcagacttcttctgtttcaggagctttgcccatgcgttctgccaccttctgccaggaattacacctgtcccatcccgtcgtctcctgaatgtccagagacaggggtctccccgtgttgtccagaacggtcttgaactcctggtcttcaagcaatcttcctgccttggtctctcaaagtgctgggattacaagtgtgagccaccatacccggtcatagcgctcttataaaatgcatcatcacatttattttataaattcagaaacaaaagtctgtatagagaagttttgaagttactagggacctgaaaatcatactgaagatgtctgcaactaaaaactcgaagagttccgaggctagaggggtcaggagatgaataaaaacgttagccccagctgatcacaatgaggttaatcacaatactaattaaaaatactacagatcctaggacaatggtcagaagagtgactatactttcctgtttgcccttggaaaatcgagggctgacttttctacgtgctcagataacctaaattgatagagagaaagctagcagaggataagataaactagttaactgtaaataagattttgctgttggagaatcttcttgttgctctggttttagatagcggaggaagccaaaaaatatctgctttaagttaccaggagttgaagttcatccctgctgaagttaacaggttgcttccctttttctggtgtattcttactttactggcaaagagaaaataaattaataccttattgttaaaaggactgaaggggtctcccttgctgccaataaaaattgctttgtgttgtaaaatttgggttcagcttgtctcctccttatataagcccagttgaatagactgctgagggaaaatcaaagtttaagagcctggcttttcccgtttggcaactttcatttcctgataatatcggataattaacaaattgtgtgttttaatgccctgtctcttgaagcgcatttgggaaaaatacttcttgtgccctctgagtaatggcttaaatggaagaacatgctcaaaagaatgctttttctcaatgcatgaaacacactcagcatttattattttaattgctacacatcatgtgtatactcgttcgtgtaattatatacatatttaaagggcaagaggaaaagattattttaggactctataattcattatgagcaaggcattgaaaatttctaactcaagatgaaaattcataaaaattctttggcaaaaacaccttagtattctcaatacggtaactgacttttttttttttgcgttatgaaataactagatactaccgtgcgttgcttttggataaaaggggaatgctgtttcttagcctttctgtctctttactaaatggataattcaggactgggaaatgcagctctaagtttgttgtttacgaaaaacacatgctaatgtaacagcgtatgaggaattaaagagaaaatgtcaaacgcgccttgacatccaaaatgcatttagctgttggcttttactacagggcctttcactctccagccgaccccctccaagaccaagtgtttttgcgtgttgggctaaaaatagccagccaagcctaacaactagcttctgattggctcagagcaaaggccactcagccaataagagcttctgggaacaaaagcaattcttttgtgtgagatactcaacccacgtcaaaacagcttcaggctgtagaaatgattttggttgagctttaacaaggtaa

SEQ ID NO: 459775 - DNA, 1504 bp, Homo sapiens
catatataaaccgctttgcaaaaagagagtgtatggaataaaagagaaaatgaagaagaggagaaaggctggagtgcaatggtgtgatctcagctcactgcagcctcaacctccctggctcaggtgattctcccacctcagcttcctgattaactgggattacagtaatggtgaaattgccggtaatcgctaagtaaaaaccactgaagaacaggacagaagccaatgaccacctcacctccaccgagtgccctgcagaaaaaggaaatggaaatccttcctgttattctccgcgtcccttcgtagaaggctgcctgagaggtcagcacaggagtcctctaagtgccctgcagagaacacgggtctcggagccggacaaacctaaattttgaaacccactttgagtttgaacttggctgtgggaaagttacacaatcgctctaagcctctgttttctcatcagtaaaacagagaggggttgcttgtgtgagaagtggccgctgccaatcatctgcgtgtccttcactctcccaggggccatgggtctgtattctacacatgtgggatcttcctctggacccttcggacatggtccacacgctgccctcaggatctgctggggtctgcatgggggaggtctttgaaacttcaaaatcccgtagggtgtgtgaccccagtgagccccacgctacatccagcgagaaccgagaagtgatggtgcagacattcttgggtcccccagacagaacacaccgggaggccgcccagctccagctcagacacacacctgctccaactgctgtgctggtcacaggcccagagcaccacgtgtcctctggggtctgtgtggtcggcgccgtgcgtgggaccactccggggctcctgccgggtctgcggagcccagagccatgctctctgccgactccatctccagatgcctgccccggcacccacgctgttgccaggacaccagtgaacccagacaggagcctgctgctgccaccattgagagatggagaagcaggagagtgtctggggagtcaggcgaaccccaaagacaacccacagactctattcacacaggagctcgagtgtggggaggccagcaagccgcctccctggccacaaaatctcagtcatgaaggtccccagctggcatgcgtgacaccactgcaacatgctcagtggcccctgaacctcctccaggagacgcccacactgggttgtaactccctatgcaacatcggcttccaccactcgacggtcggcacagaacctgccagcaaagccaacgggtccaggggtgacctgccggtgaagagcgacagagcagaggcacctcctagggactggggctcagacgacctggctctggacagacacaatgacggagccaaggactctgtgaacgaggacaggacatgttagcaaagtcctcagctgcctgacactgtggtgagcccatgggaggaaaaccattgggccccaaccctaagggccagtc

SEQ ID NO: 459776 - DNA, 2217 bp, Homo sapiens
agcgtgtgcgcggtacggggctctcctgccttctgggctccaacgcagctctgtggctgaactgggtgctcatcacgggaactgctggggtatggaatacagatgtggcagctcaggtagccccaaattgcctggaagaatacatcatgtttttcgataagaagaaattgtaggatccagttttttttttaaccgccccctccccaccccccaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccctgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgaggaaataatttccgatgatttaccattagaacatccctctgctagttaaagtctaatctgccagtatagtgttccttccagcctgtggcacccactccagcctatctcatgtcattcattaaaaagcaagactgcatcacagtctaccttatgttagagttattaaggggtttgtatcac

SEQ ID NO: 459777 - DNA, 3412 bp, Homo sapiens
gctggtacggccggagattagggatagtccctgcagtggctgtaacaaaaccagacccccaggtcccggccaatggaggcgatttagactggagtgggaccgcgtctgtcaaaagcccgactcggcagcagcggcggagtccaggaggagagctggagccgccgcgctgcctccccgcccccgccgggatttattatttggactggacaattaagtggccctgatgatgttaccaagcccggtcacctccacccctttctcagtcaaagacattttgaatctggagcagcagcaccagcacttccatggtgcgcacttgcaggcggacttggagcaccacttccactctgcgccctgcatgctggccgccgctgaggggacgcaattttctgacggaggggaggaggacgaggaagacgagggcgagaaattgtcctatttgaactcactagccgcagcagacggccacggggattcagggctgtgtccccagggctatgtccacacggtcctgcgagactcgtgcagcgagcccaaggaacatgaagaggagcccgaggtcgtgagggaccggagccaaaaaagctgccagctgaagaagtctctagagacggccggagactgcaaggcggcggaggagagcgagaggccgaagccacgcagccgccggaagccccgggtcctcttctcgcaagcccaggtcttcgagctggaacgcaggttcaagcagcagcggtacctgtcggcacccgagcgcgagcacctcgccagcagcctgaagctcacatccactcaggtgaaaatctggttccagaatcgcaggtacaagtgcaagagacagcggcaggacaagtctctggagcttggcgcacacgcgcccccgccgccgccgcgccgcgtggctgtcccggtgctggtgcgggacggcaagccgtgcgtcacgcccagcgcgcaggcctacggcgcgccctacagcgtgggcgccagcgcctactcctacaacagcttccccgcctacggctatgggaactcggccgcggccgccgccgccgccgccgccgccgccgcagcagcggcggcctacagcagcagctatggctgtgcgtacccggcgggcggcggcggcggcggcggcgggacctccgcggcgaccactgccatgcagcccgcctgcagcgcggccggaggcggcccctttgtgaacgtgagcaacctaggaggcttcggcagcggcggcagcgcacagccgttgcaccagggtactgcagccggggccgctcgatttcgtttcgcagctgtctcccctccgcagcagatacctcggtccagatctccggattgtcgggggacgcaggactcttcgaggaaaaccagccgaatgagatcaaaagttgggggtggggggaggctgaacaaactcaggacctggtggcccaccggaggtgtcgaaggctcagggccatttgaagtccctggctttgcagttccccctaagttttacccagatgcttggactagctgtatagacctgcgttcggtcaagtcttgcactctgccccacctcgagggtcgccagggaaaaggaagcctcgctcgcagtcccagctgttggccgcgcgaaggcggctccttccctggctgcagccagggctaccaacgcgcccgggggcgctgcgctgcgccccactgcggccgagctctcccccttggccgccctcccttctcccccggcggccgcggctttatgcggctccttgtcacttgcggagaatgcctgtgcgaggcctgtgctgccacacggccgattgtgagcgtgccaaggcgggtgaatggggaggcctcagagcgccgcgccattgtggggccgggcctcgctgaaaggcggctccgggccgggaaggtgcggaaagaatggctttttattggagtcccgaacaaaaggcggcagaaagaccccagagccgagcgtgagccagtgcaccagactgctggtcccgcagcaactcgcggccgggtccctcctctttcacgtcgcccccgaactgggacacagcctcccaccacctggcttgtgatcctcacagaggaaacagaactggttctgtggattggcttccgcaagtttgcgtgtcttgagatacttgaagccagcctagaccagcccgctccctaccctgctccggagcctgcagtctccaggggggtgggaacaggggcgcggggggggtcgtgggaaacagggcggcacaaggaccgaaaaccccagctccgcgggcgcgtgtcaccacagagatccggcagagccattgcgggtaaacctgggacaggtggcgcccggcggggtctgcagggctttgatttcggctgcatctgggacattcgacagaaggggaaggtggaaggacgtttcctgggggaggttcgagtcctctctagcccaccactgcagggaggaaagggtaaggagtggaaacccggcccctctccgcggggcttctcccgggcccgcgcgcgccgccggagtgacttggggccgcgcctctgccagggtggggccgggtgggcaggggcttccctggagactcgcgcgggagaccgggaggtccaaggccccagtcgcagccgcccagttcctcgctttctggttcaggacgccagtggggacttcccgggcgcctcctcccaactccaggggcccgagccctggaaggactgtgatttgcgggcccggggcggtcagagccagctgggccgggagtgccccggcgagccccgggagagcctagccgactctgcagtgaagaagaagaagatgatggtggtggttgggggtttcttggaggctgagagaggccatcatgttacctgacgtgaaaaaaaaggaatgaacttaactcattttaaataactctattttaaacaaataatattgcgatgctgaagggaggataaaaaccaaataaacaagcccaacaaatatttaattctagttagaaggagttttttctgtagtgatatggcagaaatgataacatcagaatatcatctttgtgcaaccatgatttagacaggaattatcaatggatgctaaaactagtggatagaagtttgataaagaagaggatatgtacatagattcagagcacccccatgaaaataacttattgattacaaagggaaaattagtaactccatggtacaagaatgtttatagcagtaaaaactggaaatagtggaacactggaagcaacctgtgatggttaattttatgtatacttggctaggcaatggtgcctagttgtttggtcaaatattagtctggatgttattgtgaaatattttatagaggtgattaacatttacaatcaactaactttaggtaaaaggaattatccataatggccgcatccaa

SEQ ID NO: 459778 - DNA, 2832 bp, Homo sapiens
tcgttggcatggctggagtggaagatgtgagctggggagtgctgggggggctagttttgaactcctgacctcaagtgatctgcctcagcctcccaaagtgctgagattacaggcatgagccactgtgcctggcctatgattgttgataaatacattctcaagattctctcagactttctgaatcaaaatctccagccatgtctctgtgactggcccccagtaaaaaccctggacaccaaggcatggaaacagtaattcgtttgatctggactgtgtggcccgaaccctgtatgtaatatactgtcccactgacttccctcatggttacaacgtggctgccagcaacattaggggcaacatactcccttgcgtaccatattatctttctgaaaccaaaaacatggtaagttcttttttttttttttgaaacggagtctcactctgtcacccaggctggagtgagtgtgatcttggctcacggcaacctttgcctcctgggttcaagcaattctcctgccctagcctcccgagtagcagagactacaggcacccaccgggtgtgggtcccagaacgcccgggcgtggggctgggggtgtggcgcagcgaggccgcgcagcaagcagtcctcccggcaccgtcggaagcgcagttgcagcagccgtcggacaagcggccggagcagccacggacaagcagtccgggccccgccactgggcattgcagagagacagagagagagaggaaggctcactggctttgagctctctgggtacagtgtctgagtggaggcaaagtgcggttccttcaagatgtctgtgttgaagaagaacaggagaaaagactccgacactccccaggaaccttcggagaaggccaaagagcagcaggcggaggcagagctccggaagctaaggcagcagttcaggaagatggtggaaagccggaagtcttttaagttccgaaaccagcagaagattgcgagtcagtacaaggagatcaagaccctgaagacagagcaggatgagatcaccctactgttgagtctcatgaaatcctcgaggaacatgaatcggagtgagaagaactacatggagctgcgactcctgctccaaactaaggaggactatgaggcattgattaaatccctgaaagtgctgttggctgaactggatgagaagattcttcagatggaaaaaaaaatcgcaaaccaaaaacagattttcgcaaaaatgcaggaggccaataacccccggaaactgcagaaacagattcacattttggaaacccgtttgaatctcgtcactgttcactttgacaagatgctgaccactaatgccaagctccggaaggagattgaagacctacgatttgagaaggctgcttatgacaatgtctaccagcagctccagcactgcctgttgatggagaagaaaaccatgaacttggccattgagcaatcttctcaggcctatgagcagagggtggaggccatggctcgaatggctgccatgaaagaccgccagaagaaggacacctctcagtacaacctggagatccgagagctggagcgtctctatgcccatgagagcaagctcaagtccttcctgctcgtcaagctgaatgatcgcaatgaattcgaggagcaggccaaaagggaggaagtgaaggtgcccaagtctccttctctcaaggcaaagaagcatgtcaagaagaacaggggagagagttttgagagctatgaggtggcccacctccggctgctgaagctggctgagagtgggaacctaaaccagctcattgaagattttctggccaaggaggagaagaattttgctcggttcacgtatgtcacggagctcaacaacgacatggagatgatgcacaagaggacccaacgaatccaggacgagatcatcctcttgcgatcccagcagaaattgtcccacgatgacaaccactctgtcctgagacagctggaggccactggatggcagcaaagcacatgctgcccattgaggtgctcagagcggcatctcccggatatctgggtatggggaataacagggttccaggcagggtccaggtccacggagaccctccccaagctgggcagatgcctggggcccacgtccttcactcggggccacccagaatccagactcttgttgaggttgagactggcgcccctctacatcttggcagcccagatcccgcacctcctgtacttcctgctcctccccgccctctgcagtggtggcaccacccacagtgcccccaggcccaggtctctcggcagccatcttggtcctgcttcttgttctccagccatcattgaaaagaagaccaacgacctgctgctgttggagacctacaggcgcatcctggaagtggaaggggcagaggctgagatcccgccacccttcatcaaccctttctggggtggctctgccctcctcaagcccccagaacccatcaaagtcatccccccagtgctgggggctgaccccttcagcgacaggttggatgatgtggaacagcccctggaccacagcagccttcggcagctggttctcgacaattatatcctgaaggagaatcggagtaaggaagtgcgcggagacagcctgcctgagaaggtggatgacttcagatccaggaagaaagtaaccatgtgaggtgcatgcatggggccacctttgcaacataaccgaaagaataaatgttttgttctgtaaaagcctcgtgcctgtcacacacattactaagggctttggagggatcccacaaggccctgttctgatgtttgtgtggagctggaagagagaggagta

SEQ ID NO: 459779 - DNA, 2557 bp, Homo sapiens
tcgttggcatggctggagtggaagatgtgagctggggagtgctgggggggctagttttgaactcctgacctcaagtgatctgcctcagcctcccaaagtgctgagattacaggcatgagccactgtgcctggcctatgattgttgataaatacattctcaagattctctcagactttctgaatcaaaatctccagccatgtctctgtgactggcccccagtaaaaaccctggacaccaaggcatggaaacagtaattcgtttgatctggactgtgtggcccgaaccctgtatgtaatatactgtcccactgacttccctcatggttacaacgtggctgccagcaacattaggggcaacatactcccttgcgtaccatattatctttctgaaaccaaaaacatggtaagttcttttttttttttttgaaacggagtctcactctgtcacccaggctggagtgagtgtgatcttggctcacggcaacctttgcctcctgggttcaagcaattctcctgccctagcctcccgagtagcagagactacaggcacccaccgggtgtgggtcccagaacgcccgggcgtggggctgggggtgtggcgcagcgaggccgcgcagcaagcagtcctcccggcaccgtcggaagcgcagttgcagcagccgtcggacaagcggccggagcagccacggacaagcagtccgggccccgccactgcaaggagatcaagaccctgaagacagagcaggatgagatcaccctactgttgagtctcatgaaatcctcgaggaacatgaatcggagtgagaagaactacatggagctgcgactcctgctccaaactaaggaggactatgaggcattgattaaatccctgaaagtgctgttggctgaactggatgagaagattcttcagatggaaaaaaaaatcgcaaaccaaaaacagattttcgcaaaaatgcaggaggccaataacccccggaaactgcagaaacagattcacattttggaaacccgtttgaatctcgtcactgttcactttgacaagatgctgaccactaatgccaagctccggaaggagattgaagacctacgatttgagaaggctgcttatgacaatgtctaccagcagctccagcactgcctgttgatggagaagaaaaccatgaacttggccattgagcaatcttctcaggcctatgagcagagggtggaggccatggctcgaatggctgccatgaaagaccgccagaagaaggacacctctcagtacaacctggagatccgagagctggagcgtctctatgcccatgagagcaagctcaagtccttcctgctcgtcaagctgaatgatcgcaatgaattcgaggagcaggccaaaagggaggaagtgaaggtgcccaagtctccttctctcaaggcaaagaagcatgtcaagaagaacaggggagagagttttgagagctatgaggtggcccacctccggctgctgaagctggctgagagtgggaacctaaaccagctcattgaagattttctggccaaggaggagaagaattttgctcggttcacgtatgtcacggagctcaacaacgacatggagatgatgcacaagaggacccaacgaatccaggacgagatcatcctcttgcgatcccagcagaaattgtcccacgatgacaaccactctgtcctgagacagctggaggccactggatggcagcaaagcacatgctgcccattgaggtgctcagagcggcatctcccggatatctgggtatggggaataacagggttccaggcagggtccaggtccacggagaccctccccaagctgggcagatgcctggggcccacgtccttcactcggggccacccagaatccagactcttgttgaggttgagactggcgcccctctacatcttggcagcccagatcccgcacctcctgtacttcctgctcctccccgccctctgcagtggtggcaccacccacagtgcccccaggcccaggtctctcggcagccatcttggtcctgcttcttgttctccagccatcattgaaaagaagaccaacgacctgctgctgttggagacctacaggcgcatcctggaagtggaaggggcagaggctgagatcccgccacccttcatcaaccctttctggggtggctctgccctcctcaagcccccagaacccatcaaagtcatccccccagtgctgggggctgaccccttcagcgacaggttggatgatgtggaacagcccctggaccacagcagccttcggcagctggttctcgacaattatatcctgaaggagaatcggagtaaggaagtgcgcggagacagcctgcctgagaaggtggatgacttcagatccaggaagaaagtaaccatgtgaggtgcatgcatggggccacctttgcaacataaccgaaagaataaatgttttgttctgtaaaagcctcgtgcctgtcacacacattactaagggctttggagggatcccacaaggccctgttctgatgtttgtgtggagctggaagagagaggagta

SEQ ID NO: 459780 - DNA, 600 bp, Homo sapiens
ctgttcaagaagataaactgtgacgccaccaagatcctggtgcagttaggggagacggggaaagtcactgacatcaaccttccgcagtattttgccatcattgaaaagaagaccaacgacctgctgctgttggagacctacaggcgcatcctggaagtggaaggggcagaggctgagatcccgccacccttcatcaaccctttctggggtggctctgccctcctcaagcccccagaacccatcaaagtcatccccccagtgctgggggctgaccccttcagcgacaggttggatgatgtggaacagcccctggaccacagcagccttcggcagctggttctcgacaattatatcctgaaggagaatcggagtaaggaagtgcgcggagacagcctgcctgagaaggtggatgacttcagatccaggaagaaagtaaccatgtgaggtgcatgcatggggccacctttgcaacataaccgaaagaataaatgttttgttctgtaaaagcctcgtgcctgtcacacacattactaagggctttggagggatcccacaaggccctgttctgatgtttgtgtggagctggaagagagaggagta

SEQ ID NO: 459781 - DNA, 2455 bp, Homo sapiens
tttgaccagcagcaggggtcggtgtgtccctctgaatctgagacctatgaggcaggagctagggacaggatggcaggagcgcccatggctgctgctgtacagcctgctgaggtgactgttgaagttggtgaggacctccacatgcaccacgttcgtgaccgggagatgcctgaagctttggagtttaacctttctgccaatccagagtcaagcacaatattccagaggaactctcaaacagaagctttggagtttaacccttctgccaatccagaggcaagcacaatattccagaggaactctcaaacagatgttgtagaaataagaagaagcaactgtacaaaccatgtatctgctgtgcgtttcagtcaacaatacagcttgtgttcgacaatattccttgatgacagcacagccatccagcattatcttacaatgacaataatatctgtgaccttggagatacctcatcatatcacacaaagagatgcagatagaactttgagcatacctgatgaacagttacactcatttgcggtttccaccgtgcacattatgaagaaaagaaatggaggtgggagtttaaataactattcctcctccattccatcgactcccagcaccagccaggaggaccctcagttcagtgttcctcccactgccaacacacccacgcccgtttgcaagcggtccatgcgctggtccaacctgtttacatctgagaaagggagtgacccagacaaagagaggaaagccccggagaatcatgctgacaccatcgggagcggtagagccatccccattaaacagggcatgctcttaaagcgaagtgggaaatggctgaagacatggaaaaagaaatacgtcaccctgtgttccaatggcatgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatggcctatccaaggacatggacaccgggctgggtgactccatatgcttcagccccagtatctccagcaccaccagccccaagctcaacccgcccccctctcctcatgctaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcccccacctttcccgtgtgcgatctctggagctggatgactggccagttgagctcaggaaggttatgtcatctattgtcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcctgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgtgtgtagtatctgttttatttgactgcagtctccttggtgcaaaaacaaaatgggaaaaataaggataactcagaatttcaaaaggaaatcacaaattcagctaatattagcattttcagtacttttcgtaaactaagtaaatacacaaaatgttgatttttctgaccataagacgtattttatgtccttctgccaaggtggatttgttagtctcaggccctcctggccacattgcccaagtcacacaggcttctgtattatgtatttagataaaatgtgtgaaaacatatttgaaataaacctctgagttttctatgattcctgttgggagaaaagctgagtgttgggagagcagtgggcctgctctgagccctctccctggactgggggagcagtgggcctgctctgagcccctcaccctgagctgcaggggcagtgggcctgctct

SEQ ID NO: 459782 - DNA, 490 bp, Homo sapiens
tttgaccagcagcaggggtcggtgtgtccctctgaatctgagacctatgaggcaggagctagggacaggatggcaggagcgcccatggctgctgctgtacagcctgctgaggtgactgttgaagttggtgaggacctccacatgcaccacgttcgtgaccgggagatgcctgaaggtgaggaggtgataggtgccatctaccctcggtttgcctctggctgctgctgtccccatggttccctttgaggcatcccacacttcgagctcctttctgcttgtagccagctttcccgggggctggccaggaacaaaagctggctctgccttgaattcccaccccttagtctttccccaccgagtccagtcagtttcttttcgcctcccctcccaatcgcccagttcttgctctctcatctcattctcccaggctggcatgggaccatttatttatggctcttgtcgaataagcagcagttgaataaataagttg

SEQ ID NO: 459783 - DNA, 1939 bp, Homo sapiens
ttgggcggtagtatatactaggataaatgttatacacattttcttcctttccacagggtgacctttagatacctacatcatattacacaatgagatgcagatagaactttgagcatacctgatgaacagttacactcatttgcggtttccaccgtgcacattatgaagaaaagaaatggaggtgggagtttaaataactattcctcctccattccatcgactcccagcaccagccaggaggaccctcagttcagtgttcctcccactgccaacacacccacgcccgtttgcaagcggtccatgcgctggtccaacctgtttacatctgagaaagggagtgacccagacaaagagaggaaagccccggagaatcatgctgacaccatcgggagcggtagagccatccccattaaacagggcatgctcttaaagcgaagtgggaaatggctgaagacatggaaaaagaaatacgtcaccctgtgttccaatggcatgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatggcctatccaaggacatggacaccgggctgggtgactccatatgcttcagccccagtatctccagcaccaccagccccaagctcaacccgcccccctctcctcatgctaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcccccacctttcccgtgtgcgatctctggagctggatgactggccagttgagctcaggaaggttatgtcatctattgtcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcctgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgtgtgtagtatctgttttatttgactgcagtctccttggtgcaaaaacaaaatgggaaaaataaggataactcagaatttcaaaaggaaatcacaaattcagctaatattagcattttcagtacttttcgtaaactaagtaaatacacaaaatgttgatttttctgaccataagacgtattttatgtccttctgccaaggtggatttgttagtctcaggccctcctggccacattgcccaagtcacacaggcttctgtattatgtatttagataaaatgtgtgaaaacatatttgaaataaagttcataaatatgcattgaaaaaag

SEQ ID NO: 459784 - DNA, 804 bp, Homo sapiens
tttgaccagcagcaggggtcggtgtgtccctctgaatctgagacctatgaggcaggagctagggacaggatggcaggagcgcccatggctgctgctgtacagcctgctgaggtgactgttgaagttggtgaggacctccacatgcaccacgttcgtgaccgggagatgcctgaagctttggagtttaacctttctgccaatccagagtcaagcacaatattccagaggaactctcaaacagaagctttggagtttaacccttctgccaatccagaggcaagcacaatattccagaggaactctcaaacagatgttgtagaaataagaagaagcaactgtacaaaccatgtatctgctgtgcgtttcagtcaacaatacagcttgtgttcgacaatattccttgatgacagcacagccatccagcattatcttacaatgacaataatatctgtgaccttggagatacctcatcatatcacacaaagagatgcagatagaactttgagcatacctgatgaacagttacactcatttgcggtttccaccgtgcacattatgaagaaaagaaatggaggtgggagtttaaataactattcctcctccattccatcgactcccagcaccagccaggaggaccctcagttcagtgttcctcccactgccaacacacccacgcccgtttgcaagcggtccatgcgctggtccaacctgtttacatctgagaaagggagtgacccagaccaccggggacacagagattattattacaggcaccatcatgactccaagcggaggagatcctga

SEQ ID NO: 459785 - DNA, 270 bp, Homo sapiens
aataaaggagggtgtcattgtgttactcttgctggcctcaacttcctgacctgggttcaagtgattttcccatctcagcctcctgagtagctgggactacaagcatgtgccatcttgcctggctctatcttatgtctatacattcatttcaatggataagaatcaaagtagagatagtgaaatagcctaaatgcagcagtcgaataaacgagttgataaatttttatcaatgattacatctttttttcttttcttcctctgtgcatatag

SEQ ID NO: 459786 - DNA, 2332 bp, Homo sapiens
tttgaccagcagcaggggtcggtgtgtccctctgaatctgagacctatgaggcaggagctagggacaggatggcaggagcgcccatggctgctgctgtacagcctgctgaggtgactgttgaagttggtgaggacctccacatgcaccacgttcgtgaccgggagatgcctgaagctttggagtttaacctttctgccaatccagagtcaagcacaatattccagaggaactctcaaacagaagctttggagtttaacccttctgccaatccagaggcaagcacaatattccagaggaactctcaaacagatgttgtagaaataagaagaagcaactgtacaaaccatgtatctgctgtgcgtttcagtcaacaatacagcttgtgttcgacaatattccttgatgacagcacagccatccagcattatcttacaatgacaataatatctgtgaccttggagatacctcatcatatcacacaaagagatgcagatagaactttgagcatacctgatgaacagttacactcatttgcggtttccaccgtgcacattatgaagaaaagaaatggaggtgggagtttaaataactattcctcctccattccatcgactcccagcaccagccaggaggaccctcagttcagtgttcctcccactgccaacacacccacgcccgtttgcaagcggtccatgcgctggtccaacctgtttacatctgagaaagggagtgacccagacaaagagaggaaagccccggagaatcatgctgacaccatcgggagcggtagagccatccccattaaacagggcatgctcttaaagcgaagtgggaaatggctgaagacatggaaaaagaaatacgtcaccctgtgttccaatggcatgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatggcctatccaaggacatggacaccgggctgggtgactccatatgcttcagccccagtatctccagcaccaccagccccaagctcaacccgcccccctctcctcatgctaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcccccacctttcccgtgtgcgatctctggagctggatgactggccagttgagctcaggaaggttatgtcatctattgtcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcctgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgtgtgtagtatctgttttatttgactgcagtctccttggtgcaaaaacaaaatgggaaaaataaggataactcagaatttcaaaaggaaatcacaaattcagctaatattagcattttcagtacttttcgtaaactaagtaaatacacaaaatgttgatttttctgaccataagacgtattttatgtccttctgccaaggtggatttgttagtctcaggccctcctggccacattgcccaagtcacacaggcttctgtattatgtatttagataaaatgtgtgaaaacatatttgaaataaagttcataaatatgcattgaaaaaag

SEQ ID NO: 459787 - DNA, 1336 bp, Homo sapiens
tgggtctcaccgtcctcgtgataactttcttgcaccaaagacatcagtctccaacatgtttctgtgtggttgtttgattcagcaaaagtccccagtatctccagcaccaccagccccaagctcaacccgcccccctctcctcatgctaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcccccacctttcccgtgtgcgatctctggagctggatgactggccagttgagctcaggaaggttatgtcatctattgtcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcctgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgtgtgtagtatctgttttatttgactgcagtctccttggtgcaaaaacaaaatgggaaaaataaggataactcagaatttcaaaaggaaatcacaaattcagctaatattagcattttcagtacttttcgtaaactaagtaaatacacaaaatgttgatttttctgaccataagacgtattttatgtccttctgccaaggtggatttgttagtctcaggccctcctggccacattgcccaagtcacacaggcttctgtattatgtatttagataaaatgtgtgaaaacatatttgaaataaagttcataaatatgcattgaaaaaag

SEQ ID NO: 459788 - DNA, 683 bp, Homo sapiens
gtaattgtgagctgtctataggaccctgcaagccactacccaatttttgaagccattcctcctcctgttccacacaggtttccaccgtgcacattatgaagaaaagaaatggaggtgggagtttaaataactattcctcctccattccatcgactcccagcaccagccaggaggaccctcagttcagtgttcctcccactgccaacacacccacgcccgtttgcaagcggtccatgcgctggtccaacctgtttacatctgagaaagggagtgacccagacaaagagaggaaagccccggagaatcatgctgacaccatcgggagcggtagagccatccccattaaacagggcatgctcttaaagcgaagtgggaaatggctgaagacatggaaaaagaaatacgtcaccctgtgttccaatggcatgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatggcctatccaaggacatggacaccgggctgggtgactccatatgcttcagccccagtatctccagcaccaccagccccaagctcaacccgcccccctctcctcatgct

SEQ ID NO: 459789 - DNA, 604 bp, Homo sapiens
ggcgctttcgaatttagattcatggccctgtggcgtacaaattagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggtta

SEQ ID NO: 459790 - DNA, 596 bp, Homo sapiens
taagtttaaagaaaaaaaggcaacaaaggccttaagggggggtaacatcaataagcccttacagtgctactccgaagctattaagttggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctttagagttctacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagctcaggtcccagctgtctcacgttgtttattctgcgtccccttctccaataaaacaagccagttgggcgtggtta

SEQ ID NO: 459791 - DNA, 341 bp, Homo sapiens
aactcaggggcgagctgcctgctacaccaaactcctggagttccagctggcactcaaggactgtgaggaatgtatccagctggagccgaccctcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcgcgcctgagctcagctcgccaagagggccgagctcgatctga

SEQ ID NO: 459792 - DNA, 135 bp, Homo sapiens
aattcaagcttctaacgatgtactgggcatgttatggggaggggagggggttcttccagcctcaggtcccagctgtctcacgttgtttattctgcgtccccttctccaataaaacaagccagttgggcgtggtta

SEQ ID NO: 459793 - DNA, 1153 bp, Homo sapiens
gaagcgaccatcccgaacaactccggatggaattgggccgcgtaggaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggtta

SEQ ID NO: 459794 - DNA, 1589 bp, Homo sapiens
ggcgactacaataagtgccgggagcttgtgagaaggccattgaagtggggagagaaaaccgagaagactatcgacagatgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttatatgtggcttgggccctgagtgattttttttttttttttaaaccaggagtttgtccttgcaggggctgctcctggaacctgatcttgctcttctctttggggcgggcttaggaggagtcccaagctgtggcttggcacagctccatggctttgccaagaaggttgccagatggcgctgttgctcagcagctggaagggaatctgaaggcttccccaccccaagtagtaccaatgagaggttcagataagctttgggtgctgttaattctccacgttatagtggagatccagagaacaggatctaatgtgagatgctgagacctctgtggggagagggcagctatgctgttagctgctgtt

SEQ ID NO: 459795 - DNA, 871 bp, Homo sapiens
ggacgcgtgggtcgacccacgcgttcgccacgcgtccgcaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggtta

SEQ ID NO: 459796 - DNA, 585 bp, Homo sapiens
tccttgtaatccaagcagtcggagagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggtta

SEQ ID NO: 459797 - DNA, 1196 bp, Homo sapiens
ggcgactacaataagtgccgggagcttgtgagaaggccattgaagtggggagagaaaaccgagaagactatcgacagatgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttccctagttggttttttttttatttggggcagtgggcatgttatggggaggggagggggttcttccagcctcaggtcccagctgtctcacgttgtttattctgcgtccccttctccaataaaacaagccagttgggcgtggtta

SEQ ID NO: 459798 - DNA, 1945 bp, Homo sapiens
gaagcgaccatcccgaacaactccggatggaattgggccgcgtaggaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgagtacgtagagtcagagaggcggccttgctggaaatggagaacaaaagcaggcagatgagtgcacgcggctggggggtggtatgctcagtctgcgaggaagaggaattctgtcattcttcctaaacttaaggagattggcagtgggtggcgagctggaagggctttgttagtcgtgatagcttaagcagtcatttggaaaggcccatttagctgggagaaaggtcttgactggaagctgtgtcgtgggctcaagagtaggactggcaagttctgcgaagtggagcaggcctctgcagctcggcgccccgggcctcgccaggacccctccctgccggggccttctgtagagggggttgaattggggcttgctctgagagcaagtaagactttaaaggttgtctcatttcaagtaactgcgtcttcctctgtagaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttatatgtggcttgggccctgagtgattttttttttttttttaaaccaggagtttgtccttgcaggggctgctcctggaacctgatcttgctcttctctttggggcgggcttaggaggagtcccaagctgtggcttggcacagctccatggctttgccaagaaggttgccagatggcgctgttgctcagcagctggaagggaatctgaaggcttccccaccccaagtagtaccaatgagaggttcagataagctttgggtgctgttaattctccacgttatagtggagatccagagaacaggatctaatgtgagatgctgagacctctgtggggagagggcagctatgctgttagctgctgtt

SEQ ID NO: 459799 - DNA, 1553 bp, Homo sapiens
tctctctccccttgtcagttacctctgttatcttggacctgctgaagcagtgagctgggtggtcctaacacgcttcacctttgtctcttctggactgcaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgagtacgtagagtcagagaggcggccttgctggaaatggagaacaaaagcaggcagatgagtgcacgcggctggggggtggtatgctcagtctgcgaggaagaggaattctgtcattcttcctaaacttaaggagattggcagtgggtggcgagctggaagggctttgttagtcgtgatagcttaagcagtcatttggaaaggcccatttagctgggagaaaggtcttgactggaagctgtgtcgtgggctcaagagtaggactggcaagttctgcgaagtggagcaggcctctgcagctcggcgccccgggcctcgccaggacccctccctgccggggccttctgtagagggggttgaattggggcttgctctgagagcaagtaagactttaaaggttgtctcatttcaagtaactgcgtcttcctctgtagaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttatatgtggcttgggccctgagtgattttttttttttttttaaaccaggagtttgtccttgcaggggctgctcctggaacctgatcttgctcttctctttggggcgggcttaggaggagtcccaagctgtggcttggcacagctccatggctttgccaagaaggttgccagatggcgctgttgctcagcagctggaagggaatctgaaggcttccccaccccaagtagtaccaatgagaggttcagataagctttgggtgctgttaattctccacgttatagtggagatccagagaacaggatctaatgtgagatgctgagacctctgtggggagagggcagctatgctgttagctgctgtt

SEQ ID NO: 459800 - DNA, 980 bp, Homo sapiens
ggcgactacaataagtgccgggagcttgtgagaaggccattgaagtggggagagaaaaccgagaagactatcgacagatgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttctagttggttttttttttatttggggcagtgggcatgttatggggaggggagggggttcttccagcctcaggtcccagctgtctcacgttgtttattctgcgtccccttctccaataaaacaagccagttgggcgtggtta

SEQ ID NO: 459801 - DNA, 915 bp, Homo sapiens
ggcgactacaataagtgccgggagcttgtgagaaggccattgaagtggggagagaaaaccgagaagactatcgacagatgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcctcaggtcccagctgtctcacgttgtttattctgcgtccccttctccaataaaacaagccagttgggcgtggtta

SEQ ID NO: 459802 - DNA, 1301 bp, Homo sapiens
gaagcgaccatcccgaacaactccggatggaattgggccgcgtaggaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgagtacgtagagtcagagaggcggccttgctggaaatggagaacaaaagcaggcagatgagtgcacgcggctggggggtggtatgctcagtctgcgaggaagaggaattctgtcattcttcctaaacttaaggagattggcagtgggtggcgagctggaagggctttgttagtcgtgatagcttaagcagtcatttggaaaggcccatttagctgggagaaaggtcttgactggaagctgtgtcgtgggctcaagagtaggactggcaagttctgcgaagtggagcaggcctctgcagctcggcgccccgggcctcgccaggacccctccctgccggggccttctgtagagggggttgaattggggcttgctctgagagcaagtaagactttaaaggttgtctcatttcaagtaactgcgtcttcctctgtagaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggtta

SEQ ID NO: 459803 - DNA, 514 bp, Homo sapiens
gggaatgagcctaatttctttctgttgcttcattctaggactgtgaggaatgtatccagctggagccgaccttcagtaagtgcctttctgctgcctgtcccctgtctctagccaaaagattagagaaggaaagggcaagccctttgtctacctgtgtgtccttgggacctgtaggatttaggatccaacatcagcaggtgtgaacagtgttggtgtgcaggtgaagaggtgcaaggagcagccttgggcgctgcggttggataacgcgccacctttcctgtttgtagtcaagggttatacacggaaagccgctgcgctggaagcgatgaaggactacaccaaagccatggatgtgtaccagaaggcgctagacctggactccagctgtaaggtggggctgcttctggcctccaggggccccccctgcctctttctctgttggggcttttccatgttcagtccctgatttcttccctgtcacctccatttctctctgtttctctcttacttgttc

SEQ ID NO: 459804 - DNA, 1778 bp, Homo sapiens
gaccaaggcccacgcattttgtctagttgtcatgtactcttcagtttctcaaactggaattgtcccccgctatgtgtttttcataacatcagcctcttgcagagtccaggcagtttgtcttgtgtgggatgatccatcatctggagttgtctttcctgatgttgtcccctctgtttggtgctgggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgagtacgtagagtcagagaggcggccttgctggaaatggagaacaaaagcaggcagatgagtgcacgcggctggggggtggtatgctcagtctgcgaggaagaggaattctgtcattcttcctaaacttaaggagattggcagtgggtggcgagctggaagggctttgttagtcgtgatagcttaagcagtcatttggaaaggcccatttagctgggagaaaggtcttgactggaagctgtgtcgtgggctcaagagtaggactggcaagttctgcgaagtggagcaggcctctgcagctcggcgccccgggcctcgccaggacccctccctgccggggccttctgtagagggggttgaattggggcttgctctgagagcaagtaagactttaaaggttgtctcatttcaagtaactgcgtcttcctctgtagaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttatatgtggcttgggccctgagtgattttttttttttttttaaaccaggagtttgtccttgcaggggctgctcctggaacctgatcttgctcttctctttggggcgggcttaggaggagtcccaagctgtggcttggcacagctccatggctttgccaagaaggttgccagatggcgctgttgctcagcagctggaagggaatctgaaggcttccccaccccaagtagtaccaatgagaggttcagataagctttgggtgctgttaattctccacgttatagtggagatccagagaacaggatctaatgtgagatgctgagacctctgtggggagagggcagctatgctgttagctgctgtt

SEQ ID NO: 459805 - DNA, 375 bp, Homo sapiens
aatttctttctgttgcttcattctaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgctcgcccctgagttgcagctcgcccctgagttagcagctcgcccctgagttagcagctcgccgtattgaattcaacacaccacaatactatgcagctcgcccctgagtt

SEQ ID NO: 459806 - DNA, 1229 bp, Homo sapiens
ggcgactacaataagtgccgggagcttgtgagaaggccattgaagtggggagagaaaaccgagaagactatcgacagatgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggtta

SEQ ID NO: 459807 - DNA, 1600 bp, Homo sapiens
ggcgactacaataagtgccgggagcttgtgagaaggccattgaagtggggagagaaaaccgagaagactatcgacagatgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttataaaaaaaaaaaaaaaaaaaaaacaaaaaaaaaaaaaaaaaacaacaacaaaaaaaaaaaaaaaaaaacaaaaaaaagagagcggcaacaaaacaccaacacaagagggacgacaaaagagagagaaaaaaaaaaagacaagaggacccaagaagaccacaacacacaagaagagacacaaaaagcacgaagaggaaagacaaaccacaggacaacagagaaaagagaccaaacaaagaggcaggaaccaacggccaagaaaaccacacaaaaaacacacagcgagaaaacaacagaagagcgaacaagcgaacaaccacacacagccgcgaaaaaaccgggacggcagacacaaaagcgcggcggcacaa

SEQ ID NO: 459808 - DNA, 1238 bp, Homo sapiens
  misc_feature (1114)..(1114): n is a, c, g, or t
  misc_feature (1126)..(1127): n is a, c, g, or t
ggcgactacaataagtgccgggagcttgtgagaaggccattgaagtggggagagaaaaccgagaagactatcgacagatgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccacaataaattcggggcagggggcatngtaatgcgggannggacaaaacgcgaccagagcacgcccaacaggtcgccagacctggccaaccacagaacaaaaaaaacaggcacacccaacagcaccacacggacaagcacgcccaacgagg

SEQ ID NO: 459809 - DNA, 1119 bp, Homo sapiens
gaagcgaccatcccgaacaactccggatggaattgggccgcgtaggaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgccctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggtta

SEQ ID NO: 459810 - DNA, 962 bp, Homo sapiens
ggcgactacaataagtgccgggagcttgtgagaaggccattgaagtggggagagaaaaccgagaagactatcgacagatgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagctcaggtcccagctgtctcacgttgtttattctgcgtccccttctccaataaaacaagccagttgggcgtggtta

SEQ ID NO: 459811 - DNA, 1415 bp, Homo sapiens
ggcgactacaataagtgccgggagcttgtgagaaggccattgaagtggggagagaaaaccgagaagactatcgacagatgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttataaaaaaaaaaaaaaaaaaaaaacaaaaaaaaaaaaaaaaaacaacaacaaaaaaaaaaaaaaaaaaacaaaaaaaagagagcggcaacaaaacaccaacacaagagggacgacaaaagagagagaaaaaaaaaaagacaagaggacccaagaagaccacaacacacaagaagagacacaaaaagcacgaagaggaaagacaaaccacaggacaacagagaaaagagaccaaacaaagaggcaggaaccaacggccaagaaaaccacacaaaaaacacacagcgagaaaacaacagaagagcgaacaagcgaacaaccacacacagccgcgaaaaaaccgggacggcagacacaaaagcgcggcggcacaa

SEQ ID NO: 459812 - DNA, 836 bp, Homo sapiens
ttttctttttctttttctttttttaaataatttgaacaaaaatagttcactgtgggatttgaatgacctacagttctagtatactagggttggacatttctctctttatattttattactctgtacttttgaggttcatgggtgcagtggtcagaaggaaattttactctgccctaaaatctgcctacgtagtagatgccgatgatacagcatctaatatgttgagcacatctgtcagaaaagcatacagtgtggaaggaagtgaggtcatgcggattggtggtgaagtgcgtctcccttccagaaatctgaaaaacagaacagctccctcctcggactcaaacacagccttcgattcaaatatttttctacacataaaccagatgggagaagacttctcctgcaagtaaagctggatcattgttcctccctggaaacatggaaattattttctgagaaggcatagttgtataggctgaaagttcatcctaattattctactttatttaagtacagatttccctttttaaaaagtctttcctatgtttgctgagtgaagttatttttcaaattctggagttcctgagctttcagggtatttttgtagtatatcatctgcacacatccaacgtggattactgagttatttctcatgatatgttttggaaactgtttaaacaccaactgtgtattggcttttcatgtgcacacggttgcagtgtatctctctaacttaagtagtttctgaaactcattaatgataatctggtgtcgggaaaatgatttgtaccgacatttcgttaagggtggctgtatggatggcaagtgtgagagcg

SEQ ID NO: 459813 - DNA, 654 bp, Homo sapiens
catagaccctgaggttctactcagggcctgaggttctcaagaatgaacattcctggacattcattctgtgtcctggtttctaccttcacttggagtaaattatgggggaaagaacatcatgaagacctgctattgtcagagtgtcatttcctctttctatctttctgtggattaattttaaatccatttgatagaattaatcatataagccagtctcatttccctgcaaatgtctgccttcgtgcaggtgattctgtagaaaggagtttctccaataaagcagagcttctctttcaactccatggacatcagagagagtccctttcaaaaaaggaggctcaggtctggagagacaaaggcctctactttcgaaaaggcctcttggatcaagcccagaccctcatcagagctgacaacatgtccagcctgcactactgcaagaacttctttgtctatggtagtgtggtcaactgaagaagccggcttagttgctccagtcaggtgctcacactaagaaaggatgggtgaaggttataaagtggctgtgaatgagaactcggtctgggctctaccaagcagagaagccatgcagagatgagaaaggtgaaagccatgaaaccatgttaagcagaaaaataaaaattcaaaacagaa

SEQ ID NO: 459814 - DNA, 2772 bp, Homo sapiens
cgcggtgtggctccaggtttgtttttctccggtacagcctggtagggagggctcccggcatctccctgcttcggggcagaggatgccgggggtagagtacgggagggctggagcgagggtggactggaggtgccgcttgtcctggaggtgggagagagggagcggctttgccgcctggcctgcgtcctaatcctgtcctggttcttctgctcccgaagggaacgtaggtcccgcgcctgtgataagtaaggttggattttctcttccctgaggtgaaggatgcccggaggcctcggcaggaccgcgcggaaacgggccttctgcccaaaagatgctgcttctctccttattctttcccctcagaatctcgctgtctccttccaaccacctgtggtcggcatccccgcgttgtcactgcgacgcagaggtcgcagcttcatggcctgatgccttcaggaagtattttgaagtcatcgtggctgtggattgggggatttcttgtttccactgacctgtgaggccgcgcacgtggagggaggcaccccgggtcctccggcactgtccggcctcgcctgtgtccctagtagcagtgggcatttccagacggtgcagcttgtggctaaagtgacaggaagatgtaggagctttcagtcttggatgaggattcgaactgaagggcttaggcccagctgtcttggagcaaaacatctgttgtgggatgtggcggcagaggagggcaaggccgaaggagcagacagcaccgcttcttggggagttgtgaaggcatcatgcggagggccgagcttagcagccaagtggaggacagcaccctccatgcctggattcgttactcgctcgttctcgatgttgagctgctggcatattgcagcacaactagagatgtacggatgcccccatcttgatcttacagaatcagaggtgcagccgcaagaaaggtctctacaccctctcggttttctctgctctgccaacactagtggaatatgatcacatcccagggatcagtgtcatttagggatgtgactatgggcttcactcaagaggagtggcatcatctggaccctgctcagaggaccctgtagaggaatgtgatgctggagaactacagccaccttgtctcagtagggtattgcattcctaaaccagaagtgatcctcaaattggagacaggcaaggagccatggatattagaggaaaaatttcgaagccagagtcatctgggtgagttagtgccagatggaatttaaagaattaattaataccagtagaaactattcaagaatgaagttcaatgagtttaacaaaggtggaaaatgtttctgtgatgaaagcatgaaataattcattttgaagaggaaccttctgaatataataacaatgggaacagcttctggctgaatgaagacctcatttggcatcagaagattaaaaattgggagcaaccttttgaatacaatgaatgtgggaaagctttccctgagaattcactcttccttgtacataagagagcttacacaggacagaaaacatgcaaatatactgaacatgggaaaacctgttatatgtcattttttattactcatcagcaaacacatccaagagagaaccactatgaatgtaatgaatgtggagaaagtatctttgaggaatccattctctttgaacatcagaatgtttacccattcagccagaatttaaatcccactctaattcagagaacccactcaattagcaatattattgaatataatgaatgtggaacctttttcagtgaaaaattagcccttcatttacaacagagaacacatccaggggaaaaaccttatgaatgtcatgaatgtggaaaaaccttcacccagaagtcagcccacacaagacatcagagaacacacacagggaaaaccctatgaatgtcacggatgtgggaagaccttctataagaattcagacctcattagaaatcaaagaattcacacaggggagagaccttacagatgtcatgaatggagaaatccttcagtgaaaagtcatcccttactcaaaatcagagaacacacgtggggagaaatcatgaatgtcatgaatgtgggaaaacctcgtttaagtcagttctaactgtgcatcagaaaacacacaggggagaagccctatgaatgctatgcatgtggcaacacctttctcagaaaatccgacctcattaaacatcagagaattcacacaggagaaaaaccttatgaatgtaatgaatgtgggaagtcattctccgagaagtcaacccttactaaacatctaagaacacacagatgggaaatcttatgcatgtattcaatgtggaaaatttttctgctgctactacagtttcacagaacatctgagaagacacacaggggagaaaccttttggatgtaatgaatgtgggaaaaccttccatcagaagttggccctaattgttcaccagagaactcatataagacagaaaccctatggatgtaatgaatgtggaaaatcattctgtgtgaagtcaaaactcattgcacatcatagaacatacacaggggagaaaccctatgaatgtaatgtttgtggaaaattattattaagtcaaaactaactgtacatcacagaacacacttgaggtgaaaccctataaatgtagtaagtgagggaaattactctgggtgaagtcagaactttgtagagcagagaacataaagggtgagagaaatctgttaatataatgataatgagaac

SEQ ID NO: 459815 - DNA, 2634 bp, Homo sapiens
cgcggtgtggctccaggtttgtttttctccggtacagcctggtagggagggctcccggcatctccctgcttcggggcagaggatgccgggggtagagtacgggagggctggagcgagggtggactggaggtgccgcttgtcctggaggtgggagagagggagcggctttgccgcctggcctgcgtcctaatcctgtcctggttcttctgctcccgaagggaacgtaggtcccgcgcctgtgataagtaaggttggattttctcttccctgaggtgaaggatgcccggaggcctcggcaggaccgcgcggaaacgggccttctgcccaaaagatgctgcttctctccttattctttcccctcagaatctcgctgtctccttccaaccacctgtggtcggcatccccgcgttgtcactgcgacgcagaggcgagcgaggtggcgggaagcacccgcggggcggggagggaccctgcgggcgcggactccacaccaagcctctgctcagcgtcaccccgcttgctgtgtcctcgcaggtcgcagcttcatggcctgatgccttcaggaagtattttgaagtcatcgtggctgtggattgggggatttcttgtttccactgacctgtgaggccgcgcacgtggagggaggcaccccgggtcctccggcactgtccggcctcgcctgtgtccctagtagcagtgggcatttccagacggtgcagcttgtggctaaagtgacaggaagatgtaggagctttcagtcttggatgaggattcgaactgaagggcttaggcccagctgtcttggagcaaaacatctgttgtgggatgtggcggcagaggagggcaaggccgaaggagcagacagcaccgcttcttggggagttgtgaaggcatcatgcggagggccgagcttagcagccaagtggaggacagcaccctccatgcctggattcgttactcgctcgttctcgatgttgagctgctggcatattgcagcacaactagagatgtacggatgcccccatcttgatcttacagaatcagaggtgcagccgcaagaaaggtctctacaccctctcggttttctctgctctgccaacactagtggaatatgatcacatcccagggatcagtgtcatttagggatgtgactatgggcttcactcaagaggagtggcatcatctggaccctgctcagaggaccctgtagaggaatgtgatgctggagaactacagccaccttgtctcagtagggtattgcattcctaaaccagaagtgatcctcaaattggagacaggcaaggagccatggatattagaggaaaaatttcgaagccagagtcatctgggtgagttagtgccagatggaatttaaagaattaattaataccagtagaaactattcaagaatgaagttcaatgagtttaacaaaggtggaaaatgtttctgtgatgaaagcatgaaataattcattttgaagaggaaccttctgaatataataacaatgggaacagcttctggctgaatgaagacctcatttggcatcagaagattaaaaattgggagcaaccttttgaatacaatgaatgtgggaaagctttccctgagaattcactcttccttgtacataagagagcttacacaggacagaaaacatgcaaatatactgaacatgggaaaacctgttatatgtcattttttattactcatcagcaaacacatccaagagagaaccactatgaatgtaatgaatgtggagaaagtatctttgaggaatccattctctttgaacatcagaatgtttacccattcagccagaatttaaatcccactctaattcagagaacccactcaattagcaatattattgaatataatgaatgtggaacctttttcagtgaaaaattagcccttcatttacaacagagaacacatccaggggaaaaaccttatgaatgtcatgaatgtggaaaaaccttcacccagaagtcagcccacacaagacatcagagaacacacacagggaaaaccctatgaatgtcacggatgtgggaagaccttctataagaattcagacctcattagaaatcaaagaattcacacaggggagagaccttacagatgtcatgaatggagaaatccttcagtgaaaagtcatcccttactcaaaatcagagaacacacgtggggagaaatcatgaatgtcatgaatgtgggaaaacctcgtttaagtcagttctaactgtgcatcagaaaacacacaggggagaagccctatgaatgctatgcatgtggcaacacctttctcagaaaatccgacctcattaaacatcagagaattcacacaggagaaaaaccttatgaatgtaatgaatgtgggaagtcattctccgagaagtcaacccttactaaacatctaagaacacacagatgggaaatcttatgcatgtattcaatgtggaaaatttttctgctgctactacagtttcacagaacatctgagaagacacacaggggagaaaccttttggatgtaatgaatgtgggaaaaccttccatcagaagttggccctaattgttcaccagagaactcatataagacagaaaccctatggatgtaatgaatgtggaaaa

SEQ ID NO: 459816 - DNA, 1144 bp, Homo sapiens
cgcggtgtggctccaggtttgtttttctccggtacagcctggtagggagggctcccggcatctccctgcttcggggcagaggatgccgggggtagagtacgggagggctggagcgagggtggactggaggtgccgcttgtcctggaggtgggagagagggagcggctttgccgcctggcctgcgtcctaatcctgtcctggttcttctgctcccgaagggaacgtaggtcccgcgcctgtgataagtaaggttggattttctcttccctgaggtgaaggatgcccggaggcctcggcaggaccgcgcggaaacgggccttctgcccaaaagatgctgcttctctccttattctttcccctcagaatctcgctgtctccttccaaccacctgtggtcggcatccccgcgttgtcactgcgacgcagaggcgagcgaggtggcgggaagcacccgcggggcggggagggaccctgcgggcgcggactccacaccaagcctctgctcagcgtcaccccgcttgctgtgtcctcgcaggtcgcagcttcatggcctgatgccttcaggaagtattttgaagtcatcgtggctgtggattgggggatttcttgtttccactgacctgtgaggccgcgcacgtggagggaggcaccccgggtcctccggcactgtccggcctcgcctgtgtccctagtagcagtgggcatttccagacggtgcagcttgtggctaaagtgacaggaagatgtaggagctttcagtcttggatgaggattcgaactgaagggcttaggcccagctgtcttggagcaaaacatctgttgtgggatgtggcggcagaggagggcaaggccgaaggagcagacagcaccgcttcttggggagttgtgaaggcatcatgcggagggccgagcttagcagccaagtggaggacagcaccctccatgcctggattcgttactcgctcgttctcgatgttgagctgctggcatattgcagcacaactagagatgtacggatgcccccatcttgatcttacagaatcagaggtgcagccgcaagaaaggtctcccgcctggcccatcgttaccgttgccagccagttgttcaatgtgtatttcccagctagagacatgacagtgcactc

SEQ ID NO: 459817 - DNA, 1512 bp, Homo sapiens
cgcggtgtggctccaggtttgtttttctccggtacagcctggtagggagggctcccggcatctccctgcttcggggcagaggatgccgggggtagagtacgggagggctggagcgagggtggactggaggtgccgcttgtcctggaggtgggagagagggagcggctttgccgcctggcctgcgtcctaatcctgtcctggttcttctgctcccgaagggaacgtaggtcccgcgcctgtgataagtaaggttggattttctcttccctgaggtgaaggatgcccggaggcctcggcaggaccgcgcggaaacgggccttctgcccaaaagatgctgcttctctccttattctttcccctcagaatctcgctgtctccttccaaccacctgtggtcggcatccccgcgttgtcactgcgacgcagaggcgagcgaggtggcgggaagcacccgcggggcggggagggaccctgcgggcgcggactccacaccaagcctctgctcagcgtcaccccgcttgctgtgtcctcgcaggtcgcagcttcatggcctgatgccttcaggaagtattttgaagtcatcgtggctgtggattgggggatttcttgtttccactgacctgtgaggccgcgcacgtggagggaggcaccccgggtcctccggcactgtccggcctcgcctgtgtccctagtagcagtgggcatttccagacggtgcagcttgtggctaaagtgacaggaagatgtaggagctttcagtcttggatgaggattcgaactgaagggcttaggcccagctgtcttggagcaaaacatctgttgtgggatgtggcggcagaggagggcaaggccgaaggagcagacagcaccgcttcttggggagttgtgaaggcatcatgcggagggccgagcttagcagccaagtggaggacagcaccctccatgcctggattcgttactcgctcgttctcgatgttgagctgctggcatattgcagcacaactagagatgtacggatgcccccatcttgatcttacagaatcagaggtgcagccgcaagaaaggtctacttcagtgtctataaagttttatcgggactcagccatactcatgtatttatgtatagcctgtgagtactttcacactacgagggcagagttgactggttgcagtagagactgtgatggcccacaagcctaaaatttcttttgtttaaatgctattggcgctcttgtaatggtttgccaggccatttacatctctgtgtaaagctttacttcctgcttacactgagcctgaaggtcaaccagactgaaagcttaggttcctctcaggttttttcttactggctttggatctactatgagtttcttggagacagcttatggttagatctttttcttttgttccccttattttctgtttataatttttatggatacatagtgagtatatatatttatgtgatttatatacatgagatattttgatataggcctacaatgtgtaaaat

SEQ ID NO: 459818 - DNA, 1688 bp, Homo sapiens
cgcggtgtggctccaggtttgtttttctccggtacagcctggtagggagggctcccggcatctccctgcttcggggcagaggatgccgggggtagagtacgggagggctggagcgagggtggactggaggtgccgcttgtcctggaggtgggagagagggagcggctttgccgcctggcctgcgtcctaatcctgtcctggttcttctgctcccgaagggaacgtaggtcccgcgcctgtgataagtaaggttggattttctcttccctgaggtgaaggatgcccggaggcctcggcaggaccgcgcggaaacgggccttctgcccaaaagatgctgcttctctccttattctttcccctcagaatctcgctgtctccttccaaccacctgtggtcggcatccccgcgttgtcactgcgacgcagaggcgagcgaggtggcgggaagcacccgcggggcggggagggaccctgcgggcgcggactccacaccaagcctctgctcagcgtcaccccgcttgctgtgtcctcgcaggtcgcagcttcatggcctgatgccttcaggaagtattttgaagtcatcgtggctgtggattgggggatttcttgtttccactgacctgtgaggccgcgcacgtggagggaggcaccccgggtcctccggcactgtccggcctcgcctgtgtccctagtagcagtgggcatttccagacggtgcagcttgtggctaaagtgacaggaagatgtaggagctttcagtcttggatgaggattcgaactgaagggcttaggcccagctgtcttggagcaaaacatctgttgtgggatgtggcggcagaggagggcaaggccgaaggagcagacagcaccgcttcttggggagttgtgaaggcatcatgcggagggccgagcttagcagccaagtggaggacagcaccctccatgcctggattcgttactcgctcgttctcgatgttgagctgctggcatattgcagcacaactagagatgtacggatgcccccatcttgatcttacagaatcagaggtgcagccgcaagaaaggtctctacaccctctcggttttctctgctctgccaacactagtggaatatgatcacatcccagggatcagtgtcatttagggatgtgactatgggcttcactcaagaggagtggcatcatctggaccctgctcagaggaccctgtagaggaatgtgatgctggagaactacagccaccttgtctcagtagggtattgcattcctaaaccagaagtgatcctcaaattggagacaggcaaggagccatggatattagaggaaaaatttcgaagccagagtcatctgggtgagttagtgccagatggaatttaaagaattaattaataccagtagaaactattcaagaatgaagttcaatgagtttaacaaaggtggaaaatgtttctgtgatgaaagcatgaaataattcattttgaagaggaaccttctgaatataataacaatgggaacagcttctggctgaatgaagacctcatttggcatcagaagattaaaaattgggagcaaccttttgaatacaatgaactcaaaagatttacaagagataaaacaaacccgcttggagttggcgctgtagtgttgaaaagctaaactccaaaggcttattggggctctattgctcttg

SEQ ID NO: 459819 - DNA, 1015 bp, Homo sapiens
tggacttttgagaatcaaagtgaactgccagggacaaacaagagtggcgaggaaatggaagcagtcataccactcaggctggaaaatcgctctaggaatggcaagaagaaagtcagctgccatgtcacgaagtgccctgtgagaaggacctgtaaggagggacggagggaggcctctaaatgacagccttcgaggaactgaatcctgctggtgaccatgtgagggagcttggactccggtccccctgtgttgagccttcagatgagttggcagccccagctggtggcatgactgtaacgtcctgaaacaccttcagccagaaagcattcagctaaaccacacctgtatttctgacccaaagaaattgtgagataataaacatttcttctcttgaactgctataccttaagctaattcgttacacagcaatagataacaaatactacctctggacccctgcctgccaccataccaaattccatgctctgagttctagagtcagtggtgtttccacctgtcatgcccagcccttcactgctagtattataatgagggcttgcccatatctctgcccccagatggcagactctaacagcatgagggtcactgcccccatgattcaatcacctccttctgggtccttcccacgacatgtagggattatgggaaccacagttcaagatgagatttgggtggggacacagccaaactatataactgacttaaatatttacttgcatcaggctctgatgtctagtttcaccatcaagtatgcctatcaggaggacattaatttattcattcaacaattattaaaggcctactatgtctcaggcactttgcaagttaacaaagaaaatggaaaaggtacagccagacaggtggcagaaaatccaagagagtatagtgtcacaggtaccaaaaagagtgttataaggagccactggccacatgtgtgaattgctaacctccatagctaggattacaggcatgtgccaccacatctcagcctctc

SEQ ID NO: 459820 - DNA, 1177 bp, Homo sapiens
gaaaaaacaagcaacatctcatccctcactggttttactgttgggggtcttgaaatttcttttattaatacttgaattcactgtagaaaatggagaaaccacggaccagctaaaagaagcaaataagtgtctcggtgggttatttcagatgagcacggtgctattttgaccagagggaacagcttttctgatggtggtggtggtttttctttcttttacttttttccttatttttttttttaaactctcctgttaaaaagaggattctatcttcgaacttgacattctgtcatggtaacctttcttccggcagatgggatttcaaacgtgagcaccttggctagtgctaaatatatggtcctggatgatggtagacaaggctgcccagaaactgtggttttctgtgctgcttctgaaagggctgaatttccggtggcttcctggctatctaattcaaaggccgggcctggcagagctggctgtgcccaactttgctgtacgagttattgtaaaggtgaaggatgctgacacctttgagcccacacccccaaaagtgggcctgtggctgtcccccgaaacccctccggagcacaccccagcctctgccagtcttcagttcagcccaatgaaacagcagttccaggatatgcatttgccattaaaaacaaagaaagaaagaaagaaatcaatccttcggcctctttggcctgagctggtcgtctgcccagagacgctggggggcccaacgccgccggtgtggactgtgggtgttgcggatccggagaccacaggggtcacaggggccgccagtccagggcagatttccctgagtggggccatcactcctaggccttgctgctacagatgcctcccccggagcttgcccgactgccccagcggtcccatcggcgcacgtttcctgtcccctgcccaggatggcacccctagaaggttggggctggcccagcctccctacaggcaacagcacttttgaaatctctggatagttttgaactctctgttcttaattaaatatgcaatttttcacggtaaccaggttaattcttttgtgttgtgttgtaatactgttaggaattttcatagttcttattaaacattattcaggcattgtgaattccataattaaaaaaaatgaaaagaacaaagcttgattcac

SEQ ID NO: 459821 - DNA, 1460 bp, Homo sapiens
aatgccttcctgccatgtggtgacagattaaaagctgctatacactttggaactggaaactgagctcccaatataaaggagataagccatcatgcttacaatatgttgtgcagagctcactggtgggcagtttttcttaacaatgcatcaggacttttgctatttgtaaaggaagcttaaaggaagctgagagtgctgagggcacatctgaaaccactggaggttggcgacgtggaggtcaggtagtagtgctctcccaccaggagtccctctgcacccctggagagagcagtcattatgcaggacaacccatctgctcagaactttcagtggcgacttgtggtgtgactctgttcccattcatctatgtgctgctgtaggcttagcttcccacagcctccccagctttgccatttgtcattatcatttactcttaatatttattctatctatgaccctgatgcacagagtgatagctgatagtctcttaaaacaacgtttacaattattttgacagtttaccgtgttttgttctctcaacaatacttagaatttgtctgagttatagttgcatagacggcaattttcctgacctagttttctgactatgatttatgggtcagtaaactccttaaatgatggaatataacatctcaggccacagggaacacttactatcacatgctcactgttgcaggacggatgcgtggccagcctcaggttgctaaatgttagggtgatctgccttccttctggggcggtgattctccacttgtagatccggccatgaggatttaggtgaacacagtcgatgaagcacgactgccacaaaaatgaacatttcctccacaggaagaatcaccatttggaatctggaaaggctgttcaaaatggacagcaatggtcaggccactttggaccaggacgtgccaggaacagttgaggttggatgggtaggtctctggatacctggggaacatgatgatcccttgtctgcatgcaaatatccaccagagcctccccacaaagaaacaaaggaatcactagttctaaaaacatcctttggtgcttctgcaaaaacagttgggtgtagtgcagcccccaagtccccagaagtttggtggagatggtgggtggaggtcacctccagatttcatgcccgtgctgtggatggaaagcgccatgtgttcagagcagcttctggcttcctggcagccagcagcaacatcagcatcccctgagaagttgctggaaattcagattctcaggctttaccccaaatctactaaatcagaaactccaggacactcctccatctgtgttttagcaaggcctctggtgattctgatgtctccgtggtttgagacccactgccatagagcagggctgtctaatagaacgttctgtggtgatgaaacgtgatcctgccctgaagatgttgtcagccttattttatagtc

SEQ ID NO: 459822 - DNA, 1230 bp, Homo sapiens
gtcgcagcagtatggtgatgacagagttgtggttggtacaggccagaatgtggtcattaccattgcaggagacagagtgtagagctgtgtggcccttgtcagctgcacagggatccgtgccattttccagcagctaccgcactttttccacatcgttggcactggtagcattggcattgtctccctcattctcttcagagctgcacctctttgcccgagccaccactctgcgtcatactgccaccagtcgtgtagtagtgcaatggggacttggcccaggaggcctcctggcccgggaggcccatgcagctgcccccgtgcagacccgaagtcagcgaaggagaagaggccccagctcctgtttgttgattgtgatgaaatgcatgctgaggcacatgccttgggagctaagtggcagctatacttcactactatggcagtaaagatgactataaagactggcgggggatggatcctttcaaatgtacctgagctgggatgcccagcttgtggaacgcacagcaggaggtgagcagtggccaaaggaacatctgaaggaacacctgatgaggctgcacccttggcggaaagaacacctgacatggctgaaagcttggtggaaaaaccacctgatgaggctgcacccttggtggagggaacagctgacaaaattcaatgtttggggaaagcaacatctggaaagtttgaacagtcagcagaagaaacacctaagaaaattatgaggactgcaaaagaaacatctgagaaatttgcatggccagcaaaagaaagacctaggaagatcacatgggaggaaaaagaaacatctgtaaagactgaatgcgtggcaggagtaatacctaataaaactgaagttttggaaaaaggaacatctgagatgctcacgtgtcctacaaaagaaacatctacaaaagcaagtacaaatgataagatgcccacatcagagtcaggacaaaaagaagatacgaaatcaccttcagtttctgaggtcacagctatggatgtggaagagataggaaaggcctcaccacttaagatagaagcagcagctgcatagtggtaacagcaatgagtggatgtcaaaagacagattcaactagcctatcaatattcttgggtgcagttccttctcatgaaagagcaagggaacttaaaaaatatcactgtgaacaacttacagcaaaaataaaacaaatgaaaaataagttt

SEQ ID NO: 459823 - DNA, 995 bp, Homo sapiens
gtcgcagcagtatggtgatgacagagttgtggttggtacaggccagaatgtggtcattaccattgcaggagacagagtgtagagctgtgtggcccttgtcagctgcacagggatccgtgccattttccagcagctaccgcactttttccacatcgttggcactggtagcattggcattgtctccctcattctcttcagagctgcacctctttgcccgagccaccactctgcgtcatactgccaccagtcgtgtagtagtgcaatggggacttggcccaggaggcctcctggcccgggaggcccatgcagctgcccccgtgcagacccgaagtcagcgaaggagaagaggccccagctcctgtttgttgattgtgatgaaatgcatgctgaggcacatgccttgggagctaagtggcagctatacttcactactatggcagtaaagatgactataaagactggcgggggatggatcctttcaaatgtacctgagctgggatgcccagcttgtggaacgcacagcaggaggtgagcagtggccaaaggaacatctgaaggaacacctgatgaggctgcacccttggcggaaagaacacctgacatggctgaaagcttggtggaaaaaccacctgatgaggctgcacccttggtggagggaacagctgacaaaattcaatgtttggggaaagcaacatctggaaagtttgaacagtcagcagaagaaacacctaagaaaattatgaggactgcaaaagaaacatctgagaaatttgcatggccagcaaaagaaagacctaggaagatcacatgggaggaaaaagaaacatctgtaaagactgaatgcgtggcaggagtaatacctaataaaactgaagttttggaaaaaggaacatctgagatgctcacgtgtcctacaaaagaaacatctacaaaagcaagtacaaatgaaggaagcaacaaagacagcaactgaacaacaagaaaatgatattgga

SEQ ID NO: 459824 - DNA, 3292 bp, Homo sapiens
gacacaggaagcactaaagagcagcgcttgacgccatggcccgcccccactccacagtcattggaagagctcaaagttaaaggctcccgctaaaaatcagtatgtttcattttgcagttactgggagggggcttgctgtggccccatctgggagagttgagccctggtccagccccgcgcaggaagggaggctgtaaccgtgccagcctgctgcagctgcagtgatgttttcctgtatgagacaaacaaagtcgcccggatccaaagcatcaattatggcaccattaagttcttccacgtgatcgtcttttcctatgttagcaaggaacatttgaaaaggaaattggaaaaataattccatttaccatagcatttaagagagctgaggctgtggagccagatggctgcgttcagagctggcgctgctgtttaccatgtgaccttggacaagcttctcgcttcattcataccacagtttgttcggctattaggtggaggagctgtaagggggagaggaactttgctgaaaggcacatcctccctgcagagcttgaagaacaatctaaccatgctggcatggggcccatcctacctgcaatgccaaggtaagtctgcgaaagtcacttatattcagagcatgtggattgggactctgaagaacaactttatggtggacaccttcgtctccatctggaactgactcagcacaagaagacagcttcgactccctatgatttcatctctgaccaatcagcactcctggcacactggcttcccccaacccaccaagttatccttaaaaactccattccctgattgctaggggagacagatttgagtaataataaaactccggtctcccccacagctggctctgcacgaattactcttcttctattgcaattcccctgtcttgatgaatcggctctgtctaggcagcaggcaaggtgaaccctttgagcagttacaattctatttaatacctctgtctctgccaggcacggtgactcacgcctgtaatcccaacactttgggaggctgagagagggaaaacgagtcacacggaagcaagtcatgcagccgagctaggattggaacggaagtggcctgcagagcctgcctcccaccccactgtgctatgcctcccattgatgctttcctgtgcctgccatttagctttgctctggtgagtggcaagctgtaccagtggaaagagcctgtcatcagttctgtgcacagcaaggtgaaaaggacagcagaagtgaaagaggagatcgtggagaaagaaatgaagaagttggtgcacagtgtctttaacatggcagattacaccttccctttgcaggcagaagcggaacttagaccaggacgcacagttaccatggcaatgacgcgcgccctaagggcggtggcagcgacgcagagagacctgggaggagacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggagtccctgtcgcccaggctggagtgcaatggtgcgatctcggctcgctgcaacctccgcgtctggggttcaagcgattctcctgcctcagccccctgagtagctgggattacagtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctggacagttggtaaatgctaaatgaattagaagaaaacatgtactagacattattttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctggttgcaaagtggtgtcagctgtggggatcttgggccctcgttcctcacctgcatcctgccctgcactcaggtgctccccctgaagtcagggtcacatcaggtagacctgttactatatgcacctttggcctggaatgctctgaagttggactggaaatgttactaggttggcctgttacaaaaaggaccccatcctgcttaaacacattgatctcccttgccctgcatttgagtctttctagcccacggtctgaaacttgaggcagctttccagatttggaatgtaaaaggctcagtgggcactctgttcatccctgggtggggagggcccagccaacagaagtgcatgtccactgtgcgggccagtgtgtgtttacacaaatttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcctatatattgttttactccaccagttatttcccaagtgtttgaaatgcagttcatcttccttgatgtcatttgtggtcagcaggagactgcgaccaagctggcagttatggcagtttccctttcctgtcattatttagagcagactttcaatcccttgacatgccacgtttatgtagtgtgacaagcttgtttatagagcagagtgccttaggaacttagttcctagcagtgtctaacgtgcagaagttgctcaattaaagtttctggcc

SEQ ID NO: 459825 - DNA, 878 bp, Homo sapiens
  misc_feature (870)..(870): n is a, c, g, or t
  misc_feature (874)..(874): n is a, c, g, or t
gacacaggaagcactaaagagcagcgcttgacgccatggcccgcccccactccacagtcattggaagagctcaaagttaaaggctcccgctaaaaatcagtatgtttcattttgcagttactgggagggggcttgctgtggccccatctgggagagttgagccctggtccagccccgcgcaggaagggaggctgtaaccgtgccagcctgctgcagctgcagtgatgttttcctgtatgagacaaacaaagtcgcccggatccaaagcatcaattatggcaccattaagttcttccacgtgatcgtcttttcctatgttagcaaggaacatttgaaaaggaaattggaaaaataattccatttaccatagcatttaagagagctgaggctgtggagccagatggctgcgttcagagctggcgctgctgtttaccatgtgaccttggacaagcttctcgcttcattcataccacagtttgttcggctattaggtggaggagctgtaagggggagaggaactttgctgaaaggcacatcctccctgcagagcttgaagaacaatctaaccatgctggcatggggcccatcctacctgcaatgccaaggtaagtctgcgaaagtcacttatattcagagcatgtggattgggactctgaagaacaactttatggtggacaccttcgtctccatctggtgagtccagcacaagcagcctgagggttccatgggctcaacctcaccctccatccttatttccctgccactccagggctcctcctcatccagacttgcctgtgagtgccccttgatggatgtatttgtctgttctcatgctgctaataaagacatattcgagactaggtaatttanaaanaaaa

SEQ ID NO: 459826 - DNA, 919 bp, Homo sapiens
gacacaggaagcactaaagagcagcgcttgacgccatggcccgcccccactccacagtcattggaagagctcaaagttaaaggctcccgctaaaaatcagtatgtttcattttgcagttactgggagggggcttgctgtggccccatctgggagagttgagccctggtccagccccgcgcaggaagggaggctgtaaccgtgccagcctgctgcagctgcagtgatgttttcctgtatgagacaaacaaagtcgcccggatccaaagcatcaattatggcaccattaagttcttccacgtgatcgtcttttcctatgttagcaaggaacatttgaaaaggaaattggaaaaataattccatttaccatagcatttaagagagctgaggctgtggagccagatggctgcgttcagagctggcgctgctgtttaccatgtgaccttggacaagcttctcgcttcattcataccacagtttgttcggctattaggtggaggtaatactagcaccttccttatagagttggtttttgttttcatttttttggtgggggggagtaagaattgcaaaagttaatatatgtcagcaaaatagacttagaagagtggttggcacatggtaaggacatattagggttaccaaaaattgtttataattgggaaaattgaacaaaagttacagttaaatatctatcccagagactgactggcaaattatcacaatgtacctcttagcttgagccatatggaactgcctgtattctatagctatggcctacaaaatgggcagttctttctttcttttcttttttttggagagagagtctcactctgttgcccaggctgaagtgcagctgcagtgagcagagatagtgccactgcactccagcctgggtgacagagggagactctgtctcaa

SEQ ID NO: 459827 - DNA, 2744 bp, Homo sapiens
tttaggagtcatgcagctggaggctacaagattctgaccctccctaaactgctcctaagatcagtgcttgagatattttgcagaccctgcacttgatggatcagctcagtaaactgactcatctgatcttgtggccccttctcaggaactgactcagcacaagaagacagcttcgactccctatgatttcatctctgaccaatcagcactcctggcacactggcttcccccaacccaccaagttatccttaaaaactccattccctgattgctaggggagacagatttgagtaataataaaactccggtctcccccacagctggctctgcacgaattactcttcttctattgcaattcccctgtcttgatgaatcggctctgtctaggcagcaggcaaggtgaaccctttgagcagttacaattctatttaatacctctgtctctgccaggcacggtgactcacgcctgtaatcccaacactttgggaggctgagagagggaaaacgagtcacacggaagcaagtcatgcagccgagctaggattggaacggaagtggcctgcagagcctgcctcccaccccactgtgctatgcctcccattgatgctttcctgtgcctgccatttagctttgctctggtgagtggcaagctgtaccagtggaaagagcctgtcatcagttctgtgcacagcaaggtgaaaaggacagcagaagtgaaagaggagatcgtggagaaagaaatgaagaagttggtgcacagtgtctttaacatggcagattacaccttccctttgcaggcagaagcggaacttagaccaggacgcacagttaccatggcaatgacgcgcgccctaagggcggtggcagcgacgcagagagacctgggaggagacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggagtccctgtcgcccaggctggagtgcaatggtgcgatctcggctcgctgcaacctccgcgtctggggttcaagcgattctcctgcctcagccccctgagtagctgggattacagtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctggacagttggtaaatgctaaatgaattagaagaaaacatgtactagacattattttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctggttgcaaagtggtgtcagctgtggggatcttgggccctcgttcctcacctgcatcctgccctgcactcaggtgctccccctgaagtcagggtcacatcaggtagacctgttactatatgcacctttggcctggaatgctctgaagttggactggaaatgttactaggttggcctgttacaaaaaggaccccatcctgcttaaacacattgatctcccttgccctgcatttgagtctttctagcccacggtctgaaacttgaggcagctttccagatttggaatgtaaaaggctcagtgggcactctgttcatccctgggtggggagggcccagccaacagaagtgcatgtccactgtgcgggccagtgtgtgtttacacaaatttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcctatatattgttttactccaccagttatttcccaagtgtttgaaatgcagttcatcttccttgatgtcatttgtggtcagcaggagactgcgaccaagctggcagttatggcagtttccctttcctgtcattatttagagcagactttcaatcccttgacatgccacgtttatgtagtgtgacaagcttgtttatagagcagagtgccttaggaacttagttcctagcagtgtctaacgtgcagaagttgctcaattaaagtttctggcc

SEQ ID NO: 459828 - DNA, 401 bp, Homo sapiens
actaagttagtggtaatttgttacagaaactaatataattgggatttaacttgccttgggggtgctggctctcccccattttcttctcagagcatctcttgggtcctcaacccttgctgagcccccaccatggcctagaggaccagggatggacttgattagattctcctcttgggattttaaaaaagagaagcagaggctgcatgctcagcttctccgtgccgcactgcaggcacagtgcccggcgccactgttctttaggggtccatgaagatgtctgttggccctgggttagtcatgaggtaagggatatgagggcagttcactttggaggctcagccctttggtgttacttttgctctggaaccttaggagctgtaagggggagaggaactttgctg

SEQ ID NO: 459829 - DNA, 3204 bp, Homo sapiens
gacacaggaagcactaaagagcagcgcttgacgccatggcccgcccccactccacagtcattggaagagctcaaagttaaaggctcccgctaaaaatcagtatgtttcattttgcagttactgggagggggcttgctgtggccccatctgggagagttgagccctggtccagccccgcgcaggaagggaggctgtaaccgtgccagcctgctgcagctgcagtgatgttttcctgtatgagacaaacaaagtcgcccggatccaaagcatcaattatggcaccattaagttcttccacgtgatcgtcttttcctatgttagcaaggaacatttgaaaaggaaattggaaaaataattccatttaccatagcatttaagagagctgaggctgtggagccagatggctgcgttcagagctggcgctgctgtttaccatgtgaccttggacaagcttctcgcttcattcataccacagtttgttcggctattaggtggaggagctgtaagggggagaggaactttgctgaaaggcacatcctccctgcagagcttgaagaacaatctaaccatgctggcatggggcccatcctacctgcaatgccaaggaactgactcagcacaagaagacagcttcgactccctatgatttcatctctgaccaatcagcactcctggcacactggcttcccccaacccaccaagttatccttaaaaactccattccctgattgctaggggagacagatttgagtaataataaaactccggtctcccccacagctggctctgcacgaattactcttcttctattgcaattcccctgtcttgatgaatcggctctgtctaggcagcaggcaaggtgaaccctttgagcagttacaattctatttaatacctctgtctctgccaggcacggtgactcacgcctgtaatcccaacactttgggaggctgagagagggaaaacgagtcacacggaagcaagtcatgcagccgagctaggattggaacggaagtggcctgcagagcctgcctcccaccccactgtgctatgcctcccattgatgctttcctgtgcctgccatttagctttgctctggtgagtggcaagctgtaccagtggaaagagcctgtcatcagttctgtgcacagcaaggtgaaaaggacagcagaagtgaaagaggagatcgtggagaaagaaatgaagaagttggtgcacagtgtctttaacatggcagattacaccttccctttgcaggcagaagcggaacttagaccaggacgcacagttaccatggcaatgacgcgcgccctaagggcggtggcagcgacgcagagagacctgggaggagacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggagtccctgtcgcccaggctggagtgcaatggtgcgatctcggctcgctgcaacctccgcgtctggggttcaagcgattctcctgcctcagccccctgagtagctgggattacagtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctggacagttggtaaatgctaaatgaattagaagaaaacatgtactagacattattttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctggttgcaaagtggtgtcagctgtggggatcttgggccctcgttcctcacctgcatcctgccctgcactcaggtgctccccctgaagtcagggtcacatcaggtagacctgttactatatgcacctttggcctggaatgctctgaagttggactggaaatgttactaggttggcctgttacaaaaaggaccccatcctgcttaaacacattgatctcccttgccctgcatttgagtctttctagcccacggtctgaaacttgaggcagctttccagatttggaatgtaaaaggctcagtgggcactctgttcatccctgggtggggagggcccagccaacagaagtgcatgtccactgtgcgggccagtgtgtgtttacacaaatttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcctatatattgttttactccaccagttatttcccaagtgtttgaaatgcagttcatcttccttgatgtcatttgtggtcagcaggagactgcgaccaagctggcagttatggcagtttccctttcctgtcattatttagagcagactttcaatcccttgacatgccacgtttatgtagtgtgacaagcttgtttatagagcagagtgccttaggaacttagttcctagcagtgtctaacgtgcagaagttgctcaattaaagtttctggcc

SEQ ID NO: 459830 - DNA, 812 bp, Homo sapiens
acggttgctccagtagcttgttagaagtcggcttgagggggaaccagcagccctgttattaaagggggctgggtgaatatgaaggggagactcacagaggtaaggatgtggggtttcactaaaggagctccccatttggccagaggaaggagtcacaggcgaggacgtgaaaaactagaaaacctcacgggagccatgaaaaagactaactgtgattctggagacatttctgctttcatctttgatgtaaatggcgacactgggcgattccagcattttcatggtgagctgctgtggaaaggcacttacgaagagagcacggattgtgtctgcacttgtgatttcattcggcatcctgagctgcttggtttcatctccatactggagatagagaacccctgcacacaaaggaaacagttattagtcacaggtcaagactcaggggacacacagcacaagctgagccacttctttcctgctgcacttaggaacgttcaggacaagcttggcaagcatgtaacaagagatctaggtttggaatttccaaggaatgcactgtttggttattgtaactcagcttctgaggagtccaacccagccacacgggaggtcacatgctgaagaaccaccccatctaagcgcccattttacagctggaaccactgaggttatgtggatgagccgtcttgggagtggtctccccagccccaggtgagctaccccagctgatgccagcagaaatgagatggcccctccaagcactgtccaaattgcagaatgataagcaaataaatgactgtcatgtgaagtca

SEQ ID NO: 459831 - DNA, 915 bp, Homo sapiens
taagtcaaactttaaagctccaaaatgatgtcatttgactccaggtctcacatccaggtcatgctgatgcaagaggtgggttcccatggtcttggacagctccgaccctgtggcttggaggttccaaacttttccatattttcctatcttcttctgagcccttcaaactgttccaatctctgcctgttacccaattccaaagttgcctccacattttcagaaaaaaatttgcggatagtcacaagatatgcattccaagcagtcggaagatcacaagcaaacagaaagaggaatgagggcaaggcacctgtgaggaattgtcaatatttcataatgactttattgcagagaaaatgtgctgagaaatgcgaaatccaaggtgaagagtccatcaaaatgagtgtttcagcgctggcaaaattcacagtggcagcttactcaacctctgaagaatatctaacttcattataatccaatttccatactaaattacatgtcacctggcaccatgatagtagactatcaccatgacaatgactgagagagactaaaaaaaggacagaaaagaggccatcaaataaagcccatgctgctcagtgcccacttagtgtttcccgtatttgctttgtgacaccaaacaggaaagagctcacctattcagtgtccctgtttctacatctgtaaaagaaaaaatgtggaaaacatctgtcaagaaagctccaggatctgaagtctaaggaatcactaagaaatgtactgatgaaagaaaggaagtaaattattctctgattgtcacaactgttagcattccaaatatatcaaataatttctaccactgattctatctcaaaattatttctaacccaaattaataagagatgtgtctgggaatatgaataaattaattacttgtgc

SEQ ID NO: 459832 - DNA, 1524 bp, Homo sapiens
gcctcctcagatccgttctctgcgctgccagctcaggtgagccctcgccaaggtgacctcgcaggacactggtgaaggagcagtgaggaacctgcagagtcacacagttggccaccaccatctctagatgggaagacagaaagtagttactttcccaagatctccccacaagcaagtgtatccttggggtttgtacacctactttcaccatggggctctgcctgcccccgcccctgcctcctctcgctgaccaattgagctgtgagcctggagcagatccgtgggctgcagacccccgccccagtgcctctccccctgcagccctgcccctcgaactgtgacatggagagagtgaccctggcccttctcctactggcaggcctgactgccttggaagccaatgacccatttgccaataaagacgatcccttctactatgactggaaaaacctgcagctgagcggactgatctgcggagggctcctggccattgctgggatcgcggcagttctgagtggcaaatgcaaatgcaagagcagccagaagcagcacagtcctgtacctgagaaggccatcccactcatcactccaggctctgccactacttgctgagcacaggactggcctccagggatggcctgaagcctaacactggcccccagcacctcctcccctgggaggccttatcctcaaggaaggacttctctccaagggcaggctgttaggcccctttctgatcaggaggcttctttatgaattaaactcgccccaccaccccctcctcggtagtcttgtgatccatcgtctttgggtctgggggtgggtaatcccttggattgctgactttccctggatgcccactcccagcaagcttcccagtccctgagtccctgccgcccaactgtctcctatggctcccactccagcaagccccacagagagacccatgcactgtgagataccacagtgttataacagaagacctttccatttccaccacttgcacgggggccctagaagtcctgatgcctcagggccccagaggtgtaaaaatgaggtccacatgtcttccagggcctttgaaacaggacacgtagggactgagagcaaggttccaaggggaagccacacaaaggtgaccggaagcagtgcatgctttctgactgaggaacccagggccacgcagtcacgactatcaggagctctgctgtttgaaatcctagcaaaccctgtccttgcatggtggccccatgaccctgacaagagatgcagcctcaacttccaaccccagtgccccactggggagcagaggtttctggacgtgacagccacccacctccaccttcacatgtatcctggggccacatttctcaccttggccaaatcaaataaacctttatctccaagcacctttgtcttggtgtttggcatcagctacacatcagccctttccacccatgcatcctaaatctagcatagacttccagggttgtgaaggtactctttgaatctccaccactctac

SEQ ID NO: 459833 - DNA, 1140 bp, Homo sapiens
gccctccccaaggtgacatcgcaggacactggtgaaggagcagtgaggaacctgcagagtcacacagttggcctgactgccttggaagccaatgacccatttgccaataaagacgatcccttctactatggtggcaaatgcaaatgcaagagcagccagaagcagcacagtcctgtacctgagaaggccatcccactcatcactccaggctctgccactacttgctgagcacaggactggcctccagggatggcctgaagcctaacactggcccccagcacctcctcccctgggaggccttatcctcaaggaaggacttctctccaagggcaggctgttaggcccctttctgatcaggaggcttctttatgaattaaactcgccccaccaccccctcctcggtagtcttgtgatccatcgtctttgggtctgggggtgggtaatcccttggattgctgactttccctggatgcccactcccagcaagcttcccagtccctgagtccctgccgcccaactgtctcctatggctcccactccagcaagccccacagagagacccatgcactgtgagataccacagtgttataacagaagacctttccatttccaccacttgcacgggggccctagaagtcctgatgcctcagggccccagaggtgtaaaaatgaggtccacatgtcttccagggcctttgaaacaggacacgtagggactgagagcaaggttccaaggggaagccacacaaaggtgaccggaagcagtgcatgctttctgactgaggaacccagggccacgcagtcacgactatcaggagctctgctgtttgaaatcctagcaaaccctgtccttgcatggtggccccatgaccctgacaagagatgcagcctcaacttccaaccccagtgccccactggggagcagaggtttctggacgtgacagccacccacctccaccttcacatgtatcctggggccacatttctcaccttggccaaatcaaataaacctttatctccaagcacctttgtcttggtgtttggcatcagctacacatcagccctttccacccatgcatcctaaatctagcatagacttccagggttgtgaaggtactctttgaatctccaccactctac

SEQ ID NO: 459834 - DNA, 1255 bp, Homo sapiens
gcctcctcagatccgttctctgcgctgccagctcaggtgagccctcgccaaggtgacctcgcaggacactggtgaaggagcagtgaggaacctgcagagtcacacagttggcctgactgccttggaagccaatgacccatttgccaataaagacgatcccttctactatgactggaaaaacctgcagctgagcggactgatctgcggagggctcctggccattgctgggatcgcggcagttctgagtggcaaatgcaaatgcaagagcagccagaagcagcacagtcctgtacctgagaaggccatcccactcatcactccaggctctgccactacttgctgagcacaggactggcctccagggatggcctgaagcctaacactggcccccagcacctcctcccctgggaggccttatcctcaaggaaggacttctctccaagggcaggctgttaggcccctttctgatcaggaggcttctttatgaattaaactcgccccaccaccccctcctcggtagtcttgtgatccatcgtctttgggtctgggggtgggtaatcccttggattgctgactttccctggatgcccactcccagcaagcttcccagtccctgagtccctgccgcccaactgtctcctatggctcccactccagcaagccccacagagagacccatgcactgtgagataccacagtgttataacagaagacctttccatttccaccacttgcacgggggccctagaagtcctgatgcctcagggccccagaggtgtaaaaatgaggtccacatgtcttccagggcctttgaaacaggacacgtagggactgagagcaaggttccaaggggaagccacacaaaggtgaccggaagcagtgcatgctttctgactgaggaacccagggccacgcagtcacgactatcaggagctctgctgtttgaaatcctagcaaaccctgtccttgcatggtggccccatgaccctgacaagagatgcagcctcaacttccaaccccagtgccccactggggagcagaggtttctggacgtgacagccacccacctccaccttcacatgtatcctggggccacatttctcaccttggccaaatcaaataaacctttatctccaagcacctttgtcttggtgtttggcatcagctacacatcagccctttccacccatgcatcctaaatctagcatagacttccagggttgtgaaggtactctttgaatctccaccactctac

SEQ ID NO: 459835 - DNA, 1311 bp, Homo sapiens
cagggaagccctgaagagaggcgcccaagaaccagaggcagaatgatgcgaggagtaaaaggaggagaagagcttggtgtcacagaagccaagcgacaaaaatgtaaagaaagacaaccggttccaccggaaacacgcatacggctgcaatttgaaggtcaattcgatattgaactcagtgtggggggaagagtaacagggcaaagtggtgttgttgaaagcattggccatctaacgcttccatatagagacaacttattctgtgagtggcatctccaggggctctccagacactatctcaccaactctttcgaagattttaaccttcagaattcctctggctgtgaaaaagactttgtggagatctgggactatcatacttctggaaacatcttgggaagatactgtgcaaacaccattcctgacagcatagacacttctagcaatactgccgtgggctctgctggaacatctacttctcccaactacccgaacctaaatcctcatggccggatctacgagtggagaatcaccgccccagaaggaaggcagatcaccctaacgtttagcaacctgaggctggccacgcatctgtcctgcaacagtgagcatgtgatagggagggttcccatagaaggaagtaggtctgggctgggaatatcacctcctaggaaatatgcagtaagatggattgtgtgtctaaaggttaaactctttttccaacagatggatctaggccgtatggaggattcactgcttctcatacctccagtgaagatgcagataaagtgggatgttgtaaatgtacttcattttaatcaggaagaagctgctatggtgaatttaaaacttgtaatgccattagatgagcttctagcacagtttcagtcatgttaccatgaggattggtgtgacctgttccatattccgtggtccattatttggtgctgaaagagaccatctacctcctagaagtgtgtggtgggtctcttccaaatactcctgaaggaaactttacttctcctggctatgatggagtcaggaattactcgagaaacctaaactgtgaatggactctcagcaatccaaatcagggaaattcatctatttatattcattttgaagatttttacctagaaagtcaccaagactgtcaatttgatgtccttgagtttcgagtgggtttgttaagagcctggtaagaagtgcaagattgacaaaggtaaggttagtagcggaggtaagtgaaagcttgaatataggaaaccttggaccacttgccattgcagtggataaaattttcaagatttc

SEQ ID NO: 459836 - DNA, 994 bp, Homo sapiens
gtcaggggcgtgttggccccgcacagattgagccgagttgtcgccccgctgggagaagtgaccctcctgcgcctgatcagaacactgaggctcagagaagttaactactccaaagtcatatagccagtattttctggagctgtaattcaaatcagatgtgttcaataccttctactaccccattgctgtctttatgaaaagaaatttcatttcaatataggtgactatgcagcctgcaattcaagtatggtttggagaagatctgcctctaagtcctcggagtcctctgactcccagacacggaccaggattggctaatgtttgtcagtacgatgagtggatagctgtgaggcatgaagccactttgttgcccatgcaagaagatctgtcaatctggttatctggtttattaggtattaaagttaaggcagaaaaattattggaagaacttgataatggagtactattatgtcaactgattgatgttcttcaaaacatggtgaaaacatgcaactctgaagaatcagggaattttccaatgagaaaagtgccctgtaagaaagatgctgcatcaggttcattctttgctcgggacaataccgcaaacttccttcactggtgtagggacattggggttgatgaaacttacctctttgaatctgaaggtttagttttgcacaaagatccaagacaggtgtatctttgtcttcttgaaattggtcgaattgtgtcaagatacggggttgagccaccagtgttagtaaaacttgagaaagaaattgagttagaagagactttgcttaatacttctgggcctgaagattccatcagcattccaaaatcatgctgtcggcatgaagagctacatgaagctgtaagtagttgccacactttcttttgaccatgataccttgaagtctcatagttttaagcacttctagtgtgctacaggtgatgctatttttaaaagcaagtgtttcttattcagaatata

SEQ ID NO: 459837 - DNA, 1285 bp, Homo sapiens
gtcaggggcgtgttggccccgcacagattgagccgagttgtcgccccgctgggagaagtgaccctcctgcgcctgatcagaacactgaggctcagagaagttaactactccaaagtcatatagccagtattttctggagctgtaattcaaatcagatgtgttcaataccttctactaccccattgctgtctttatgaaaagaaatttcatttcaatataggtgactatgcagcctgcaattcaagtatggtttggagaagatctgcctctaagtcctcggagtcctctgactcccagacacggaccaggattggctaatgtttgtcagtacgatgagtggatagctgtgaggcatgaagccactttgttgcccatgcaagaagatctgtcaatctggttatctggtttattaggtattaaagttaaggcagaaaaattattggaagaacttgataatggagtactattatgtcaactgattgatgttcttcaaaacatggtgaaaacatgcaactctgaagaatcagggaattttccaatgagaaaagtgccctgtaagaaagatgctgcatcaggttcattctttgctcgggacaataccgcaaacttccttcactggtgtagggacattggggttgatgaaacttacctctttgaatctgaaggtttaggtaagtgatgttcttgtcattcttgtttttaatgcttactaggatgttttaatatccttcacctctaatttttctttccaaataaggactcaaatgcctcatctcattttcctagaaaaatgtatactttgaatatatgtagaattattggagaatcagatactaaatcaaatatattaaccttttcacttaaagattttatgtgtctagaatgtcctaaaattctgaattcctaaatgagttggctacaggaaggttctggactaatgctttagtaattgatattttcattaagaattactccaccaagcctaaaaagtagtaacttccctttaaccggataattacggaaatgacaggaggcctaataatgtattatcacggtgtttagctttaccttacaaacaacagctgccaacttgattatctaatggattaatatttttgacaattcattttgaggagtcatgctctgttgaagaattattgacgtattttctcatttccttgaagtcaacagaagcatctgtgcagtgactaaagcggtagctatttaagttttatactatatttgaaagcatttatatatgtgtacatacacacacacacccacc

SEQ ID NO: 459838 - DNA, 1933 bp, Homo sapiens
gtcaggggcgtgttggccccgcacagattgagccgagttgtcgccccgctgggagaagtgaccctcctgcgcctggtcaagtgtcttggcaaatcttcctttcttcacgtaagatgtgtattggcggcagccgtgggaggtccagacacaggtggccatggaactcgctggtaatagaggacacatctcttaactgggttgctctaagaactgatgcctaaaccatctcagcatggcgtataaaggagaaggtgggcatggccagcctccctcagctacactgtctcaggttagccctggaagtctttacacacgtagaacccatacccataatatatgtatggcatctgactttttctacccaaatatgggaggtgtggaaagccacatttaccagctccctcagtgcctgattggaagaggggataaggttataattgtcatccatgcttatggaaatcgaaaaggcatccgttacctcactaatgacctcaaagtctattacttgcctctgaaagtcatgtataaccagtctatggccatgaccctctttcacagtctgccattgctcaagtacatatttgttcaggagagagtcacaataatccattcacatagttcattttctgccatggcccatgatgttctcttccatgccaagacaatggggcttcaaacagtcttaacagaccatcccctttctggatttgctaaggtccattcagtgcttacaaacaaacttctaactgtgtctctttgtgacacaagccgtatcatttgcgtttcttatactagtaaggaaaataccgtactacgagcggcactgattactgaaatagtgtctgtcattcctaacgctgtagatcctattgacttcactccagacccatttagaaggcatgatagtataactattgttgtcagcagacttgtttacagaaagggaacaaatttggttagtggtattatacccaaactcttgtcagaaatattaagatttaaatttcataattggaggagagggaccaaagagaatcattttgcaagaagttccggaaagataccagttgcatgacagggtgcatcttttgggagctttagaacacaagaatgttagaaatgtcttagttcaaggacatatttttcttaatacctcccttactgaagcattctgcatggcgatcatggaagcagccagctgtggtttacaggttgtaagtaccagggttggtggaattcctgaggtgcttccggaaaatcttactattttatgagaaacttcagtaaaatctttgtgtgagggattggaaaaagctattttccaactgaagtcaggggcattgctggctccagaaaatatccgtaacatagtaaagactttccacacctgaaggaatgttgtggagagaactgaaaaagcgtatgaccaagtatcagtggaatctgtgttgccaatggacaaacaactggacagacttatttctcacagtggaccagtaacaggctacatctttgctttgttggctgttttcaacttcctcttcctcattttcttgagatggatgactccagattcttatcattgatactggaatagatgccactgggccaaggggtgcctggactcataaatgttctcacagtaaaagagggggtgagaatattaagatatctaaaaccaggtagaagagagcctacattgtaagattttaaacatttgtaatagttgtattaagactatggaaaataacctgctttttgggggcttgtgttttttattagttttttataagttaatttatgtttccctagttctttttcctacatattcatccacttttcccccttttctctgttaaacgcatcactgtttcactccaccctttctctctcttcctcggatttcctttaaaactgtgaattagatcatgtc

SEQ ID NO: 459839 - DNA, 1726 bp, Homo sapiens
gtcaggggcgtgttggccccgcacagattgagccgagttgtcgccccgctgggagaagtgaccctcctgcgcctggtcaagtgtcttggcaaatcttcctttcttcacgtaagatgtgtattggcggcagccgtgggaggtccagacacaggtggccatggaactcgctggtaatagaggacacatctcttaactgggttgctctaagaactgatgcctaaaccatctcagcatggcgtataaaggagaaggtgggcatggccagcctccctcagctacactgtctcaggttagccctggaagtctttacacacgtagaacccatacccataatatatgtatggcatctgactttttctacccaaatatgggaggtgtggaaagccacatttaccagctccctcagtgcctgattggaagaggggataaggttataattgtcatccatgcttatggaaatcgaaaaggcatccgttacctcactaatgacctcaaagtctattacttgcctctgaaagtcatgtataaccagtctatggccatgaccctctttcacagtctgccattgctcaagtacatatttgttcaggagagagtcacaataatccattcacatagttcattttctgccatggcccatgatgttctcttccatgccaagacaatggggcttcaaacagtcttaacagaccatcccctttctggatttgctaaggtccattcagtgcttacaaacaaacttctaactgtgtctctttgtgacacaagccgtatcatttgcgtttcttatactagtaaggaaaataccgtactacgagcggcactgattactgaaatagtgtctgtcattcctaacgctgtagatcctattgacttcactccagacccatttagaaggcatgatagtataactattgttgtcagcagacttgtttacagaaagggaacaaatttggttagtggtattatacccaaactcttgtcagaaatattaagatttaaatttcataattggaggagagggaccaaagagaatcattttgcaagaagttccggaaagataccagttgcatgacagggtgcatcttttgggagctttagaacacaagaatgttagaaatgtcttagttcaaggacatatttttcttaatacctcccttactgaagcattctgcatggcgatcatggaagcagccagctgtggtttacaggtttatgaccaagtatcagtggaatctgtgttgccaatggacaaacaactggacagacttatttctcacagtggaccagtaacaggctacatctttgctttgttggctgttttcaacttcctcttcctcattttcttgagatggatgactccagattcttatcattgatactggaatagatgccactgggccaaggggtgcctggactcataaatgttctcacagtaaaagagggggtgagaatattaagatatctaaaaccaggtagaagagagcctacattgtaagattttaaacatttgtaatagttgtattaagactatggaaaataacctgctttttgggggcttgtgttttttattagttttttataagttaatttatgtttccctagttctttttcctacatattcatccacttttcccccttttctctgttaaacgcatcactgtttcactccaccctttctctctcttcctcggatttcctttaaaactgtgaattagatcatgtc

SEQ ID NO: 459840 - DNA, 883 bp, Homo sapiens
gacttaggggcatggcaaaagttaaacatagagctgacgttgggcccatcgtagagtgtgagatagttctggacacagtctcctggatcgtcaatgctgatgaagtaaaagttgacagtgagaagccttccagcaggagctaccagtgcccactcgcagaagtttcagatccattctacggagtaatgaaggacagcgaggaggaagagttcttactgtccatggctggaaagcaaggctttgcttcccagcatctatcaggcaaatggcaaatgttgactctgatcaataatggtccattcaagctggacaatgatattcatgttccatctcacatgctcaatgcaggtgatgtggcagaaagagcacagagggagctcaccaggggctctggaagaccccaaaggttcaggcccacaaggggcatggctctgcctgctccaggtgcaaggggggcttctctctcagtgtgtcctggggtgggagttgggggtgaatgggtggagaatgggcaaacagcaaagtcacttctgtgtccaaatgagagctctggagttgtggtggaaaaaggacagaccacacttcctgcaacaagggagcactttttcaaggcaacacttgtctttagaggatgttgacgatgccccaaacttactgtagctgtcagggaaattagatttgaaaatgacaattgcagtactcatagaagaataaaacaccggcatagccaaagcatttctgccacagaactgaattcttgaatttccatgactctgaaatgaaatggaagccaagtcatgttagatttattttagaagagaacagcataacagaaattaaactgcctataaaagtatggcttaaatatttaaccatggaaact

SEQ ID NO: 459841 - DNA, 6842 bp, Homo sapiens
  misc_feature (1)..(4): n is a, c, g, or t
  misc_feature (9)..(9): n is a, c, g, or t
  misc_feature (14)..(15): n is a, c, g, or t
nnnnttgtnttttnnaagaatcctgctttgggcaggaatggggaaatgtggcctctgtgtgaacatggtgatggatccaaagggcggcagctggggctgtcagtcacagtcttcccctcggcaagttcttcagaaggagccttttgagattgatggaagctctgtgcagctggcatattctcaagatgcctacctgaaaggcaacgaagcttatagcggcaatgcccgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcagtttaaaaaaattccaccagatctaaaaacattgcagtcaaacagaaattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatcaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgcaggaggaaagcacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcagtaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaattttgcatggcttgaaacttattctgatatatttttagatgtcatccatttataactaccttacatgattaattggtcctgactttaaaaaggtgcctactatatttatacattccatcttctcctctttcttgctgtggtgggtagagactctttcttacagatgcttacattagcctaacctcacttgttgactgatagtgtttaactcttctaggtaaagtaatgtatgttatgttaatgttcttttcgtgagtgaaacgaacatgagtttggagtcagtccagctctacctagctatcataccttcagttttagcaggtttgattctttgatatttctactgactcgtgcctatggtgatctgctttctcatatggtaaagcatgtgttcacagtttatacaaatcagggtagcaaacttattttatcattatctttgagccagaaaaataaatgtttgtcatggtgtacatagttcagtatacccaaatgatacttcatcttttttttaatcttt

SEQ ID NO: 459842 - DNA, 6896 bp, Homo sapiens
ggcatgctgaacacacacccacatacaaatatttacaataatacacccgagacttacaatgttgcatcttctctgtaatcatccagaccctcatcatatgatttgatctttctgtctttgagatgggctgagcatccaggctaggagggccaacagattcgtggtcatgtgagagctgacggcgaattaatggagctgaagttgtgaggcaaggaggaactgttgctatggaggggacctgagaggtagaggctgatataacagcagaggcagggatatgtgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcagtttaaaaaaattccaccagatctaaaaacattgcagtcaaacagaaattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatcaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgcaggaggaaagcacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcagtaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaattttgcatggcttgaaacttattctgatatatttttagatgtcatccatttataactaccttacatgattaattggtcctgactttaaaaaggtgcctactatatttatacattccatcttctcctctttcttgctgtggtgggtagagactctttcttacagatgcttacattagcctaacctcacttgttgactgatagtgtttaactcttctaggtaaagtaatgtatgttatgttaatgttcttttcgtgagtgaaacgaacatgagtttggagtcagtccagctctacctagctatcataccttcagttttagcaggtttgattctttgatatttctactgactcgtgcctatggtgatctgctttctcatatggtaaagcatgtgttcacagtttatacaaatcagggtagcaaacttattttatcattatctttgagccagaaaaataaatgtttgtcatggtgtacatagttcagtatacccaaatgatacttcatcttttttttaatcttt

SEQ ID NO: 459843 - DNA, 1035 bp, Homo sapiens
gattatttttaatttcggtccaatgcatattttttcttttttttttttcagcctttctagtgtgtacttagaagtatctgctttaaatttcattttcttaatgactactgctgctaactatcttttcttgtcatttatcatccatatacattatgaattacctgctcaaatatttctgctcatttacactcaagacaaaacaaaaaaatgcacatttaaaacaacatacaactataagttcatctacagtgaacatgtgataacttcagttctctacagacagaatcctaggaaacttcaattctcagggataaacacagaaggcaaaatcttggaagagataaatagaaggactaaccagaaagttgtgaaggaaaccaagagagagttgcattgaaaacccaagggagtagaaaatatcaacagaagctgagtgccaagaagtacaataaattaaaggcaaaagtaaataaataaatacataaatacataaatataattgggtttcataatcgggaagtcattagaaagagttctacttagttgtataattttggttttggcatgtttgtctttacttagttcatgctaataaataccagactaaaaatatctttttaagctcagactaaaaaaaatcaacttttttagtttgaatggcaagaggttatggcagaataaagagacttaagagagaatggagggaaaattgataaagcaaaaggaatcaagctgaaaattcacaaagatagaagaagaatgaagttcaaaatacaaatgcctgggttggctttggacaaaagaagcactacttcatttgaagttgggcagcaacaggaatagaatattccagacaggagctgttcctttaacctggatcacagaatggaatttcaagtgaagcagacctttagtcaacccatagacctacagcggagccacagacaaatctcaggcttcatacatgagaaataaattgatgtttatttgtgtaaaccattttaatttagtaggctgtttcttacctcagaaaaa

SEQ ID NO: 459844 - DNA, 2942 bp, Homo sapiens
taaggaggaatggcaagttgtttaatgggtacagagtttcagatttgcaagatgaaaatgttctagagatctgtttcacaacaatgtgaatctacttaagactgaactgtacactttaaaaaggttaattggcgtcctttgcggtcttttgtccacgtccgggtcaacgcctgacgcgccccttcccggctggacgacgcagctcagggcggggcgaggcgaggttgtgtcgcggaacctgacgggaaacggcccctctaggtccgtggcgcggcgcgcttgtggcagcgacgggcactgccgcgcatgcgcggcccatttccgagagtggcagggctgggcgcggtggggtcgcctctggggtcaaagagcacgccgagcccgccggagggcggggccgcggccttggccctttggcgcgtaggagacagcgcgccaggctggcagccggccttagcggcgtttgctgctcttgctatctggcccacgtcctgtgtcattttcattcacaggatattgcattaccaaaccagaggtggtttgcaagttggagcatggacaggtgctgtggatattagaggaagagtccccaagtcagagccacctagagagtgtgctcatgggagaccctgtgaatataatgaacatgtgagagccttttccgatagaccaatattcattgttcatcagagaactcacataaggaagagtcaccatgaattcaatgaatgtgagaggaggtctgtacattttgctgtaagccaaagcattctgtatatcagaaaacagatacagaagaaaaactctatgaatgtagtgaatgtgggaaaaccttcagccataaatcctcttttatcctacagcagaggatacacagaggagagaaaccctatgaatgcactgaatgtgggaaaacttttggatataggtcatgccttgcagtacatcaaagaacacacacgggacaaaacctatgaatgtaatgaatgtggaaaaaacttctgtgagaagtcaaatcttcatgtacatcagagaacacacacaggagagaaaccctatggatgtaatgaatgtcagaaagcctttggtgataggtcagctctaaaagtacatcagagaatacatactggcgagaaaccctatgagtgtaaggaatgtgggaaaactttctcccagaagccaaacttcattaatcatcaagaacatcagagaattcacacaggggagaaaccctatgaatgtaatgaatgtgagaaaatgttctaccacaagtcatccctcacagtacatcagagaacccacacaggagagaaaccctatgcatgtagtgaatgtgggaaaaccttctaccagaagtcatccctcacaacacatcagagaacacacacaagggagcaaccctatgaatataatgaaagcttttaccagaatcccaacttcactaaatgtcagagagacaacatagaggaaacccttgtcaacatcctgaaggctcagaaaccttcaccttcttggactcgttccatagcagaaacaacccaggttgggcattacctttactcttcacatttttccaagatcagtagaaaatgaacagatcccaggtacctgtgtgggttccctcagacctggccccagtacttttgcctttccttgggagccatctgattcactgctggtttcagcagccaccaacatgccagtgactccgcagtcctcagcttcattacgggcttcccttctgagctccagaaccactcatccagctccctcctgaagatccctgcctgcccgttccacagacacttcgagcacaacatgtccgagacccctctagcccttaccttttgcccagcctctttctttgcacttcccagtctttgcaaatggcacctggatttacctggaggctcataaagaaactctgggagataatttccccatctttcttttgcaccatgaatttgggaccaatatctcttaatgtcttattttgtaggatcaattcttctttccaggagttagctaacgtcttttgtaaagagccagatagcgaatattttatgctttgtggaccaagaaataaaatcaaggatatatgtaggacttattgagcaagagacagaagaaatttacacaatttttgttttgttttgttttattttgtttgtttgttttgatatgaggtctttggcctcactctgttgccaggctgaagtgcaatggtgtgatcacggctcactgcagcctagacctcctaggctcaagtgattcttccacgtcagcctcctgagtagctgggaccacacagccaccacgctgccacatcccgccatgagctgctaatttaaaaaatttctgtgaagatggggttttgccacattgcccaggctaccgccagtttttgttgatgaaattcaaaatataatcatgattgtgttatagtgttttgcaatacaggtctactaatgagaaaagtggaattcttttggggtggttaacattttgcttaattgaggttctttgttactattctatgtcatcaaaatctattgcaaatcatcatctgctaatgttgaattgtaatgagctttcacatatttcatctttgaaaatgtgtttcacataggtactaccagttactgatatcagtccacaaacatgattttattttattattttattttatttctattttattttgagatggagtctcgctctatcgcccaggctggagtgtagtggcatgatctcggctcactgcaagctccacctcctgagttcacgccattctcctgcctcagcctcccaagtagctgggactacaagcgcccgccaccacgcccggctaattttgtattttttagtagagactgggtttcaccatgttagccagaatgatttcgatttcctgacctcgtgatccgccggcctcggcctcc

SEQ ID NO: 459845 - DNA, 747 bp, Homo sapiens
cagctcccgggcatagatgcatcttgtgctggctgagccatgtaactccaagtacgatttattttaagagaaaattgcccaccttttagagtaaataaacttaagagcagaacccagcaacttcatttccacttcctagtgtagcaactgaagagtgagcttctttcagcttcaattgctcttctcagaaagtttttatttggcttaatagaagaaagcacagtttctagaccaaagaggaagaaaataagacaaggcaaggcaaatatgaataaatgacccaggctaaatgccagttccttgcaaagaatttcatttaagcttcactgaattgaaaaggctcaaccagactcaacatttccaacttcctagcaagcagcagaaaatctacctgacagttgctatggagacacgaacaggaagacatggcaaggcggctaggagtgcaaacttcaagagtcagactgccaccatggaaatccggaccttgctgcatatcggcggcagaaacttgcacgtatacacctgcatcagatgtcacattgaaaggatgacaggtgtggtggtgaattgcctgcatcaacttgactgggccacaggatgcccagacacctggttcaacacggtttctgggtatgccccaagaatgtttctagatgggattagcattggaattggtggattgagtaaagcagatggtcctgccaaatgtatgtgggcctcatccaacccactgagggcctgaat

SEQ ID NO: 459846 - DNA, 823 bp, Homo sapiens
tatgctttactcaccgtcggatataatcctcacaacactatgaggaagccctcggtcatctatcttgcctgcactggggacagcggcactcagacaagcccatttttactggtgcccttcagatgcccgcgggctcagctgtctcggtgcctggcattccgggggtattgttcctctctacgagtcccagattccagcaacagctgctgccccaggctcccccgccagcttccccctgcgctccccctgcccgcctgccagagcccccttgctgaagaacgtggcacagtgacagccgaacctgcacagatgcaggcgtctgcggggcttccattctggagcagcactctcatcctgggctctatggatgtgaggggctggataattctttgttacggcagtggagggtgtcccgtgcattacgagctctcctcacttctctctctgtctctcctgccaccatgtgaagaaggtgcttgtttcccctttgccttccgccatgagtgtaagtttcctgaggtctcccagtcatactgctggttaagcctgcagaacggtgtacttgtttgaaatgtatctggcccaatcgctgagcgtccgcgctgcatttctccaaactgcccagcagggggcggtgctacctcggctccgcgcagccacggcttcccgctggcgaaccaagggcgcggaatctggagagggcgaggaacatctttcctcccacctgtcccccgccaggtctgccagacccgtctcatccgtgctgctgcttctgaaaatcagaagagtgaggatgaaataaagtcttcataaaggaaaacca

SEQ ID NO: 459847 - DNA, 1096 bp, Homo sapiens
tatgctttactcaccgtcggatataatcctcacaacactatgaggaagccctcggtcatctatcttgcctgcactggggacagcggcactcagacaagcccatttttactggtgcccttcagatgcccgcgggctcagctgtctcggtgcctggcattccgggggtattgttcctctctacgagtcccagattccagcaacagctgctgccccaggctcccccgccagcttccccctgcgctccccctgcccgcctgccagagcccccttgctgaagaacgtggcacagtgacagccgaacctgcacagatgcaggcgtctgcggggcttccattctggagcagcactctcatcctgggctctatggatgtgaggggctggataattctttgttacggcagtggagggtgtcccgtgcattacgagctctcctcacttctctctctgtctctcctgccaccatgtgaagaaggtgcttgtttcccctttgccttccgccatgagtgtaagtttcctgaggtctcccagtcatactgctggttaagcctgcagaacggtgtacttgtttgaaatgtatctggcccaatcgctgagcgtccgcgctgcatttctccaaactgcccagcagggggcggtgctacctcggctccgcgcagccacggcttcccgctggcgaaccaagggcgcggaatctggagagggcgaggaacatctttcctcccacctgtcccccgccaggtctgccagacccgtctcatccgtgctgctgcttctgaaaatcagaagagtgaggatgaaataaagtcttcataaaggaaaaccaaaaaaaaaaaaacaaaaaaaaaaaaaaatttttgtggggggcttttgggcctttagaaaaagtttttagaacaatcggtttgggcgacggcggcccaagaagtttagggaacaccggggcacataagtggtccaagagaacaaccgggcgagtacacaagtgcgggttccacccgaattaaaaccgcgcggagcaaacggagggtcgtgacaaaccaaagggttcggagcacaaccgggcttacagggggctcaaggagccaaataatgccgg

SEQ ID NO: 459848 - DNA, 1007 bp, Homo sapiens
tatgctttactcaccgtcggatataatcctcacaacactatgaggaagccctcggtcatctatcttgcctgcactggggacagcggcactcagacaagcccatttttactggtgcccttcagatgcccgcgggctcagctgtctcggtgcctggcattccgggggtattgttcctctctacgagtcccagattccagcaacagctgctgccccaggctcccccgccagcttccccctgcgctccccctgcccgcctgccagagcccccttgctgaagaacgtggcacagtgacagccgaacctgcacagatgcaggcgtctgcggggcttccattctggagcagcactctcatcctgggctctatggatgtgaggggctggataattctttgttacggcagtggagggtgtcccgtgcattacgagctctcctcacttctctctctgtctctcctgccaccatgtgaagaaggtgcttgtttcccctttgccttccgccatgagtgtaagtttcctgaggtctcccagtcatactgctggttaagcctgcagaacggtgtacttgtttgaaatgtatctggcccaatcgctgagcgtccgcgctgcatttctccaaactgcccagcagggggcggtgctacctcggctccgcgcagccacggcttcccgctggcgaaccaagggcgcggaatctggagagggcgaggaacatctttcctcccacctgtcccccgccaggtctgccagacccgtctcatccgtgctgctgcttctgaaaatcagaagagtgaggatgaaataaagtcttcataaaggaaaaccatttgcttgtttagatttcattcattcactactcaaatatttactgagctcctactgtgtgccaagccttgttctaagccctgggagtcaacagggaacaaaacagacacaaattccaattcctgccttcctggagcagtccttcctgctgggggccggtgggcaggaggtcttagatgacaaac

SEQ ID NO: 459849 - DNA, 914 bp, Homo sapiens
tgggaagcccccaaggggctggagtgggatgggggtgtgatgcaggccgcccaccaggttccctccgggcaaagcggcagggccccgcgcttcctgagccttcacggaggcctctgcaaagacctcctcttgccccgccttctcttattagtttcctgggctgctgtaacaaattacaacgaacttagtgacttaaaagaacagcctagttttttctcacaggtcctggagtccagaactctgaagttaaggtgtcagcaaagctgcacttcctccagagcctctagggtagaacccatgccttgcctatggtggctgcgggtgttcctggacttgtggctgtacaccccaatgtctgctcccaccatcacgtggccttccaactgtgtgtgtgttgacatgactggattaagaaatacctacaaaactggcaaaacagtacttctggatgtgtctgtgagggtgtttcaaggagactgatgtgtctctggacttggactgggccatgctaccagcatctcagagttgccagcttgtagacagcctgttgtgcgacttctcaacctctgtaatcaagtgagctaattcccctaacaaaccccctctcatatgtctatatctatcgatagctcctattgatctgtctctctgtagaaccctgaccaatacacacatgcttattacaaggtattgacccttggccaatgctgtgcaatggattaactaaagataaagatgttctataactatgagtctgaaaaccagagacctttgttctcgtgtttatctgctgaccttctctccactattatcctatgaccctgccacatccccctctctgagaaacacccaagaatgatcaataaatactaaaaaaaaaaaaaaaaaaaaaaaagagaacagtggcttggtgt

SEQ ID NO: 459850 - DNA, 559 bp, Homo sapiens
aaacccaaaacaatgaaaccttttcaaggaagtaaggtgttgacatgactggattaagaaatacctacaaaactggcaaaacagtacttctggatgtgtctgtgagggtgtttcaaggagactgatgtgtctctggacttggactgggccatgctaccagcatctcagagttgccagcttgtagacagcctgttgtgcgacttctcaacctctgtaatcaagtgagctaattcccctaacaaaccccctctcatatgtctatatctatcgatagctcctattgatctgtctctctgtagaaccctgaccaatacacacatgcttattacaaggtattgacccttggccaatgctgtgcaatggattaactaaagataaagatgttctataactatgagtctgaaaaccagagacctttgttctcgtgtttatctgctgaccttctctccactattatcctatgaccctgccacatccccctctctgagaaacacccaagaatgatcaataaatactaaaaaaaaaaaaaaaaaaaaaaaagagaacagtggcttggtgt

SEQ ID NO: 459851 - DNA, 663 bp, Homo sapiens
ttgtggtggcgttgagctcctctagcccgcgcttgccgtcctctcagtggtagcgcggggactggctgggaagcggtcggtcgagtgtggcctgtgtggactcgcatcttgcccgaagccgggcggaggagagctcaagctaagggtgatcagcccatgacctaaacctccagacaaaataaaacagggaaaatttgctagaatcaagaatgatggatccatgttcagttggagtccagcttcgtactacaaatgagtgccataaaacctactatactcgtcacacaggttttaagactttgcaagaattgtcatcaaatgatatgcttttacttcaacttagaactggaatgacactttctgggaacaatacaatttgctttcatcatgtaaaaatttacattgacagatttgaggatttacagaagtcatgttgtgacccatttaacatacacaagaaattagccaaaaaaaatttgcatgtaattgacttagatgatgccacttttctgagtgctaaatttggaagacagcttgtacctggttggaagctttgtccaaaatgcacacagataatcaatggaagtgtggatgttgatactgaagaccgccagaaaaggaaacctgagtcagatgtatgtgtaatagtcatttttttctaca

SEQ ID NO: 459852 - DNA, 2420 bp, Homo sapiens
ttgtggtggcgttgagctcctctagcccgcgcttgccgtcctctcagtggtagcgcggggactggctgggaagcggtcggtcgagtgtggcctgtgtggactcgcatcttgcccgaagccgggcggaggagagctcaagctaagggtgatcagcccatgacctaaacctccagacaaaataaaacagggaaaatttgctagaatcaagaatgatggatccatgttcagttggagtccagcttcgtactacaaatgagtgccataaaacctactatactcgtcacacaggttttaagactttgcaagaattgtcatcaaatgatatgcttttacttcaacttagaactggaatgacactttctgggaacaatacaatttgctttcatcatgtaaaaatttacattgacagatttgaggatttacagaagtcatgttgtgacccatttaacatacacaagaaattagccaaaaaaaatttgcatgtaattgacttagatgatgccacttttctgagtgctaaatttggaagacagcttgtacctggttggaagctttgtccaaaatgcacacagataatcaatggaagtgtggatgttgatactgaagaccgccagaaaaggaaacctgagtcagatggaagaactgctaaagctttgaggtcattacaatttacgaatccaggaaggcaaactgaatttgctccagaaactggtaaaagagaaaaaagaaggcttacaaaaaatgcaaccgctggttcagacagacaagtgataccagcaaagagtaaggtctatgatagccagggtctcctgatttttagtgggatggacctctgtgactgcctggatgaagactgcttaggatgtttctatgcttgtcctgcctgtggttctaccaagtgtggagctgaatgccgctgtgaccgcaagtggctgtatgagcaaattgaaattgaaggaggagaaataattcataataaacatgctggataatctgcggtaccaaactatggagcctttaaaggtctttatttctaaaaatctgttactctaagatacattttaagcttgattatcatatgacaaagattttaaaaccatctcagtgtgccctaatttttcatcttgggtgctttaagattcactatttgatataaattcagataggctatttttcagtagtcagcgttaagcctgtctggatcaatataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaatctaggttaaaattttagttagcacattgtaactgagtaattacatgaagtacaaacctctctgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattctatagaagtgaacactcgaaagaactggtcaacaaagatgaaagtgcagcaaagcaatgaaaaatgataacactggaagtgaaattttaatcaaacataaatgaatttgtagaagaagtcactgaccatgggaatgttgttcttgctgctgtgtattcataggagcttagtgaaggcaaacttaccaacacaaataagcaaagtggttgcaataaagacagatacgtcccagaggaagtgatggttaaaaaaaaaaaactttacattaaaagatatttaatgtgaatatagaaatatttcacaacattgaaagcacaagcaataaaagggtggaagctgacccaaacttagaaggagtatggcagtttgccgtgaacataaaagatgcttactcagtatggtaagttacttgccagaaaaaaaggcaagccctattcaaactactttgtttttacaatgaaataaaacactttaattctatttctaatgttttaaattacagtgtactaaatatttttaaacatttttgcatttttttctacatttataactggtcttaagagtttttaatatttgagcagaaccttaaaggtcatggaacaatcatcattttccctattgattattaagattgcaggaccatttttatggtcccacagtaccatgtgaaatgaggatcgcttgtagctgggaacagtgcttacttcagggaaaactgattttgatagaaccgactagttgagtattaaactgttttggaaataatttatatatctaagtgctgaaatatatttctcttctccccacttattcaaataaaaaagttttaatacta

SEQ ID NO: 459853 - DNA, 2787 bp, Homo sapiens
ttgtggtggcgttgagctcctctagcccgcgcttgccgtcctctcagtggtagcgcggggactggctgggaagcggtcggtcgagtgtggcctgtgtggactcgcatcttgcccgaagccgggcggaggagagctcaagctaagggtgatcagcccatgacctaaacctccagacaaaataaaacagggaaaatttgctagaatcaagaatgatggatccatgttcagttggagtccagcttcgtactacaaatgagtgccataaaacctactatactcgtcacacaggttttaagactttgcaagaattgtcatcaaatgatatgcttttacttcaacttagaactggaatgacactttctgggaacaatacaatttgctttcatcatgtaaaaatttacattgacagatttgaggatttacagaagtcatgttgtgacccatttaacatacacaagaaattagccaaaaaaaatttgcatgtaattgacttagatgatgccacttttctgagtgctaaatttggaagacagcttgtacctggttggaagctttgtccaaaatgcacacagataatcaatggaagtgtggatgttgatactgaagaccgccagaaaaggaaacctgagtcagatggaagaactgctaaagctttgaggtcattacaatttacgaatccaggaaggcaaactgaatttgctccagaaactggtaaaagagaaaaaagaaggcttacaaaaaatgcaaccgctggttcagacagacaagtgataccagcaaagagtaaggtctatgatagccagggtctcctgatttttagtgggatggacctctgtgactgcctggatgaagactgcttaggatgtttctatgcttgtcctgcctgtggttctaccaagtgtggagctgaatgccgctgtgaccgcaagtggctgtatgagcaaattgaaattgaaggaggagaaataattcataataaacatgctggataatctgcggtaccaaactatggagcctttaaaggtctttatttctaaaaatctgttactctaagatacattttaagcttgattatcatatgacaaagattttaaaaccatctcagtgtgccctaatttttcatcttgggtgctttaagattcactatttgatataaattcagataggctatttttcagtagtcagcgttaagcctgtctggatcaatataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaatctaggttaaaattttagttagcacattgtaactgagtaattacatgaagtacaaacctctctgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattctatagaagtgaacactcgaaagaactggtcaacaaagatgaaagtgcagcaaagcaatgaaaaatgataacactggaagtgaaattttaatcaaacataaatgaatttgtagaagaagtcactgaccatgggaatgttgttcttgctgctgtgtattcataggagcttagtgaaggcaaacttaccaacacaaataagcaaagtggttgcaataaagacagatacgtcccagaggaagtgatggttaaaaaaaaaaaactttacattaaaagatatttaatgtgaatatagaaatatttcacaacattgaaagcacaagcaataaaagggtggaagctgacccaaacttagaaggagtatggcagtttgccgtgaacataaaagatgcttactcagtatggtaagttacttgccagaaaaaaaggcaagccctattcaaactactttgtttttacaatgaaataaaacactttaattctatttctaatgttttaaattacagtgtactaaatatttttaaacatttttgcatttttttctacatttataactggtcttaagagtttttaatatttgagcagaaccttaaaggtcatggaacaatcatcattttccctattgattattaagattgcaggaccatttttatggtcccacagtaccatgtgaaatgaggatcgcttgtagctgggaacagtgcttacttcagggaaaactgattttgatagaaccgactagttgagtattaaactgttttggaaataatttatatatctaagtgctgaaatatatttctcttctccccacttattcaaataaaaaagttttaatactaaaaaaaaaaaaaaaaaaacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaagg

SEQ ID NO: 459854 - DNA, 2450 bp, Homo sapiens
ttgtggtggcgttgagctcctctagcccgcgcttgccgtcctctcagtggtagcgcggggactggctgggaagcggtcggtcgagtgtggcctgtgtggactcgcatcttgcccgaagccgggcggaggagagctcaagctaagggtgatcagcccatgacctaaacctccagacaaaataaaacagggaaaatttgctagaatcaagaatgatggatccatgttcagttggagtccagcttcgtactacaaatgagtgccataaaacctactatactcgtcacacaggttttaagactttgcaagaattgtcatcaaatgatatgcttttacttcaacttagaactggaatgacactttctgggaacaatacaatttgctttcatcatgtaaaaatttacattgacagatttgaggatttacagaagtcatgttgtgacccatttaacatacacaagaaattagccaaaaaaaatttgcatgtaattgacttagatgatgccacttttctgagtgctaaatttggaagacagcttgtacctggttggaagctttgtccaaaatgcacacagataatcaatggaagtgtggatgttgatactgaagaccgccagaaaaggaaacctgagtcagatggaagaactgctaaagctttgaggtcattacaatttacgaatccaggaaggcaaactgaatttgctccagaaactggtaaaagagaaaaaagaaggcttacaaaaaatgcaaccgctggttcagacagacaagtgataccagcaaagagtaaggtctatgatagccagggtctcctgatttttagtgggatggacctctgtgactgcctggatgaagactgcttaggatgtttctatgcttgtcctgcctgtggttctaccaagtgtggagctgaatgccgctgtgaccgcaagtggctgtatgagcaaattgaaattgaaggaggagaaataattcataataaacatgctggataatctgcggtaccaaactatggagcctttaaaggtctttatttctaaaaatctgttactctaagatacattttaagcttgattatcatatgacaaagattttaaaaccatctcagtgtgccctaatttttcatcttgggtgctttaagattcactatttgatataaattcagataggctatttttcagtagtcagcgttaagcctgtctggatcaatataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaatctaggttaaaattttagttagcacattgtaactgagtaattacatgaagtacaaacctctctgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattctatagaagtgaacactcgaaagaactggtcaacaaagatgaaagtgcagcaaagcaatgaaaaatgataacactggaagtgaaattttaatcaaacataaatgaatttgtagaagaagtcactgaccatgggaatgttgttcttgctgctgtgtattcataggagcttagtgaaggcaaacttaccaacacaaataagcaaagtggttgcaataaagacagatacgtcccagaggaagtgatggttaaaaaaaaaaaactttacattaaaagatatttaatgtgaatatagaaatatttcacaacattgaaagcacaagcaataaaagggtggaagctgacccaaacttagaaggagtatggcagtttgccgtgaacataaaagatgcttactcagtatggtaagttacttgccagaaaaaaaggcaagccctattcaaactactttgtttttacaatgaaataaaacactttaattctatttctaatgttttaaattacagtgtactaaatatttttaaacatttttgcatttttttctacatttataactggtcttaagagtttttaatatttgagcagaaccttaaaggtcatggaacaatcatcattttccctattgattattaagattgcaggaccatttttatggtcccacagtaccatgtgaaatgaggatcgcttgtagctgggaacagtgcttacttcagggaaaactgattttgatagaaccgactagttgagtattaaactgttttggaaataatttatatatctaagtgctgaaatatatttctcttctccccacttattcaaataaaaaagttttaatactagtcgacgcggccgcgaatttagtagtagta

SEQ ID NO: 459855 - DNA, 818 bp, Homo sapiens
atcagccggtccctggttccccctaaaaatctcatttttatggtcccacagtaccatgtgaaatgaggatcgcttgtagctgggaacagtgcttacttcagggaaaactgattttgatagaaccgactagttgagtattaaactgttttggaaataatttatatatctaagtgctgaaatatatttctcttctccccacttattcaaataaaaaagttttaatactataaacttttcattgttagcgccacgcagtccttgtcaagattgttctgggggacaaaaacttgatgtataaagcatgaatatacacacagtacttaaacagataccatatctgtggtattaaaattttgggggtggttgattaggattgtaaaaagactccttagggagtgaggatggaaaagagaaacactggttaatacagagtataaataaattttttggaaattgattgcatcttgatgttggaatttgcttggatgctatttggaggatgggggaatggactctcagttctgtggtgtgaaagaggggaaggtgaaactggttcctgccaaacaaaagggaactcagcacacacctcaacattttctatatgtcatttccagaaataatgatgccaaaaaaaaaatcaaatgcataatgactttctgatacttgacagtgtattttataaagctggatattcttaatcatttgtgatacagggatatttaaatgctttcatcttttttgatattttagtgtattgacattttttaactttttttcagttgaaattacataaaaatatagagtatatttggttagac

SEQ ID NO: 459856 - DNA, 3011 bp, Homo sapiens
ttgtggtggcgttgagctcctctagcccgcgcttgccgtcctctcagtggtagcgcggggactggctgggaagcggtcggtcgagtgtggcctgtgtggactcgcatcttgcccgaagccgggcggaggagagctcaagctaagggtgatcagcccatgacctaaacctccagacaaaataaaacagggaaaatttgctagaatcaagaatgatggatccatgttcagttggagtccagcttcgtactacaaatgagtgccataaaacctactatactcgtcacacaggttttaagactttgcaagaattgtcatcaaatgatatgcttttacttcaacttagaactggaatgacactttctgggaacaatacaatttgctttcatcatgtaaaaatttacattgacagatttgaggatttacagaagtcatgttgtgacccatttaacatacacaagaaattagccaaaaaaaatttgcatgtaattgacttagatgatgccacttttctgagtgctaaatttggaagacagcttgtacctggttggaagctttgtccaaaatgcacacagataatcaatggaagtgtggatgttgatactgaagaccgccagaaaaggaaacctgagtcagatggaagaactgctaaagctttgaggtcattacaatttacgaatccaggaaggcaaactgaatttgctccagaaactggtaaaagagaaaaaagaaggcttacaaaaaatgcaaccgctggttcagacagacaagtgataccagcaaagagtaaggtctatgatagccagggtctcctgatttttagtgggatggacctctgtgactgcctggatgaagactgcttaggatgtttctatgcttgtcctgcctgtggttctaccaagtgtggagctgaatgccgctgtgaccgcaagtggctgtatgagcaaattgaaattgaaggaggagaaataattcataataaacatgctggataatctgcggtaccaaactatggagcctttaaaggtctttatttctaaaaatctgttactctaagatacattttaagcttgattatcatatgacaaagattttaaaaccatctcagtgtgccctaatttttcatcttgggtgctttaagattcactatttgatataaattcagataggctatttttcagtagtcagcgttaagcctgtctggatcaatataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaatctaggttaaaattttagttagcacattgtaactgagtaattacatgaagtacaaacctctctgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattctatagaagtgaacactcgaaagaactggtcaacaaagatgaaagtgcagcaaagcaatgaaaaatgataacactggaagtgaaattttaatcaaacataaatgaatttgtagaagaagtcactgaccatgggaatgttgttcttgctgctgtgtattcataggagcttagtgaaggcaaacttaccaacacaaataagcaaagtggttgcaataaagacagatacgtcccagaggaagtgatggttaaaaaaaaaaaactttacattaaaagatatttaatgtgaatatagaaatatttcacaacattgaaagcacaagcaataaaagggtggaagctgacccaaacttagaaggagtatggcagtttgccgtgaacataaaagatgcttactcagtatggtaagttacttgccagaaaaaaaggcaagccctattcaaactactttgtttttacaatgaaataaaacactttaattctatttctaatgttttaaattacagtgtactaaatatttttaaacatttttgcatttttttctacatttataactggtcttaagagtttttaatatttgagcagaaccttaaaggtcatggaacaatcatcattttccctattgattattaagattgcaggaccatttttatggtcccacagtaccatgtgaaatgaggatcgcttgtagctgggaacagtgcttacttcagggaaaactgattttgatagaaccgactagttgagtattaaactgttttggaaataatttatatatctaagtgctgaaatatatttctcttctccccacttattcaaataaaaaagttttaatactataaacttttcattgttagcgccacgcagtccttgtcaagattgttctgggggacaaaaacttgatgtataaagcatgaatatacacacagtacttaaacagataccatatctgtggtattaaaattttgggggtggttgattaggattgtaaaaagactccttagggagtgaggatggaaaagagaaacactggttaatacagagtataaataaattttttggaaattgattgcatcttgatgttggaatttgcttggatgctatttggaggatgggggaatggactctcagttctgtggtgtgaaagaggggaaggtgaaactggttcctgccaaacaaaagggaactcagcacacacctcaacattttctatatgtcatttccagaaataatgatgccaaaaaaaaaatcaaatgcataatgactttctgatacttgacagtgtattttataaagctggatattcttaatcatttgtgatacagggatatttaaatgctttcatcttttttgatattttagtgtattgacattttttaactttttttcagttgaaattacataaaaatatagagtatatttggttagac

SEQ ID NO: 459857 - DNA, 2649 bp, Homo sapiens
ttgtggtggcgttgagctcctctagcccgcgcttgccgtcctctcagtggtagcgcggggactggctgggaagcggtcggtcgagtgtggcctgtgtggactcgcatcttgcccgaagccgggcggaggagagctcaagctaagggtgatcagcccatgacctaaacctccagacaaaataaaacagggaaaatttgctagaatcaagaatgatggatccatgttcagttggagtccagcttcgtactacaaatgagtgccataaaacctactatactcgtcacacaggttttaagactttgcaagaattgtcatcaaatgatatgcttttacttcaacttagaactggaatgacactttctgggaacaatacaatttgctttcatcatgtaaaaatttacattgacagatttgaggatttacagaagtcatgttgtgacccatttaacatacacaagaaattagccaaaaaaaatttgcatgtaattgacttagatgatgccacttttctgagtgctaaatttggaagacagcttgtacctggttggaagctttgtccaaaatgcacacagataatcaatggaagtgtggatgttgatactgaagaccgccagaaaaggaaacctgagtcagatggaagaactgctaaagctttgaggtcattacaatttacgaatccaggaaggcaaactgaatttgctccagaaactggtaaaagagaaaaaagaaggcttacaaaaaatgcaaccgctggttcagacagacaagtgataccagcaaagagtaaggtctatgatagccagggtctcctgatttttagtgggatggacctctgtgactgcctggatgaagactgcttaggatgtttctatgcttgtcctgcctgtggttctaccaagtgtggagctgaatgccgctgtgaccgcaagtggctgtatgagcaaattgaaattgaaggaggagaaataattcataataaacatgctggataatctgcggtaccaaactatggagcctttaaaggtctttatttctaaaaatctgttactctaagatacattttaagcttgattatcatatgacaaagattttaaaaccatctcagtgtgccctaatttttcatcttgggtgctttaagattcactatttgatataaattcagataggctatttttcagtagtcagcgttaagcctgtctggatcaatataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaatctaggttaaaattttagttagcacattgtaactgagtaattacatgaagtacaaacctctctgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattctatagaagtgaacactcgaaagaactggtcaacaaagatgaaagtgcagcaaagcaatgaaaaatgataacactggaagtgaaattttaatcaaacataaatgaatttgtagaagaagtcactgaccatgggaatgttgttcttgctgctgtgtattcataggagcttagtgaaggcaaacttaccaacacaaataagcaaagtggttgcaataaagacagatacgtcccagaggaagtgatggttaaaaaaaaaaaactttacattaaaagatatttaatgtgaatatagaaatatttcacaacattgaaagcacaagcaataaaagggtggaagctgacccaaacttagaaggagtatggcagtttgccgtgaacataaaagatgcttactcagtatggtaagttacttgccagaaaaaaaggcaagccctattcaaactactttgtttttacaatgaaataaaacactttaattctatttctaatgttttaaattacagtgtactaaatatttttaaacatttttgcatttttttctacatttataactggtcttaagagtttttaatatttgagcagaaccttaaaggtcatggaacaatcatcattttccctattgattattaagattgcaggaccatttttatggtcccacagtaccatgtgaaatgaggatcgcttgtagctgggaacagtgcttacttcagggaaaactgattttgatagaaccgactagttgagtattaaactgttttggaaataatttatatatctaagtgctgaaatatatttctcttctccccacttattcaaataaaaaagttttaatactataaacttttcattgttagcgccacgcagtccttgtcaagattgttctgggggacaaaaacttgatgtataaagcatgaatatacacacagtacttaaacagataccatatctgtggtattaaaattttgggggtggttgattaggattgtaaaaagactccttagggagtgaggatggaaaagagaaacactggttaatacagagtataaataaattttttggaaattg

SEQ ID NO: 459858 - DNA, 2950 bp, Homo sapiens
ttgtggtggcgttgagctcctctagcccgcgcttgccgtcctctcagtggtagcgcggggactggctgggaagcggtcggtcgagtgtggcctgtgtggactcgcatcttgcccgaagccgggcggaggagagctcaagctaagggtgatcagcccatgacctaaacctccagacaaaataaaacagggaaaatttgctagaatcaagaatgatggatccatgttcagttggagtccagcttcgtactacaaatgagtgccataaaacctactatactcgtcacacaggttttaagactttgcaagaattgtcatcaaatgatatgcttttacttcaacttagaactggaatgacactttctgggaacaatacaatttgctttcatcatgtaaaaatttacattgacagatttgaggatttacagaagtcatgttgtgacccatttaacatacacaagaaattagccaaaaaaaatttgcatgtaattgacttagatgatgccacttttctgagtgctaaatttggaagacagcttgtacctggttggaagctttgtccaaaatgcacacagataatcaatggaagtgtggatgttgatactgaagaccgccagaaaaggaaacctgagtcagatggaagaactgctaaagctttgaggtcattacaatttacgaatccaggaaggcaaactgaatttgctccagaaactggtaaaagagaaaaaagaaggcttacaaaaaatgcaaccgctggttcagacagacaagtgataccagcaaagagtaaggtctatgatagccagggtctcctgatttttagtgggatggacctctgtgactgcctggatgaagactgcttaggatgtttctatgcttgtcctgcctgtggttctaccaagtgtggagctgaatgccgctgtgaccgcaagtggctgtatgagcaaattgaaattgaaggaggagaaataattcataataaacatgctggataatctgcggtaccaaactatggagcctttaaaggtctttatttctaaaaatctgttactctaagatacattttaagcttgattatcatatgacaaagattttaaaaccatctcagtgtgccctaatttttcatcttgggtgctttaagattcactatttgatataaattcagataggctatttttcagtagtcagcgttaagcctgtctggatcaatataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaattgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattctatagaagtgaacactcgaaagaactggtcaacaaagatgaaagtgcagcaaagcaatgaaaaatgataacactggaagtgaaattttaatcaaacataaatgaatttgtagaagaagtcactgaccatgggaatgttgttcttgctgctgtgtattcataggagcttagtgaaggcaaacttaccaacacaaataagcaaagtggttgcaataaagacagatacgtcccagaggaagtgatggttaaaaaaaaaaaactttacattaaaagatatttaatgtgaatatagaaatatttcacaacattgaaagcacaagcaataaaagggtggaagctgacccaaacttagaaggagtatggcagtttgccgtgaacataaaagatgcttactcagtatggtaagttacttgccagaaaaaaaggcaagccctattcaaactactttgtttttacaatgaaataaaacactttaattctatttctaatgttttaaattacagtgtactaaatatttttaaacatttttgcatttttttctacatttataactggtcttaagagtttttaatatttgagcagaaccttaaaggtcatggaacaatcatcattttccctattgattattaagattgcaggaccatttttatggtcccacagtaccatgtgaaatgaggatcgcttgtagctgggaacagtgcttacttcagggaaaactgattttgatagaaccgactagttgagtattaaactgttttggaaataatttatatatctaagtgctgaaatatatttctcttctccccacttattcaaataaaaaagttttaatactataaacttttcattgttagcgccacgcagtccttgtcaagattgttctgggggacaaaaacttgatgtataaagcatgaatatacacacagtacttaaacagataccatatctgtggtattaaaattttgggggtggttgattaggattgtaaaaagactccttagggagtgaggatggaaaagagaaacactggttaatacagagtataaataaattttttggaaattgattgcatcttgatgttggaatttgcttggatgctatttggaggatgggggaatggactctcagttctgtggtgtgaaagaggggaaggtgaaactggttcctgccaaacaaaagggaactcagcacacacctcaacattttctatatgtcatttccagaaataatgatgccaaaaaaaaaatcaaatgcataatgactttctgatacttgacagtgtattttataaagctggatattcttaatcatttgtgatacagggatatttaaatgctttcatcttttttgatattttagtgtattgacattttttaactttttttcagttgaaattacataaaaatatagagtatatttggttagac

SEQ ID NO: 459859 - DNA, 2287 bp, Homo sapiens
ccgggctgtaggaaaaaatgtaaccgctggtttagacagacaagtgataccagcaaagagtaaggtctatgatagccagggtctcctgatttttagtgggatggacctctgtgactgcctggatgaagactgcttaggatgtttctatgcttgtcctgcctgtggttctaccaagtgtggagctgaatgccgctgtgaccgcaagtggctgtatgagcaaattgaaattgaaggaggagaaataattcataataaacatgctggataatctgcggtaccaaactatggagcctttaaaggtctttatttctaaaaatctgttactctaagatacattttaagcttgattatcatatgacaaagattttaaaaccatctcagtgtgccctaatttttcatcttgggtgctttaagattcactatttgatataaattcagataggctatttttcagtagtcagcgttaagcctgtctggatcaatataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaatctaggttaaaattttagttagcacattgtaactgagtaattacatgaagtacaaacctctctgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattctatagaagtgaacactcgaaagaactggtcaacaaagatgaaagtgcagcaaagcaatgaaaaatgataacactggaagtgaaattttaatcaaacataaatgaatttgtagaagaagtcactgaccatgggaatgttgttcttgctgctgtgtattcataggagcttagtgaaggcaaacttaccaacacaaataagcaaagtggttgcaataaagacagatacgtcccagaggaagtgatggttaaaaaaaaaaaactttacattaaaagatatttaatgtgaatatagaaatatttcacaacattgaaagcacaagcaataaaagggtggaagctgacccaaacttagaaggagtatggcagtttgccgtgaacataaaagatgcttactcagtatggtaagttacttgccagaaaaaaaggcaagccctattcaaactactttgtttttacaatgaaataaaacactttaattctatttctaatgttttaaattacagtgtactaaatatttttaaacatttttgcatttttttctacatttataactggtcttaagagtttttaatatttgagcagaaccttaaaggtcatggaacaatcatcattttccctattgattattaagattgcaggaccatttttatggtcccacagtaccatgtgaaatgaggatcgcttgtagctgggaacagtgcttacttcagggaaaactgattttgatagaaccgactagttgagtattaaactgttttggaaataatttatatatctaagtgctgaaatatatttctcttctccccacttattcaaataaaaaagttttaatactataaacttttcattgttagcgccacgcagtccttgtcaagattgttctgggggacaaaaacttgatgtataaagcatgaatatacacacagtacttaaacagataccatatctgtggtattaaaattttgggggtggttgattaggattgtaaaaagactccttagggagtgaggatggaaaagagaaacactggttaatacagagtataaataaattttttggaaattgattgcatcttgatgttggaatttgcttggatgctatttggaggatgggggaatggactctcagttctgtggtgtgaaagaggggaaggtgaaactggttcctgccaaacaaaagggaactcagcacacacctcaacattttctatatgtcatttccagaaataatgatgccaaaaaaaaaatcaaatgcataatgactttctgatacttgacagtgtattttataaagctggatattcttaatcatttgtgatacagggatatttaaatgctttcatcttttttgatattttagtgtattgacattttttaactttttttcagttgaaattacataaaaatatagagtatatttggttagac

SEQ ID NO: 459860 - DNA, 959 bp, Homo sapiens
cagtgggtcaaattgtttccctgatcagtcccaatgcgagaacctggatgtttcagttgaagttgctgtatttactcgccccttttcttcctccctccgtgctggctttttgtgatggttggtattcagaaaacctctctaaatttctgggctgggcattttgtgtagctctgtcttccctggtactctgttcctcatggactccaactgctttgattgctcagctttctctcctcaactcagtgaatccaccagcttcttccaggtttcctctccctgtactatgtcctggaaatgctcttaaggagggtgttggaatagtcttggtgaggatggaggaagacctcaaggaagcattaaccatgggtttggagaaaagcagtgttcatacaactgagtatgtgattcactctccttccccttccaagaaaaatggaagcactgcaaaaagaatgggaatggatcctcatcaggcaaaggacatatttcttaagtaaactatcagtataattccactggaagcttctaactcatcaagtaaatacaattttgcagtaagcaggacaacttctatttcccatatgaatgctcaaattcacttttcataggcactagcattttcctaccgggaccaacagttagacaaagatttacaggactctccagaaatctgacctaatgcctccagtgcactcatcacccaaccttcttcagaagaatgtgacagattattgtctgcgcaacttaccgtgcacaatgtccagcatgctaaaaaagttactagacatgcagagaaacagggaaacgtgagccatagtcaagaggaaaaacagtaagtaaagaaagacaggatgattctgattttgaaattagcaggcaagcactttaaagagcttattgtaaatgtgctcaagaatttaaaaaaagatagtcataattattgaaaagaaaatcaatag

SEQ ID NO: 459861 - DNA, 1914 bp, Homo sapiens
ttctgctgacatcacaaatcacacatggcttagtcgtttactaatggtcctgtcgttacttagtcgttacacatggtcctgtcgtgtcgtttacatagagactctccatccttactgcaaccttctgcacgttcgcctttggaggccccaagctagtgacatgtcagcgacagggtttgtgtttctttggatgagaagaggcattctggtttttggaattttcaggctttctgctctggtttctcctcatctttgtggttttatctacctttggtctttgatgttggtgacctacacatggagttttggtgtggatgtcctttttgttgatgttgatggtattcctttctgtttgttagttttccctctaacattcaggcccctcagctgcaggtctgttggagtttgctggagctccactccagacgttgtttgcctgggtatcaccagcagaggctgtagaacagcaaatattgctgcccaatccttcctctggaagctttgtcccagaggggcacccacctgtatgaggtgtctgtcagcccctactgggaggtgtctcccagtcaggctacatgggagtcagggacccacttgaggaggcagtctgtctgttctcagatctcaaacgctgtgctgggagaatcactgctctcttcagagctgtcaggcagggatgtttaagtctgcagaagctgtctgctgacttttgttcgtatatgccctgcctccagaagtagaatctagaggggcagtaggccttactgaactgtggtgggcactgcccaatttgagcttccctgccactttgtttacactctgagcatagaaccccctactcaagcctcagcaatggtggacacccctcccccacaagctccagtgtcccaggttgatcctagactgctgtgctagctgtgagcaaggttctgtgggcatgagacctgccgaaccaagcatgggagggaatctcctggtctgctggttgtggagaccatgggaaaagtgtagtatttgggcagaagtgtgccgttcctacagaatttgggtagagtaggtgagagcaagaagcaaggatgaaggaaagggagaacactgaagacagtgtttgctagtgggatttagtccatttttattggcaggattgcacgtcctgatgtcagctgaagagagaaatggtgcctcatagagtgtcctcggcttacctttctgtctggagggtgtctactcaattcaagcgtaaaacgtttttgagagaagacccaattttcctattttgccattccagtggtttttggcaagccaggacacccgttcatcctttcggaaactgatctagctgtcatgtttgccttagctgagccaggaactgcacccacacagactctttgttgggccagtcaaatctctgctcatttactaggaaacttctctttctcctcgagttttcctagagaaagatatttatacatgtatttgtacatggatttctcctataaaatgatgacagtgtggattttgatttgacttttctccaagatgatgcctcttaagtcacccttcttattttattgttattatttctatgaaatcatttaactggaacctttctaactacacaaatcatctacatctgcagagtcttcactgctccttcaccaagaaaccttacaccacaacagatcatagtgattatactatgtaattttgaaacttatagcatttaaaaatatatctgtggctcaaaaaataaattcaaggtccttttctgatatgaaattgtgtgtgtgaagatccactatagaaagtaaaattaaaaaaaacaaccaaaaaaacctgagagtgaccgtggtggaggtggaagccaggatgtgggattgggctgaaactcgatgtatttgatacttctcttat

SEQ ID NO: 459862 - DNA, 806 bp, Homo sapiens
tctagatttaaggattcaatatggactgcctcaaatataaaggtcctgatgtcagctgaagagagaaatggtgcctcatagagtgtcctcggcttacctttctgtctggagggtgtctactcaattcaagcgtaaaacgtttttgagagaagacccaattttcctattttgccattccagtggtttttggcaagccaggacacccgttcatcctttcggaaactgatctagctgtcatgtttgccttagctgagccaggaactgcacccacacagactctttgttgggccagtcaaatctctgctcatttactaggaaacttctctttctcctcgagttttcctagagaaagatatttatacatgtatttgtacatggatttctcctataaaatgatgacagtgtggattttgatttgacttttctccaagatgatgcctcttaagtcacccttcttattttattgttattatttctatgaaatcatttaactggaacctttctaactacacaaatcatctacatctgcagagtcttcactgctccttcaccaagaaaccttacaccacaacagatcatagtgattatactatgtaattttgaaacttatagcatttaaaaatatatctgtggctcaaaaaataaattcaaggtccttttctgatatgaaattgtgtgtgtgaagatccactatagaaagtaaaattaaaaaaaacaaccaaaaaaacctgagagtgaccgtggtggaggtggaagccaggatgtgggattgggctgaaactcgatgtatttgatacttctcttat

SEQ ID NO: 459863 - DNA, 1554 bp, Homo sapiens
tggcttgccttctaaaaaggtccctatggactatttgacttatagtactccatctactgttatatccccagaggaattccggtctcttcgcttgtccttttctccaaacctggatgactacaacccggacatccctgagtggaggagggacatcggtcgagtcatcaaaaaatccctggtggaaaaaggggagctttgtacaaaaacaaacaaactaacccagcaggaagaagctagagcccatgggaagttctggcctgatgtctgcaaagctgagccccacacatgcagagacctcaaaggccctaaaggggatgcaactatggaaccacggacaaacatggggtccttgcctcttgccacaggggttccaggccagcacatcctggtggcggtgctccctggcttacccaccactgctgaactctttgtcctaccctatcaggatccagctggagaaaacaaaaggtcaactgatgacctggagcagatatcagaattgctgatccacacgctcaaccaaaactcagtacacttcgagctgaagccaggagtccgagtccttgtccatgctgctcacttaacagcggagctggcggtgtccacaggagcacagtcactcagggctcgattttcttatgcaaaagacaaacgtgtcaacgggaacagcaattgtgataaggaaagtctcacctgcccagttctctgctcatttttctctgctctgtttcccccacaagcccccctggtggacctcactccaacccacagtggatctgccatgctgatgctgctctcagtggtgtttgtggggctggcagtgttcgtcatctacaagtttaaaaggaagatcccggggattaatgtttatgcccagatgcagaatgagaaagaacaagagatgatcagtccagtcagtcactctgaaagcaggcccaatgtccctcagactgaactaaggaggcctggccagcttatagatgagaaggtggaatcccagctcatagactgtcccttaccagaagttgtaaaatggactttctcatatttcaatggctctctctctgcctgtgaagtaggcatgggaatccaacaacgaggtatagagaatctgacgttcacttgctagattctgctatttattgcagcagaaattttccaggaagctagacaaacctatgaagccactattgctgatccatttctctgtctggttcctcctgtctgttggcattaggagttgaagccttatatgtttacatctagatcctgcattgctgacaacagtgaataaattattatataaccattcatgctccactctaatgtgataatgccaaaccacctagaaggcctttacataaaatttttaatcttacttggaaaacaatgagtatgtaaacggaaacataaccctctttaaatgaatatgggaaaggtctgtggctgtgttaaggggaaatgtaaatgcagtgactggctcctatcatagataatgataacaactgcagtcacatctggtgtccgattttcacagtgcactttcttttattt

SEQ ID NO: 459864 - DNA, 508 bp, Homo sapiens
gcctttctgcagccagctcaccattacttgctccactgggcccctgcagggatgctgtggtcctcccactggcaggcttcagcttcggccttgccatatgccccaacacaaccctccagttgccccaggggctatattggctggtcaacaggttcccactttactacaaatctcaatgcttcttctttggaagcacatacctctgactccagaatctccaggagagacccctgagaaggtcttggcctgaagacactcacctctctttccccaggagtgtcttttagggtgagtttggattatgcacctgtgagtcaggagactagaggcaggaaagagagcaatgagctgagggtggctaagctgggaggtgagcgagggtgccctggctgagaccttgaaaaactccacccatgatgatcaccattatactcctcttcatcaacacacatttgttgagcatctactctttgccaggcaccgtgtcagactctcaggcacagaggca

SEQ ID NO: 459865 - DNA, 848 bp, Homo sapiens
gcctttctgcagccagctcaccattacttgctccactgggcccctgcagggatgctgtggtcctcccactggcaggcttcagcttcggccttgccatatgccccaacacaaccctccagttgccccaggggctatattggctggtcaacaggttcccactttactacaaatctcaatgcttcttctttggaagcacatacctctgactccagaatctccaggagagacccctgagaaggtcttggcctgaagacactcacctctctttccccaggagtgtcttttaggaagacagacaaatagccagcagttccacagcgactcaggggactgccagggttcaaatcctgctcctgctagatgccacttctgctgctcttcattgctgccctagacaaggccaggccctgcggcgtgctgcgagccttccttccgttatctttaccagctctacatggtcattcacagatgagaaagctgaagatcagagagctcacacatttcccacaaggttacacagtcagtaagagacactatcaggattccaatgacctgctgttaaagttcatctcttattcactcattgcctccctcaaggctgaagagtggggtggaggggagaccagcagagctactgagctcaatctgcctccttggccctcccagcccagagctctgccagcggtggtaggaggagtgtgggcctccacaatcccctccctgtccctctccgggggctcctggatcaacagaagcacatgacgccagcatcctcatggagtcattcacaattagtaccagataagaatgcattgtgtagaccagtgctgccccatagactattctgc

SEQ ID NO: 459866 - DNA, 597 bp, Homo sapiens
gtggagtgatagaaaaatcttccaatgaactatcaagaagacagacaaatagccagcagttccacagcgactcaggggactgccagggttcaaatcctgctcctgctagatgccacttctgctgctcttcattgctgccctagacaaggccaggccctgcggcgtgctgcgagccttccttccgttatctttaccagctctacatggtcattcacagatgagaaagctgaagatcagagagctcacacatttcccacaaggttacacagtcagtaagagacactatcaggattccaatgacctgctgttaaagttcatctcttattcactcattgcctccctcaaggctgaagagtggggtggaggggagaccagcagagctactgagctcaatctgcctccttggccctcccagcccagagctctgccagcggtggtaggaggagtgtgggcctccacaatcccctccctgtccctctccgggggctcctggatcaacagaagcacatgacgccagcatcctcatggagtcattcacaattagtaccagataagaatgcattgtgtagaccagtgctgccccatagactattctgc

SEQ ID NO: 459867 - DNA, 1007 bp, Homo sapiens
  misc_feature (973)..(973): n is a, c, g, or t
  misc_feature (976)..(976): n is a, c, g, or t
  misc_feature (986)..(987): n is a, c, g, or t
  misc_feature (989)..(989): n is a, c, g, or t
  misc_feature (992)..(993): n is a, c, g, or t
  misc_feature (995)..(995): n is a, c, g, or t
  misc_feature (997)..(1000): n is a, c, g, or t
ttttttccatgcattttccaagggagaatgataaggtttcaactgggtgacttgtccaccatggaaaaccaaacatggatggcagggatgttcttgaatctgcagcccatgttgcaccagtcactgccaccttgtgtgaccaaaactgaaaaaagatttgcatcaacatgcttttattccagcactgtggttatcaacataagcatcagctttcagggttcctgctacagactttcaaactctccagccactcaagatggcattacactgcaattgggatgtcacagccggatagtacgcttcctaggcgaccattctttggtggtagacccctccctggggacactggaactcaacaggcatccgctcattacagctggtgagctttctgttaacagtgctgcaagaacaaaggtggaggcattgaagcaacttgtgcttctctcctcattgcaacccacccttgtggcaggaaaagtcttcttgatcattcaaaccacttgaagacagcattcttcttcaggaattgaactgaatgtgctgccatcctaggcaaaaactcccaactgactgatttgcaaaggatttgtagctgataaagatggtgcttgggacacacattctccttcctttctggaggaaatctaaatgcctggagctgagcaggtgtttcatgtcgagaaagagaagaatatctggggatagggcattaaatgatgagaggaccaggataaggaaaccagaggctggcctgaatcactacaatcctggtcttgtagaaatccttgactcacctcttcattccaaattagcaaaatgagcaacatgtaattttttttatctacaggatttgggtttgttctgacttgtctaattacactcttcaattcaccaaaagtagactgtgtgtttcattagtctccttttctttttttggatagaaaaagaaaactttgttttcttttctttgtgnaanttgagatatnnanagnnangnnnnttaaaat

SEQ ID NO: 459868 - DNA, 1095 bp, Homo sapiens
ttgtttatgactatgtgcagtaatatgggtgaaactattaggatagtgggatgtatggacttactgctgctgtggccgaacagaggcatttctgtctttctacctaaaggttttaaggtctcaaaatctgcaatacggatgcagcttgaggcctttatcctaactgatatggaaacagaaaatcaaatactgcatgttctcacttataagcaggaactaaacattggggacaggcagcagctggcttctgcagatcttcttcccagagagctgggcaagggcccatctccaactgtcagaggtcagggatttggcagtgagaatagcaaaaacgaaaacaacaaaaccaaaggaaaagtcttggtttctagtttttcccttcaaaatccacatcttcccaaaaaccaagacatgaaaatcctcctaaggagtctggaagaagccatgtggcaagttgtccatatctacaaaatagtttccagccaatactgtagttactggtgaggtaaaaaagtgtcagtctgggtggaaaaggaaacaaaaaataagggaaaacagtatgagatatgatgcacattacaactagcaagggtgaggacggtgtagcttcgtctccttcctctctcagacgtatcgtagagaagatggatctttccttccgccatctctgctaattgatgatgtttgagctcttccttggggaagacatcagcagttcattcactgcagttgccaatcattgaatcagactggctttccaggcattctaactgaattacaatagacaaaaattagttgacaaagtcagcaacgtagaccatgtaaacctcatgattccttatagtgaaataaacagtgaggaagtgacataactggcattgatgatggaaaaaatcaaaaggaagattgttttcctacagcatcaattttatattttcctaaaaaatactgtgaaaggttaatggctacttatccataaatattgtcttatataatgtatttttcattactggtagaagaaggaaatcatagaaacaaaagaaagtaaatttttagattttaataggaaaaaagaaaaaaaaattctccagggct

SEQ ID NO: 459869 - DNA, 2291 bp, Homo sapiens
atatagcatctacactagcaagaatggtgatcagatatcagatgaaaagtgctgtggaagaaggaacagcctcaggcagcgatggaaatttttctgaagatgtgctgtctaaatttgatgaatggacctttattcctgactcttctatggacagtgtgtttgctcaaagtgatgacctggatagtgaaggaagtgaaggctcatttcttgtgaaaaagaaatctaattcaattagtgtaggagaattttaccgagatgccgtattacagcgttgctcaccaaatttgcaaagacattccaattccttggggcccatttttgatcatgaagatttactgaagcgaaaaagaaaaatattatcttcagatgattcactcacaaatgaactaagagatattgatgccctaagccagaaatgctgtataagtgttcatttggagcatcttgaaaagctggagcttcaccagaatgcactcacgagctttccacaacagctatgtgaaactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaaggaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttgctgctatgcctttcttgcctccttctatgacaatcctaaaattatctcagaacaaattttcctgtattccagaagcaattttaaatcttccacacttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtatttctttctatagaattttaaaattcacttttaccatttgtttggaacagggattcaaaaactgagctttctgttctaatatccagaaacctggtagactgtatggaattattccaaagcccttcatttctcctaattttacccttgcctccagaatggagaagaacatggagggatatgttaggaacaatttggtgctaggtactttgatcggttgctgacaaatatgctaaaagtggtcaatcctagtaaaaacccagaatagttctctaaacatggtctgttgtttttctcttattagtatgctaaataataaatagtattattctcccagatttttttttaaaaaaggattcttgcctgtcgtttgaaagattaaaaaaatttgtctctaatctttatttaggtcgtgaggaattctatagtactcatccccattttatgacgcagcgagcattgtaccttgctgtctatgacctcagcaagggacaggctgaagttgatgccatgaagccttggctcttcaatataaaggtgatttgttctgatcatttgaaaatagaaaataattcatgtgtctgtgtgcgtgtgtgtgtgtgtgtgtaagttaatttattttgggcaaacaattgcttcagtctctttaaatactttcttaaaagaagcactaaaattttgaattgggaaacttt

SEQ ID NO: 459870 - DNA, 792 bp, Homo sapiens
acatctttctcctgtgctagatgcttcctgtcctcaaacatcggactccaaattcttcagctttgggacggactggcttccttgctcctcagcttgcagacagccgactgtgggaccttcctttgatttatgcctactcacatatacttggtacatgcacgttccttagaggaggggagataggaagacacacatgtaaatttccacctcagtttggaaacagatactgcaatcccagaaaatcttgccataagaagagcctagccaatagtttgactgcgatttcatgggagacctcaaggcagagtgatccagaataccacagtctggaggctatgaagtccatgattaagaagccagcacgtttgctttctggttccaagatggcacacctttttgctgcttcctccagagaggaggaacactgtgttctcacatagtagaagatggaaggagcagatgcagatgggcatggcaatgtgagaatatgtcagaggccccaggatgaaatgagctcaagtccctgaaatccctgttagaagagtctttccactggttgggaatgctaattgtattttgacaactcaatgtttcagcaactcaaaatgttacagcttctgcattggaataaaaaaaggttagttcctttggaattttgtgagttccaagttttaaaatattaaacctttagagcaatgatttatattgtaataacaacgatatttaggggagaaagactaaataaaaggagagagaaatctccttggtatttgccagtaatttacaggtcag

SEQ ID NO: 459871 - DNA, 1599 bp, Homo sapiens
gccttgcttttctctgttctctgtgggaacagctccggtctacagctcccagtgtgagtgacgcagaagacgggtgatttctgcatttccatctgaggtactgggttcatctcactagggagtaccagacagtgggcgcaggacagtgggtgcagcgcaccatgcgcgagctgaagcagggctaggcattgcctcactcgggaagcgcaaggggatgattccttgggttcaggcctgaatagctagaaaaatggagttgttatcaaccaagatgcagaaaactttgggtggagagatctgtggtggagggagaattggaggtcagcttggacatactgagtgtgacatgtctgttaaacatccagttaaagatgcagagtgtgggagccagagggacattgcacatgtgatggttaagataacaactttgagatggagagatgatcctagattatctggtgggcccaacctagtcacagaagtccttagaagtagagtatctttcccatggtggtcagaggctgaggtgactacgggagaatggccagagagatgcaaggttgctggatttgaagatggaggaagggggccactggccaaggaatgtgggtggctgctagaaggtggaaatggcaaggaaacaaattctcccctataacctcaagaagggaacacaaccctgcaaacccttgatttttgcccagggagatggatatctgacctgcagagctataagataatacatttgtgttgttttcagccactaagtttgtcataatttgttatcacagcaatataaaatgaatacacagagtaagcagttggatatgagtctggagatcctttattcttttaatataggaaatttgtcaacaacaaaaacaagtgtatatatttaaaagttttaaacctgattgttttaggctgtttaatttttgtgaacctaatgatttcagtcaggcccacatttctgaaatgagcgttatgtcagtgtaagctaatttaacacttttatgcagttttcataagtgattgtacaactatttgatgtttattgttgagtttgtgaagcatgacaccacaaaatcataaaaatgttctaatatctgtaaccagaactacagataagtctgtgcagtccttaaaatatactctacatatgtgtggatatatctgtatgtatttgtatatacgtatgcataagtaacctctatttggctacaagtagcacaaattagttctgtgtcagatattataagtatgtttctgtactttgttcattaacttcattattttatttcattaaaaaaaatttttttttaagatgaagttttgctcttgttgcccaggctggagtgcaatggcgtgatcttggctcactgcaacctccgcctcccaggatcacttgagcctgggaggttgaggctgcaatgaggcgtgattgcaccactgcattctggcctgggagacagactttgtcttaaaaaatatatgttaaaaaaaaaaaaaaggagagacagacagacaaggagaatgtcatgcgaagatagatgcacagagagaagacggccatgggactgctggagcagcagcacaatt

SEQ ID NO: 459872 - DNA, 1247 bp, Homo sapiens
acctacagcctcggagggtgagcgtcatggcggcttcttgccctctcccggtgaccccggacctgcccacgctgcgtgccaagttgcagggactgctgcagttcctgagggatgccctgtccatttccaatgcacataccgtggatttctacacagaatccgtgtgggaggagctggtcgacttgccaccggagacagtgctggctgcgctgaggaagtcagcgtcggagacggaggccctgccctcagagacgcgccccctagtggaagcagagtgggaagcaggtatgactgattttcccaaaatattttgtgaaacttctcagaagttggtgagtgtggaagcctttgctctggctgcgaaatactattctgtacaaaacttgggaatatgtactccttttgaacagttgcttgtagcccttcgaggaaatcaaaaccagagaattggtgaaaatcagaaggcagttgagtttatgaatatgaagaaatctcatgaagttcaggcaatgtcagagctgattagcagtattgctgactactatggaataaagcaggtgattgacttgggttccggtaaaggctacctaagctcttttttgtccttgaagtatggcttaaaagtttatggaattgattcttcaaataccaatactcatggagctgaggagagaaacagaaaattgaagaaacattggaaactctgtcatgctcagtcaagattagatgtcaatggactagcattaaaaatggcaaaagaaaggaaagtgcaaaataaagttaaaaataaagctgatactgaggaagtgaaagcaaagaataagcaggaggaaacaggactgagtgatatgatgaaatgggcggggacgtatgcaactaaaggatttaaagctggagaatttaatgtcaacaagggatggtgtgatgattttagaaagacgtttggcttaaaacaaattgtcaagataataggagaagcagcagatgctgatcaagaggcagcagacaagttcccagatgctattaagaaaactgttgaaatgtaagggtatcttcctgaaaaaattttcagtgcagataaaagtgccatattctggataaaaaaaaatgccacaaagaacacttattaataaggaagagaagcaagcaccaggatttaaggcaggaagagataggctaaggctactgttttgtgcaaattcagtcaagtttatcatcagaaatgtccttatctctaaaattactaa

SEQ ID NO: 459873 - DNA, 1247 bp, Homo sapiens
ggtgggttcttggtctcactgacttcaagaatgaagccacagacctttgcggtgagtattacactctttaagatggtgtgtctggagtttgttccttcagatatgtccagagtttcttccttctggtgggttcgtcttgctgacttcaagaacgaagccacagaccttcacagcgagtgttacagctcttaaaggtggtgtggacccaaagagtgagcaacagcaagatttattgtgaagatcgaaataacaaagcttccacagcatggaaggggacctgagcaggtatgactgattttcccaaaatattttgtgaaacttctcagaagttggtgagtgtggaagcctttgctctggctgcgaaatactattctgtacaaaacttgggaatatgtactccttttgaacagttgcttgtagcccttcgaggaaatcaaaaccagagaattggtgaaaatcagaaggcagttgagtttatgaatatgaagaaatctcatgaagttcaggcaatgtcagagctgattagcagtattgctgactactatggaataaagcaggtgattgacttgggttccggtaaaggctacctaagctcttttttgtccttgaagtatggcttaaaagtttatggaattgattcttcaaataccaatactcatggagctgaggagagaaacagaaaattgaagaaacattggaaactctgtcatgctcagtcaagattagatgtcaatggactagcattaaaaatggcaaaagaaaggaaagtgcaaaataaagttaaaaataaagctgatactgaggaagtgaaagcaaagaataagcaggaggaaacaggactgagtgatatgatgaaatgggcggggacgtatgcaactaaaggatttaaagctggagaatttaatgtcaacaagggatggtgtgatgattttagaaagacgtttggcttaaaacaaattgtcaagataataggagaagcagcagatgctgatcaagaggcagcagacaagttcccagatgctattaagaaaactgttgaaatgtaagggtatcttcctgaaaaaattttcagtgcagataaaagtgccatattctggataaaaaaaaatgccacaaagaacacttattaataaggaagagaagcaagcaccaggatttaaggcaggaagagataggctaaggctactgttttgtgcaaattcagtcaagtttatcatcagaaatgtccttatctctaaaattactaa

SEQ ID NO: 459874 - DNA, 1212 bp, Homo sapiens
gagcacagcactgtgcaagtcatgcatgctagttgtttgcttccatgtgaagggaactcagtgaatctgcagaccttagtctatctcttgggggacacatcagactatagcaggcccccattacttccttcatccattcttttaatacattcattcattcattgtcctccttccctcccttcttccttcccattctttctttattcccttccttccctctcccatcccacttcatctatttattctattaacatctttctgacatttttcttgcatgttgggttactccaatctagagaaggaggagaggtgacttatctgcttagtacatttgaaaagagtgaacagggcttacgcatactcagctctcctactttcatctactttttgaaatagtcttcctgctctgctcctccaaggctaggctcttcacctgtgagggacaggaaagggggcttgtcacagttcactgaggctgacattaggttgaggaacacacagatgatttaagcagccttcgattacaacatacctaaaataataaagcaattgaagagggaaaaaaatcagccgaaggtgtataccccctccacgctgggtgactgtggtatatttcatcttcgcattctaaatcaatgctaagcaaagcacagaaatgtttacctttgtctgatctctaattccctaaatttatgtggaatcatgcacagatgcgctggaaaccagcctggaaaagcctggcattttaattgatcccagagcttcttgcctcacggctcctgctgtgatgaagtctgctacttgttccaaagattctccgcctggttgcctagccacggcagctggccaatcaaggtgttcgtatgcagcgaaggaagtaaccaatcaattttttaatttccttctgtaaacgggagtgaatcggggtggatttgaaatctcattagtcaaaacttgccttgttgatccaaaatgaacctcccaaaacatcaccatcgtcatgccacacatcaagtcagaaatcttcatttgttttctcatggcttccagaagagtctgcattaatacattatcatgttttttgggggtgtagctaaattctgtcttcttaaaaaatagataaataaaaaataaccttcaacttttccagcctgcaatgatctcacatactatttttgattcctccataagttacgcattttatccttggtc

SEQ ID NO: 459875 - DNA, 1054 bp, Homo sapiens
  misc_feature (3)..(3): n is a, c, g, or t
  misc_feature (5)..(5): n is a, c, g, or t
  misc_feature (8)..(10): n is a, c, g, or t
  misc_feature (12)..(12): n is a, c, g, or t
  misc_feature (14)..(14): n is a, c, g, or t
aangngtnnntntngacacaaggctgtttcctgcactggtcagggatgaggtcctggagtccagtgcaggggaagtgtgctatggggaagggctgtaggtggtagggacagtcttgctgctccctcctggggcaccctcactggtccctgccgatgccacctcctacctgtcccccatgtacctctcctctgtgttttcctctggtccaggcacaaactcttctcagtgtgccacagcaggcttgaatgggtccaaggaacatgttcttgaaacaaaggaaaaaacaggccagaaacactaactcagggttgcggtcaggtttaaatgagcttatgcactgggatcattgagtacagttcctggcaccgagttggttctgcaatcactgttttctatgggtcccttctgtgggctaagcctgtgagagatgtggctgtgcctgcctggcaaaccattggcctctgtttgccacacagagccaggcacacagcaggtgctcaggaggacacgttgttagtctacgagtctctccttaccagtaacttactcagcacaaagggagaaatagtgatttcacagtggagaggccaagcagacaccaccctaaccaagggtgaagacttcacagaggaggggattgttgggattggtttttatgggtgtacaggaacctgccagatagacaagaggaagaagggcattccaggtagacaagcatccaggacccagaaggagttaaaacacttggggaaactgtagggtctaaaatagggtgtgaggaagggagcagccatggccctcaattttcccatctgcacgtgggatgtttgaatcagctgatctccctgctgacacattgttcattcttcattggtagtggggacaggacccagtcctgttgcagatgtgtgatggggctggctcatacagatttgtgagagcacttctttcagctccatagtcaacaacataaagcccaatagtgaaagtgtttacaccacagaaattggcaaatgctacgaatccagcctttttgtttttctgggacagctc

SEQ ID NO: 459876 - DNA, 1204 bp, Homo sapiens
tctttattatatgaatagcacaggatgatcacgctctctagcgcattctctgctaaacagaaaacacacgcgcacaagaacacacatgcatgcatgtgtgcaacggacatggctaacccgaaactggttttacatttcgaggtaattgtggctctcctctctttactacagacaattctttctctccttctggggcaaagaacatggcttgctcatctttatgttctcagcactgagaatgatgccttgcacacagtaggcacccagaagcatctactgccacatgactggtgctttggtaaacactgtgtcagctgccggcaccacatttttcatcgtttctgttctatattcagttcaacattaaaacggtcccagggctttgaagggtaccctaacctcaactcattgttacaaaagggctctgcattaagcctatgttccaatggtttcgaagatcataatgattattctgtacttattcatggctgtacgctctggcatgcctgtgagctgttctcgtaaaagagatataaggatcaaaacgtacccatgataggtattatctgccagggcagacgctgccctttgatagaagtcacagaaattcagcactggcctaccctcactctaccatggcacagaagaaacttctggatttagggctaccttcgggccaattctgaaataagtaaagttagtctttggtgtctttatgcttctgttcctgtttccttcttcctgttcattccccagcagtctggtctgattctcaagaaacttttccattgtactgaactagagagagattgagacaaactaagattttactaacgacttcctgaaggctgaagtaaagcctttaagatggaaagaaacaactcatcatcctattcgaagatcagtcgggccagccccagtgtaaccctcactgcagcctgaccaagacgaggctgaaacagcaagagcatctaacccacacaaaagctgctcttgtgaaacttaaggtaataactcttcccaaagaagccatgaatacaatttctgatccatccagaaagctctggcttgcagtactgttgcgatgcagttgcacagcagttatgccatgacctcccaacatactgcaagaaaaaaggaagttttttcctttggtacgtagtgatagtcaacaaaagccacttcccttttctatttctctttg

SEQ ID NO: 459877 - DNA, 1322 bp, Homo sapiens
tctttattatatgaatagcacaggatgatcacgctctctagcgcattctctgctaaacagaaaacacacgcgcacaagaacacacatgcatgcatgtgtgcaacggacatggctaacccgaaactggttttacatttcgaggtaattgtggctctcctctctttactacagacaattctttctctccttctggggcaaagaacatggcttgctcatctttatgttctcagcactgagaatgatgccttgcacacagtaggcacccagaagcatctactgccacatgactggtgctttggtaaacactgtgtcagctgccggcaccacatttttcatcgtttctgttctatattcagttcaacattaaaacggtcccagggctttgaagggtaccctaacctcaactcattgttacaaaagggctctgcattaagcctatgttccaatggtttcgaagatcataatgattattctgtacttattcatggctgtacgctctggcatgcctgtgagctgttctcgtaaaagagatataaggatcaaaacgtacccatgataggtattatctgccagggcagacgctgccctttgatagaagtcacagaaattcagcactggcctaccctcactctaccatggcacagaagaaacttctggatttagggctaccttcgggccaattctgaaataagtaaagttagtctttggtgtctttatgcttctgttcctgtttccttcttcctgttcattccccagcagtctggtctgattctcaagaaacttttccattgtactgaactagagagagattgagacaaactaagattttactaacgacttcctgaaggctgaagtaaagcctttaagatggaaagaaacaactcatcatcctattcgaagatcagtcgggccagccccagtgtaaccctcactgcagcctgaccaagacgaggctgaaacagcaagagcatctaacccacacaaaagctgctcttgtgaaacttaagagtttacgttcttggagacattgatggagataataacaacaactatgatcatcatgactgccataaccagctcctactgtatcctagctctgtggagagcacatcacctcatcacacagcaacactacaaggactgcctccactttaagatgtgattaagtaacatgcccaaggcccgtagcaaagaagcagtagagccagaaattaaatttagggttctccaatttcagaagccatgttcttaactctctgtggtattgctcaccatctacagaccaaacagatgaaccctgaataaaacacacttttccaaag

SEQ ID NO: 459878 - DNA, 825 bp, Homo sapiens
aactggctttgctttgtatgtctttcatccttctgtggactagacataagcatgttcttatgttgaaaataaataatgaattgtccctaaatgtggacttcatttccattccattctgttattcagagccttcactatttcaaatagccatctttttttcattaattacatcagctctgcttttgttatgtcttgttggaaaagagaagaaagtttccattatttctcttctagactgtggaatgaagcagatggggcattttgcaaacattcaatcatatcttgaaatctctgaaacctatatcctgaacccttcagttctgatcttgactattgtaactattgtaattaatacttttattttttatctttctcactggactgtaggctctttgaagacagtggaatactgtttgtctccatactgtcaatgcccagcgtaatctctgacaaatgaatttcgctcttgtcgcccaggctggagtgcaatgatgcgatctcggctcactgcaaccttcgcctcctcggttcaagtgattctcctgcctcagactcccgagtacctgggattacaggcatgtgccagcacgcctgtatttttgtatttttagtagagacggggtttcaccatgttggctaggctggtctggaactcctgacctcaggtgatccgcccgccttggcctcccaaagtgctgggattacaggcatgagccatcgtgcccggcctgttgtaatttccttctctatactaaaaggtgttttatacatataaagtatttttctttattataatgagaaataaatcttataaaaatatttggg

SEQ ID NO: 459879 - DNA, 1039 bp, Homo sapiens
ttcgaagcggctgctccagacaggccgccgctgccatcacaagtaccattaacattaccactttatagtgatggcactttgtagtttgacattggccactgtgggagtatttgcagcagaaactggcaaatgctgcaaggtggtcacatggtggttccacagagttaggtctatcccagaatacagtgtagtggacaccaaagaggccaaaagggcaaattccccttcgaaagcagacgacctcctgtggaagatagtgaaacacatgctgtggaaattcagtctgatcttcatcccatatgctggttctcaagatggagcaacagggagatttttctcttcccatgaacacatcctcagcctcaatccaagggcaatgatctgtattattaaagatataggtcaagccagcttgcgcttcttcgtcctgtgggatgttttagaagctgctgtcacattaccaagatctgttctgtggttcctaattattcctcttggcagctttggattccaagtgattcctctcacatagattcatgagtgaatgaaacagacatgatcacttcccttatggctacaaaagaggggagaatggggaaacatggaaatcaaaaagcatccctgtattatctattctcatactgctaacaaagacatacttgagactggttccctatatcccaggatgatgaagacccctctttctccctctgtataccaagaagtttaagtatcagcaacacaccaagggaaaatagcaaacagacttctgtttggacatgaaattgaacaaagagctcacaccagtcagagccagtttgaaccagtctgcacggctctgaaatctgccggacctccctctgaagctggcacaaagacacgaagaacatcattgacttcaatctttggccttctaaccaggaaaggacttgtgaaggtgaatggtttgcagacgaaggggatataaaagagacaaaaccaggataaaaattaaataaaaagtagctgtcttaaactgtaattgcagtcctctgctgag

SEQ ID NO: 459880 - DNA, 971 bp, Homo sapiens
cagagggcgatgtagcctttacttaggagaagtatagaaattaaggaagcttataaaattatgatttattattgcagtcgagctgtcttctgggctttatcagacatttcgtataaatattcttctctctttttgagtctgtgtcatattcagcactgtgaacccttaccagcaagtgactatttttgagttacaggaaggaaaggtgagcagccatgtggctaaagaaagctccttaactaggacatatgggaagcaaaagatggttaacatttttctgctgaatgaattctacattctttcacattctttgtgttgaaataaacttctagcttatctttcaaatggctcctaattttatttatgcaagtacgttactgctttaattccttgatgaaacaaggcaagatataaataaatacaataaaagctattctagctgggtagaacaccttttcaaaagtcttccctagagtaaatatcaaatcaaaatgcctttatgaatcagttgcccttaaaagggtggattttacggtctgaatatctcaatttcaacagaaacacaaaacagaaaaaaaaaaacctggttgtctcagaacatcagttcttaaaatcaaggcataataaatggtctatatgtgtagacaattttgatgtagatgatctctccagacagtctggggaacacaggaaccattgtattgatcagactgtggtcacatgtactacttagctaaagaggttctgttcctgaagatagcttactataacatcaagtgtttgaaataaaataagaccacgaaaccattgtaaagcaaataaaacatgcaatcatgacaatattttgtcaataaaccaaggcctagcaatttaagaagcttagaagaggaataaggtattttacttttgtttgttctgtccttggacttgattgattgattgattgattgagacggttttgctctggttga

SEQ ID NO: 459881 - DNA, 3177 bp, Homo sapiens
  misc_feature (3)..(6): n is a, c, g, or t
  misc_feature (9)..(10): n is a, c, g, or t
  misc_feature (13)..(13): n is a, c, g, or t
ctnnnnttnnctncagcctgtagcgggagtggcttgctgtcagctcgggtccgacactgcagggttcccgacctccagcctcgccaggagagcgccgcgttcagcgactcggagccgggtacctcctgcctgctggattaggtagaaggagaagctcagccaatcctgagggctcggaggcaaggaaggcgggacgaagaggaaaagttgaggacaggagcgtcacccaatccaacgcctgactgcaaaagcgatggcggcgagcacccaattgtagacggcagttagagggaggatggttagtggagagcggaccaatccgtgacaggggagggcaatcttaagccaattaaagctgagaaggtgggaaggggcggagctcgccctgtggctgctcggtggtggggagccactggtggggaccttttttgggccccctttccttcgtggggtactatggagttcccagaacacagtcagcagctgctgcagagcctccgggagcagcggtcccagggtttcctttgtgactgcaccgtgatggtgggtagtacccagttcttggcccatcgggctgtgctggcctcctgcagcccattcttccagcttttctacaaggagcgggaattggacaagagggatctggtgtgtattcacaatgaaattgtcacagccccagcctttgggctgcttctggactttatgtatgctggccagctgaccctgagaggggatacccctgtggaggatgtgctggcagctgccagctacttgcacatgaatgacatcgtcaaggtgtgtaagcggcggcttcaagcccgggccctggcagaggcagacagtaccaagaaggaggaggaaaccaactcacagcttcctagtttggagtttttgtctagtacttcccgtggcacccaaccttcgttggcatctgctgagacatcaggccactggggcaaaggggaatggaaaggctctgctgctccctcacctactgtccgtcctccagatgagccaccaatgtctagtggggctgacactacacagcctggcatggaggttgacgcaccacatctgcgggcacctcatccaccagtggctgatgtctctcttgccagccctagtagctccactgagaccattcctacaaactacttctcttctggcatctcagcagtttcattggagccactgccatctcttgatgtgggtcctgagagtctgagggtggtggaaccaaaggatcctggaggaccactgcaaggcttctatcccccagcctcagccccaacgtcagccccagcccctgtctcagctccagttccatcccaggctccagccccagctgaagctgagctggtccaggtgaaagttgaagctattgtgatctctgatgaagagactgatgtgtcagatgaacagcctcagggtcctgagagagctttcccatctggaggagcagtgtatggggcacagccctcccagccagaggcttttgaagacccaggggcagcaggactggaggaggtggggccaagtgaccacttcctgccaacagaccctcatctaccctaccatctgctgccaggtgcagggcagtatcatcgaggactggtgacctcacctctgcctgcacccgcatccctgcatgagccactttacctgtcttctgagtacgaagcagctccaggaagctttggggtttttactgaggatgttcccacctgcaagacatgtgggaagaccttctcatgctcttacacactacggcgacatgccacggtgcacacacgtgagcgaccctatgagtgccgctactgcctgcggagctacacgcagtcaggggacctctaccgccacatccgcaaggctcacaatgaggacctggccaaacgcagcaaaccagatccagaagtgggaccccttctaggggtgcagcctctccctggctccccaacagcagacagacagagcagcagtggtggagggccacctaaagattttgtattggccccaaaaactaacatctaagggagcatgagctgatgctaggctgctcttaccatccttagatggcagctcagaaggttggtggcaccttatcacccctgctgggtgacaagaataaaggctctgcccaggctgaaagttcctacccttttttttttttaatcttttatttttttgagacagagtctcactctgtcacccagactggagttgcagtgagccgagatcacgccattgcactccaaccctgggtgacagtgcgagactccatctcaaaaaagaaaaaaagaaaagggggaaaatgacaagtaaatattcttctctctttttgagtctgtgtcatattcagcactgtgaacccttaccagcaagtgactatttttgagttacaggaaggaaaggtgagcagccatgtggctaaagaaagctccttaactaggacatatgggaagcaaaagatggttaacatttttctgctgaatgaattctacattctttcacattctttgtgttgaaataaacttctagcttatctttcaaatggctcctaattttatttatgcaagtacgttactgctttaattccttgatgaaacaaggcaagatataaataaatacaataaaagctattctagctgggtagaacaccttttcaaaagtcttccctagagtaaatatcaaatcaaaatgcctttatgaatcagttgcccttaaaagggtggattttacggtctgaatatctcaatttcaacagaaacacaaaacagaaaaaaaaaaacctggttgtctcagaacatcagttcttaaaatcaaggcataataaatggtctatatgtgtagacaattttgatgtagatgatctctccagacagtctggggaacacaggaaccattgtattgatcagactgtggtcacatgtactacttagctaaagaggttctgttcctgaagatagcttactataacatcaagtgtttgaaataaaataagaccacgaaaccattgtaaagcaaataaaacatgcaatcatgacaatattttgtcaataaaccaaggcctagcaatttaagaagcttagaagaggaataaggtattttacttttgtttgttctgtccttggacttgattgattgattgattgattgagacggttttgctctggttga

SEQ ID NO: 459882 - DNA, 1131 bp, Homo sapiens
  misc_feature (1)..(3): n is a, c, g, or t
  misc_feature (5)..(9): n is a, c, g, or t
nnntnnnnngctattgccagaaggtccagagactcacagaccggtgtcacccctgcccagcctgtctatggttgtttctctgccctgtccatcggtcactgccctgcccctatctagccctgacaaaaagtgcaagtgtggtatcccagcctcctgcctctctcttccctcccccgccttccttcctctcgcctgggctgcctgcctcagaagtggggacccaaagggtgcaggacgcctggtctgccttgtgggtcctggacggagcccctacctctgcaaagatgacttggagacaggccgtcctgctgtcttgcttctccgccgtggtgctcctgtctatgctgagagagggaaccagtgtatctgtgggcaccatgcagatggcgggagaagaggcgagtgaagatgcaaaacagaagattttcatgcaggaatcagatgcctcgaatttcctcaagaggcgcggcaagcggtcccccaagtccagagatgaggtcaatgtggaaaacaggcagaagcttcgggttgatgagctgcggagagaatattacgaggaacaaaggaatgaatttgagaacttcgtggaggaacaaaacgatgagcaggaagagaggagccgggaggctgtggagcagtggcgccagtggcactatgacggcctgcacccatcctatctctacaaccgccaccacacctgatcccatcctgaagccggccaagaagacaaagcttgtagcaccattggcatccccgtgttccagcaatctttcccatgcaaaccggcccttcagagggtctcagcttggggtctgcagtggccagcagctcttgaaaagacgcatgcctttccttccagtgtgtgaaagtgtcctgactttcacctctttgcagaccatcttctgaggtgagcaactgcctgcagggcctcctagtaccaaacctacagtggcttcccctggcttcgttcccaagcaaaagaatcagtcaagaatcacatgtttgcttatggcttacaaataaaaacgctgaatcaaccatgtgtattatcttctcaaatctccaaccgaggggtgtcatgctgtcttccctgagcgatgatgtgattcttgctgacttgggtgtttgaaa

SEQ ID NO: 459883 - DNA, 2191 bp, Homo sapiens
  misc_feature (6)..(9): n is a, c, g, or t
gtcagnnnnagatggtggctcaaatgtggagaaagtttagtaaagaagctacttgcaaagggtgggggcaggatgttgggaataaagggatgtcattacatcccagggtcatggagtccctaccactcatgtccgaaggggcaggaagaaccctttggtggtgatgctacaccaggattgaaagatgagaggaggagatggggaattctatctgacatctatcagcagcaaactatccagacttcacttgtgaaatatggaccttgtcaactggggtgtcagcatcagtcaggagacggcggtggtcagacagcagctgggcacaggggagcacagagctgtaggcccagggtcaaggcactgagtgatgggccaggattctgcagtgatacaaatgtttttgggctgtttctttctgaattaaaagagccccacatgtctgacggattcaccaggggaagatacaaaggacagggtcgcagggcttgatagagtctgaacaactggactcagccattgacaatgtccagaaacatatttccccaatccgagcttttccccaaaaactttagttcacagttcctattttgttgatgagttttacttatgaaaagtaaatgtacttatggaaagtataatccacttgaaaactccaactggaagcttatatagaaaattctccagccttataaactatcaggggtcatcggtgaaaatgtccacaggagtgagagaaagcagctgtctcgatttttaaaatgtgaaatctaattttaaatgtgaatggtacatttaaattacaaacatattacatatatacacacatatattccaatgaaacagttcattatgaatatgtaacaaataaatgtatacatatatacaaatcatacatatatatatatatatatatataaatgtatatattatgtaataaatatatgaaaatggaatacataaagatatagtatatctgaatttatacatgcatacttaaatgtatatatgctaaaatatttaataaaatatataaatatatagtagtacatattccccatatagcagatattatatatgtcatatataacactattataggctataaataataaattatatattatatagggtatatatatatatagaattcaatgagttaatatatatacaatgaaaggacctaaaaatgtaatatatattatatatgtaatgtgtagtagattatcatgtgtaatatatgataaataaaatttattatcaacatacaatgcatgtattccaatgaaataaggcatgttcccacggtatatttgggcggtgccatctctgacctaaaataactcgctctgacataatccctgaggaaggatgcctgtaagagcccatggttcccagcatgctcctgcagagccgggctcaccccctgcctccaacagcccttctagacgcaggctccacctttagcctgtggaagaaagagcagccctgggcatcacgtgaccatccccacccctcgcccccctccactgctgattggtccagggatgaacatgcttctgagacaggctaccatctctgcgtgcagtccccgcggaatttacgcactttcgtcttgtgctcttagatgttctccaggtagactgcaaccaacacctttagaataaacccacctgtgcttgggccagcctgagaggtcttcattccttgctgtccagaaaaccttcaaaggctgcagcataaccagcttctaacattgtccactggagcagagactttgggagccgaggtgaagatggcgcaactaccagagggagagctggattctagagtccccacttgcttgcctggaaggagatctgctcagaactgccaggatgtcagaacacggctctgtacgagctcctgagatccagggctgtagttgtgagaatttgtcctaatgcctctagtcttggcctgtgcttcagcttatttgggggaacaaaaccaatctgattgctctcaacatccagttgtcactgattgggttcaaggaaattattttatcttcagaaaacattttgttatttgaagcagctatataagtgagataaatatatttgatacatatgtacagatttatatatatatagcaccaaacatacatatatattatatatatatatttcatataagcgtacatatgccttcc

SEQ ID NO: 459884 - DNA, 2057 bp, Homo sapiens
  misc_feature (6)..(9): n is a, c, g, or t
gtcagnnnnagatggtggctcaaatgtggagaaagtttagtaaagaagctacttgcaaagggtgggggcaggatgttgggaataaagggatgtcattacatcccagggtcatggagtccctaccactcatgtccgaaggggcaggaagaaccctttggtggtgatgctacaccaggattgaaagatgagaggaggagatggggaattctatctgacatctatcagcagcaaactatccagacttcacttgtgaaatatggaccttgtcaactggggtgtcagcatcagtcaggagacggcggtggtcagacagcagctgggcacaggggagcacagagctgtaggcccagggtcaaggcactgagtgatgggccaggattctgcagtgatacaaatgtttttgggctgtttctttctgaattaaaagagccccacatgtctgacggattcaccaggggaagatacaaaggacagggtcgcagggcttgatagagtctgaacaactggactcagccattgacaatgtccagaaacatatttccccaatccgagcttttccccaaaaactttagttcacagttcctattttgttgatgagttttacttatgaaaagtaaatgtacttatggaaagtataatccacttgaaaactccaactggaagcttatatagaaaattctccagccttataaactatcaggggtcatcggtgaaaatgtccacaggagtgagagaaagcagctgtctcgatttttaaaatgtgaaatctaattttaaatgtgaatggtacatttaaattacaaacatattacatatatacacacatatattccaatgaaacagttcattatgaatatgtaacaaataaatgtatacatatatacaaatcatacatatatatatatatatatatataaatgtatatattatgtaataaatatatgaaaatggaatacataaagatatagtatatctgaatttatacatgcatacttaaatgtatatatgctaaaatatttaataaaatatataaatatatagtagtacatattccccatatagcagatattatatatgtcatatataacactattataggctataaataataaattatatattatatagggtatatatatatatagaattcaatgagttaatatatatacaatgaaaggacctaaaaatgtaatatatattatatatgtaatgtgtagtagattatcatgtgtaatatatgataaataaaatttattatcaacatacaatgcatgtattccaatgaaataaggcatgttcccacggtatatttgggcggtgccatctctgacctaaaataactcgctctgacataatccctgaggaaggatgcctgtaagagcccatggttcccagcatgctcctgcagagccgggctcaccccctgcctccaacagcccttctagacgcaggctccacctttagcctgtggaagaaagagcagccctgggcatcacgtgaccatccccacccctcgcccccctccactgctgattggtccagggatgaacatgcttctgagacaggctaccatctctgcgtgcagtccccgcggaatttacgcactttcgtcttgtgctcttagatgttctccagagactttgggagccgaggtgaagatggcgcaactaccagagggagagctggattctagagtccccacttgcttgcctggaaggagatctgctcagaactgccaggatgtcagaacacggctctgtacgagctcctgagatccagggctgtagttgtgagaatttgtcctaatgcctctagtcttggcctgtgcttcagcttatttgggggaacaaaaccaatctgattgctctcaacatccagttgtcactgattgggttcaaggaaattattttatcttcagaaaacattttgttatttgaagcagctatataagtgagataaatatatttgatacatatgtacagatttatatatatatagcaccaaacatacatatatattatatatatatatttcatataagcgtacatatgccttcc

SEQ ID NO: 459885 - DNA, 1463 bp, Homo sapiens
gtcagtaacacgtagttgatcatgggaattgacagtttgggtgcacagatatctgcagtacaggtccaaatgtcaactcttgtaaaagttacacccactctaatacccagtgttggacaaggaagggatatctggctggtgtttggaatgctttatcctgcatattattcatacaaagctgtgaaaacaaaaaacgtgaaggaatatgttcgatggatgatgtactggattgtttttgctctctatactgtgattgaaacagtagccgatcaaacagttgcttggtttcccctgtactatgagctgaagattgcttttgtcatatggctgctttctccctataccaaaggagcaagtttaatatatagaaaattccttcatccacttctttcttcaaaggaaagggagattgatgattatattgtacaagcaaaggaacgaggctatgaaaccatggtaaactttggacggcaaggtttaaaccttgcagctactgctgctgttactgcagcagtaaaggatttctggcttacttctgcacctctacttcaatcaatttgaggtaaccgattattcaaaataaggcatgaaaaagtctgttcttaaaacttggtacttagccagttactaatgtcatttgttgtgtttgcaagccaagttatcaaatgaatgtgttctgtaaaaatttgcattatggttttggatttctttgcatgttgtaatttgtgtgatttattttaaatactttagcataattgattttggtgtgtttggtatggaaagaaaatagccttctgtgttccttagttgcttcatgtataaaatgggggtaatatacctgtgagaatatttaaaagcacagtgcttgcttgcatatagtaggagcccaataaacataaatatcatgtgtctatctccattcaaaattcaagtgaaaatttaagttttttgctattaaattaaattgagattgaatagtattctgctttcaagttagtctgttttagttatcttgaactaaaacaactctatggaaataaatattccagttgagtggtgattttatataactaatagtgaagggatatgaaatgagggcactttcacttttcagagaggtctttgactcaagtatcaaaatgaatgtaatgaacaagaaggaaaattcaaattatatacctaatagcattacattgagggttaaatggaagtttattaactatgcagcactatacatgtaagataactatattattaatgattattaatggtcagcactttaatatagcatagttttcttgttatttggcttttaaaggctttttcttttattaggataggtttataaatgaatacagaaatagcaaagttttcagcttaaaggactatgttttattttagaagttcattttgttttttatttcttgcttagtgaaaatgcattcctgatttccatatctgct

SEQ ID NO: 459886 - DNA, 696 bp, Homo sapiens
ttttcacacataactggtttttaattacatttgacttttcctgatgtctgttcagaatgccggtcccctttggaaggggcaagcacaaaggcagggacaggttggcaagaaggagaagcaaattgagcagagccctacaatccttcctcttttggtggggaaacaggcacagggcaggcttctgcccagagaattgttctcatctgagggtcattgtccacggagattagtctcgcgagcctctggaatcctgatctgtcacagaagcccagagatctgtgctgccgactgtggtggccatggcgtgtgcgtagggggcacctgccgctgcgaggatggctggatgggggcagcctgcgaccagcgggcctgccacccgcgctgtgccgagcatgggacctgccgcgacggcaagtgcgagtgcagccctggctggaatggcgaacactgcaccatcgctcctccaaggctacatgcggaacatagtaggagtatgagaaacatttgtacaatgccaaagaaacaagcgttgcccaagagaaaagatgcctactgccatcatcttcatcctgaagttctgaagagaaagatgcaggaattgatgaagtcctgaatccacctttcataatgcaaagcttgcatcatcttttctaaaagttggtactttaaaatcatgaatttttaaacaactgtact

SEQ ID NO: 459887 - DNA, 595 bp, Homo sapiens
  misc_feature (24)..(24): n is a, c, g, or t
cacacaactcagacgaaaaaaaanttaatgcttaccatttcggcttttcacttgagtgctgtacatgtgtgtccttcaggtactgatgaagcctctacagagctctcttctcagccttgctctgccatttctgctgctactgcagcagtgacactggaatccctgaagcatcaaatcttgaattggaggaaagtacttctttccatattttgtaatatgtcctactaaaggatagcaaagcagagttgtttgctcccatcttagaaacttttaaataaaatttaggtattacttttaaacataggtccacagagaagacaaatctaagtggcaaaaataatgtgtattcagcgtcactattccccaaggatgacaaatgtatgttttttgctgtaatatctcccagttgactccatcttctcttctattgaattttcaaccagagagcttcttagttccttattcaaatacagttttggtagacctaaccagtattatatgtgcctgatctatctaaatctaatcaagtttggtttaaatgaaatcaagtgtactcacagcctctcatacctattccatttttacttttgtacaa

SEQ ID NO: 459888 - DNA, 588 bp, Homo sapiens
cccaacacccataccacaaaaagaaaacccttaaggcttttcacttgagtgctgtacatgtgtgtccttcaggtactgatgaagcctctacagagctctcttctcagccttgctctgccatttctgctgctactgcagcagtgacactggaatccctgaagcatcaaatcttgaattggaggaaagtacttctttccatattttgtaatatgtcctactaaaggatagcaaagcagagttgtttgctcccatcttagaaacttttaaataaaatttaggtattacttttaaacataggtccacagagaagacaaatctaagtggcaaaaataatgtgtattcagcgtcactattccccaaggatgacaaatgtatgttttttgctgtaatatctcccagttgactccatcttctcttctattgaattttcaaccagagagcttcttagttccttattcaaatacagttttggtagacctaaccagtattatatgtgcctgatctatctaaatctaatcaagtttggtttaaatgaaatcaagtgtactcacagcctctcatacctattccatttttacttttgtacaa

SEQ ID NO: 459889 - DNA, 3113 bp, Homo sapiens
agaaagacaaagatcaaagtgccaacacctgatcatggatgataactatgacacttgaatatctgaataattgtataacctgtacttttagtactttacctccttctactgctaattatttcattatttatagagtaagtgtatggcttactctatcacattgtaaactctgtagatctgctctatctatattttctgatgacctctcagccataggaaagttctatgcttggaaatacatcacatcacatcccctgagaaggtttttaaaatgcaaaaatcttcaccctgagattttgattcagtggtttggtgcaaaaaatttgcaaaataaaatgccaagagctttggatttaacccattttatcatcaacctatcatttttactggtgttttccaaagaggaagctgacgctgaaattgtagaaaaacttgcccaagttcacatagctaataagagacagctggtagtgttcaaacccacaggtgtttaattctaatgcctgtatcctggtcaaagaccagtttagtaaaataataggcacaccagagtaaaacttctaaagagcagaggcaaagaaaatatttaaacttagccaaaaagacatattcccttcgaatgagtcatgctaagacaaacagctgaattataaagcagaagaataaaatattgccttccacttattgaaagaagataactatcaagctagaattctatgcacaaaagaaatattcttcaaaaatgaagaagaaacaaaatattttcacatacatgcttgagaaaatttttcaacaacagatttgcctaataaataataataaaggaagttgttcagtcataaataaatcacagatgaaagcaaggaaaaaagggaaatgaatgaagagcaatgggaatgatcagtaagtgctaaatccaaatgaacactgattttataataataggtactgcctaaaatgcattcagaatttaaaatataatgaaaataccacacaacctggggatatatagaattttatgtgttctaatgtcttttggttgtctgacatatggcaaaaagtgctaattatattatactgcttaaataagttaaacatgcatataatattgtaatatccaagatgaacaataaaaaatagtacagtaaatcgatttttaactaaaatttaatagaaagaaaatgggaaaataaaacagaaatacttgattaatccaaaagaagctagtggtaaaaagaagcaaacagcaggtggaaaagaaaaacaatttttaaagtattagagaaaatttagcctagtgattaaaacgtgttattgaccaatttatacttgttttaatcccatctttttcacttcttagtgagtagtaagattatataacaccctaataagtctgttttttccagctgtgtacaacaattgcctaaaaaattagatggctttattgccttgaaggaatactgaacgagaagtttaaacaagtgaattctagccttggtcttactagtgtttaatcgtggccaaaaaaaaaaaaaaaaaagtctttattcactggacatgtcatttagctttggtggtcgttagtatgttgaatttttaaaaataattttaagaagactaactttgcctacttttcagaatttcttttaaaataaatgaaatgaaattacatacataagagaatgctgagaagtgtgtcatgttcaaatgtaaaatgtgtttgacctccttcgtaagtgttgaaatcacttgtcattattggttccctaaaggaggaaacaaataggaaaaaaaaaaaaaaaaaaggactttgtcatcctacaagtattgttcttcagagaggataaattgaagcctttagataaattaactgctaaagtaaagcccttcatgtttaataaacttaatggaaaggaataacttcaacaaatacacaagttattcagtctgttcttgaatagctgtttcttgattcacacacatttggtaaggtattatttagaaaacatcaataaacaaactagctttatcagaactgtaagagtatttacaaaataattttatataaatctattctcaaaagaaagaagggaaggaaggaaggaaggatggagggagggagggacagagggagggagggggaagggagggagggaagaaagaaggaaataaagaaaattaattgttatacatacatttggttttccaaatttaaaatcgcaccaaaagaaaatcctgagcacattcagacagtcattaaatctttgaagaaaatgtttttattagtttaaaaacaaagtgaaaatggactcaggatgttggaacctaagaaggaagaccgcaagtgtttcagaatgttccacaaaaaatagttctgcttacatcattatggaaggaattttgatgagacaggtcatagagggaaaagaaaaaaaggctaatatagccataaagaatgcttttaaatcaagtaatacacttgacttagaaagacaagccagcggcaattataaaataatgacacctaagaatgttttcaagaagtctggttcataatgcattcaaacttaaaaaaatattaaagacaactaaaaaaattttgctcatttttggagcaaaaaaactaccaaagaaggagcagcttgagggaatattaatggattatgagaagaaaatgaaactgaactattttgcgttatcctacaagatgaatgattatagagtacaatagactgactaaccaggagttgaaagccagatcataagatatttgaagagacacagtaacctctcaaaatgaggccaattttcttagatcaggcttttcacttgagtgctgtacatgtgtgtccttcaggtactgatgaagcctctacagagctctcttctcagccttgctctgccatttctgctgctactgcagcagtgacactggaatccctgaagcatcaaatcttgaattggaggtagagtctcaacagttcagataactggacccattccagactgctaagacctacaaccccaaattcttcaccagaccacaagcacagttaatgcaactggtagaatatgttccgggaacatgtgaaataccactttgaagactctca

SEQ ID NO: 459890 - DNA, 3373 bp, Homo sapiens
agaaagacaaagatcaaagtgccaacacctgatcatggatgataactatgacacttgaatatctgaataattgtataacctgtacttttagtactttacctccttctactgctaattatttcattatttatagagtaagtgtatggcttactctatcacattgtaaactctgtagatctgctctatctatattttctgatgacctctcagccataggaaagttctatgcttggaaatacatcacatcacatcccctgagaaggtttttaaaatgcaaaaatcttcaccctgagattttgattcagtggtttggtgcaaaaaatttgcaaaataaaatgccaagagctttggatttaacccattttatcatcaacctatcatttttactggtgttttccaaagaggaagctgacgctgaaattgtagaaaaacttgcccaagttcacatagctaataagagacagctggtagtgttcaaacccacaggtgtttaattctaatgcctgtatcctggtcaaagaccagtttagtaaaataataggcacaccagagtaaaacttctaaagagcagaggcaaagaaaatatttaaacttagccaaaaagacatattcccttcgaatgagtcatgctaagacaaacagctgaattataaagcagaagaataaaatattgccttccacttattgaaagaagataactatcaagctagaattctatgcacaaaagaaatattcttcaaaaatgaagaagaaacaaaatattttcacatacatgcttgagaaaatttttcaacaacagatttgcctaataaataataataaaggaagttgttcagtcataaataaatcacagatgaaagcaaggaaaaaagggaaatgaatgaagagcaatgggaatgatcagtaagtgctaaatccaaatgaacactgattttataataataggtactgcctaaaatgcattcagaatttaaaatataatgaaaataccacacaacctggggatatatagaattttatgtgttctaatgtcttttggttgtctgacatatggcaaaaagtgctaattatattatactgcttaaataagttaaacatgcatataatattgtaatatccaagatgaacaataaaaaatagtacagtaaatcgatttttaactaaaatttaatagaaagaaaatgggaaaataaaacagaaatacttgattaatccaaaagaagctagtggtaaaaagaagcaaacagcaggtggaaaagaaaaacaatttttaaagtattagagaaaatttagcctagtgattaaaacgtgttattgaccaatttatacttgttttaatcccatctttttcacttcttagtgagtagtaagattatataacaccctaataagtctgttttttccagctgtgtacaacaattgcctaaaaaattagatggctttattgccttgaaggaatactgaacgagaagtttaaacaagtgaattctagccttggtcttactagtgtttaatcgtggccaaaaaaaaaaaaaaaaaagtctttattcactggacatgtcatttagctttggtggtcgttagtatgttgaatttttaaaaataattttaagaagactaactttgcctacttttcagaatttcttttaaaataaatgaaatgaaattacatacataagagaatgctgagaagtgtgtcatgttcaaatgtaaaatgtgtttgacctccttcgtaagtgttgaaatcacttgtcattattggttccctaaaggaggaaacaaataggaaaaaaaaaaaaaaaaaaggactttgtcatcctacaagtattgttcttcagagaggataaattgaagcctttagataaattaactgctaaagtaaagcccttcatgtttaataaacttaatggaaaggaataacttcaacaaatacacaagttattcagtctgttcttgaatagctgtttcttgattcacacacatttggtaaggtattatttagaaaacatcaataaacaaactagctttatcagaactgtaagagtatttacaaaataattttatataaatctattctcaaaagaaagaagggaaggaaggaaggaaggatggagggagggagggacagagggagggagggggaagggagggagggaagaaagaaggaaataaagaaaattaattgttatacatacatttggttttccaaatttaaaatcgcaccaaaagaaaatcctgagcacattcagacagtcattaaatctttgaagaaaatgtttttattagtttaaaaacaaagtgaaaatggactcaggatgttggaacctaagaaggaagaccgcaagtgtttcagaatgttccacaaaaaatagttctgcttacatcattatggaaggaattttgatgagacaggtcatagagggaaaagaaaaaaaggctaatatagccataaagaatgcttttaaatcaagtaatacacttgacttagaaagacaagccagcggcaattataaaataatgacacctaagaatgttttcaagaagtctggttcataatgcattcaaacttaaaaaaatattaaagacaactaaaaaaattttgctcatttttggagcaaaaaaactaccaaagaaggagcagcttgagggaatattaatggattatgagaagaaaatgaaactgaactattttgcgttatcctacaagatgaatgattatagagtacaatagactgactaaccaggagttgaaagccagatcataagatatttgaagagacacagtaacctctcaaaatgaggccaattttcttagatcaggcttttcacttgagtgctgtacatgtgtgtccttcaggtactgatgaagcctctacagagctctcttctcagccttgctctgccatttctgctgctactgcagcagtgacactggaatccctgaagcatcaaatcttgaattggaggaaagtacttctttccatattttgtaatatgtcctactaaaggatagcaaagcagagttgtttgctcccatcttagaaacttttaaataaaatttaggtattacttttaaacataggtccacagagaagacaaatctaagtggcaaaaataatgtgtattcagcgtcactattccccaaggatgacaaatgtatgttttttgctgtaatatctcccagttgactccatcttctcttctattgaattttcaaccagagagcttcttagttccttattcaaatacagttttggtagacctaaccagtattatatgtgcctgatctatctaaatctaatcaagtttggtttaaatgaaatcaagtgtactcacagcctctcatacctattccatttttacttttgtacaa

SEQ ID NO: 459891 - DNA, 1591 bp, Homo sapiens
caagacagcttaagtggagcttaagtggacaagatccagggaaatgcctcacaaaacatgtgaagaatctgatggaaagcttattgaagacagcctgattcagctgagatgtcactttacatggaagttgttaattgaagcccctgaaattcctgatttagaaaacaggatctgggaagagattcagttcctggacaccaaatacaatgtgggaatacacaacctactagcctatgtgaaacacctgaaaggccagaatgaggaagccctggtcagcttgaaaaaggctgaagacttaattcagaaagaacatgccaaccaagcagatattagaagtctggtgacctggggcaactttgcctgggtgtattaccacatgggcagattggcagaagcccagacttacctggacaaggtggagaacacttgcaagaagtttgcaaatccttcccgctatagaatggagtgtccagaggtggactgtgaggaaggatgggccttggcgaagtgtggaggaaagaattatgaacgggccaagacctgctttgaaaaggctctggaagggaaccctgaaaaccctgaattcaatactgggtacgcaatcaccgtctatcgcctggataaatttaacacagcatcagggaggaataaggcattttctctgcacgtcctaaaacgagctgtcaggctaaatccagatgatgtatatattagggttctccttgccctgaagcttcaggatgaaggacaggaagctgaaggagaaaagtacattgaagaagctctgaccagtatatcttcacaggcctatgtctttcaatatgcagccaagttttatcgaagaaaagggtctgtggataaagctcttgagctcttaaaaatggccttggagacaacacccacttctgccttcctgcatcaccaaatggggctttgctacagggcacaaatgatccaaatcaaggaagctacaaactggcagcctagagggcaagatagggaaactgtggacagattggttcaattggctatatgcaaatttgaaaagactataatgttaaagcgaacatttgagatggcctatgttgacctggctgaaacgtatgcagaaataggccaccacagaaaggctgaggaacattttcagaaagggttacgcatgaagatctttgaagatcagctaaagcaagagattcattaccactacggccgtttccaagaacatcatgggaaatctcaagataaagcaattacccattatttaaaaggtttgaaaatagaaaaaatgtcccattccagggaaaaacttctcaatgctttagagaaattggctaaaagatgtattcaccagaatgtacgggttgtggaaagtgtcagcctccttgggcttatccacaaattgaaaggagaatcattaggtgtctgtatttcctgagtggttaccctcaagctttgtgctcaaataaactctatacttaatcatagtttctgaattccattatttgagattgagacaacagtctttcccaattgctgccttcaaaaatgtatagtctgatgaaatacaaaatacttcggtataacacatact

SEQ ID NO: 459892 - DNA, 588 bp, Homo sapiens
catttcctcctgtctggttaagatgcccagctcagtgccaaagagcatatcctggatgacagcaagacagttttgtttctgtctcaaaggactgatttacctgccccccatgttcatgccaagttttcctttggcatgtatatgcctggggttccatggctcagaccgaaaggctcctactgagctttctgagagccctgaaaaaggttggcaatttccaagagatccagccatgtacagagtagcagtggggtcaaggaagaggcagcttcttcaggactctcaagctccagcaggattcttgatccatctaccaaagaagcagggaggggtgaaaggtgttgaggagatgaaatgccaggggtttacagtcagggctctcacaccaggtttcaattcacagctgcaggtaagacactgttctggggctcccagaatccctcagatcttccaagagagatgaaaacctccatccccaaaaagagaaaactctctattttcaagtggactgttcctatcaagagaattctatgaaatgttaatttttttaaacttataatattgattcttttctgtataaagaaaatg

SEQ ID NO: 459893 - DNA, 1464 bp, Homo sapiens
agcaggaaccaggaagtgacagtgtgcccagcctctcacctgaccctggacagggatataaagagcccgggctcagggggctccacacctgcacctccctctcacctgctcctctacctgctccaccctcaatccaccagaaccatgggctgctgtggctgctccggaggctgtggctccggctgtggaggccttggctccggctgtgggggctgtggctccggctgtggaggccgtggctccggctgtgggggctgtggctccggctgtggaggctgtggctccggctgtgggggctgtggctccggctgtgggggctgtgggggatgtggctccggctgctgtgtgcctgtctgctgctgcaagcccatgtgctgctgtgtgccagcttgttcctgctccagctgtggcaaagggggctgtggctcttgcgggggctccaagagaggctgtgtctcctgtggggtgtccaagggggcctgtggctcctgtggggggtccaaggggggctgtggctcctgtggggggtccaaggggggctgtggctcctgtggggggtccaaggggggctgtggttcttatggctgctcccagtgcagctgctgtaagccctgctgctgctcctcaggctgtgggtcatcctgctgccagtccagctgctgtaagccttactgctgccagtccagctgctgtaagccctgtagctgcttctcaggctgtggatcatcctgctgccaatccagctgctacaagccctgctgctgccagtccagctgctgtgtccccgtgtgctgccagtgtaagatctgaggctctgactgcagactgcaggtggcctgactggtgaagggcccgtctgcccagcttccttgccctgggttctctggtgctccactgtctccactgtgtcctcactggcttcatccactccacaccagtgcttccgaaactgactgaggaccccttctggctcattgcctactacttctcctgaacttcctctccctgctcctcactcatttaagatccaaagcggcccactgaggccccagaggcagatcagaccccttagaccctgacagctgctccttctttcaggagtgtgatcgaccctcaatctctctggctgtctgtatatcaagactgaatcctgaccctctaaataaacaaagtctctaagcacaaagctcactgtcttgtggttctctccttcccacctctctctcattcccagaagcaccatcttcttgcctccacccctgggcctgttcccatttctctcccctcagcatctttcatgtcatggtccatgtcttcatgcacagaactaacgtctatagctttctgctctgggccccttgttgtgttgggctccagagatgacagagcagagtaaatccaagctcacagtctgggatgtgctttatactattataaggagcaaagggtcagagtgaggacagg

SEQ ID NO: 459894 - DNA, 680 bp, Homo sapiens
gctggggcctccgggcagacggggaagaggtgcagggaggccgatgccctcccataagtgttcgtggtggaggagctggcctggcttcaggtggggatgcatcacactgccctcaggaccattggcctatgcacgcactgcaggagaagagacatcccagctccccaagaaaggaggcctggtgtgggtgccttcctccctcgccagcacccatcgttggccatctattcagaagagcctgtgctgcccactccttcccctagagatcttcccgtgtccctggcttgcagctttggcctcccagggtcctcccacgtgtggactgacagacatgcagagccctcctgggtcatcccagagagagcagatgacctaccagagtgctggggatgccgtgtccaacacaatagcaaggaagctgctttcgtggaagtggtgttctcatgaagatgggaaaaacacataagacatttctgatgacaatcaaagctctatggaaaagaggctgggcacggtggctcatgcctgtaatcccaacaatttgggaggctgaggatgaacataacatcagccaatgccaagaaccaaaaccttcttggattagattcaaaataaactacaggcaacgcagctttttttcttttttctttttttttttttaattttggagttgtgctgtt

SEQ ID NO: 459895 - DNA, 678 bp, Homo sapiens
gctggggcctccgggcagacggggaagaggtgcagggaggccgatgccctcccataagtgttcgtggtggaggagctggcctggcttcaggtggggatgcatcacactgccctcaggaccattggcctatgcacgcactgcaggagaagagacatcccagctccccaagaaaggaggcctggtgtgggtgccttcctccctcgccagcacccatcgttggccatctattcagaagagcctgtgctgcccactccttcccctagagatcttcccgtgtccctggcttgcagctttggcctcccagggtcctcccacgtgtggactgacagacatgcagagccctcctgggtcatcccagagagagcagatgacctaccagagtgctggggatgccgtgtccaacacaatagcaaggaagctgctttcgtggaagtggtgttctcatgaagatgggaaaaacacataagacatttctgatgacaatcaaagctctatggaaaagaggctgggcacggtggctcatgcctgtaatcccaacaatttgggaggctgaggatgaacataacatcagccaatgccaagaaccaaaaccttcttggattagattcaaaataaacaaggatgcggccgaaccccctgttgcacacaagcaccaaatgcgcacaaaaacaaaaaaca

SEQ ID NO: 459896 - DNA, 3161 bp, Homo sapiens
  misc_feature (12)..(12): n is a, c, g, or t
  misc_feature (18)..(18): n is a, c, g, or t
gcccaattgccnactccntcgggacaatcaaccaacacccctttcaagtttgggggtggtgctgtcccggggccacggagaatacatccttctggggaacacgtctgtggaagaaggcctgcatgacttgcttcacccagacctggccctggccggtgactggatctactgcatcacagatattgacccagaccaccggaagctcagccagctagaggccatgatccgcttcctcaccaggaaggacccagacctggagtgtgacgaggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccacaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggcgcttcccccgctcctccatcaccctcagcctccacacttcaaagttcaagttcaaagctgttcaagtttcctaccagcaaatagccctaacttgcctctagagtaggccaaatgccaactctgtaaaacacacttacattataggttacagaatgtcactcttaccgtcatgtcttgcaacaaccctgtgaggacagtattaatgcccccttacagcagaagacactgcagctcggagaagacagcttaagtggcagaataatgctagaacagctaaggtttacatgtaccaaataacatgtttcagctcattccatcctcacaacagccccctgaaagtgggtactatcattagtcccatgttatagaaactgcagcagagttgaaaattgcctccaaattaccggaagagtgtatgaagattgaatgtgatgtattcacgtaacatgcttgaaactgcctggcatatactaaacgctaaataaatacatgctaactgcgatcattaaaataccttg

SEQ ID NO: 459897 - DNA, 3246 bp, Homo sapiens
tctgccctcgttgttttctggaatgggagcctcatcactgctgggcattttctgtcgctcttcttccagtgggaacgagagaggctgccgtctctgttcttcccccacccctcccactccccagaaaccccagtttgcactctgccctctgactcagtcctcccatccgctgcggtctctctcctcagttcctgcggaagcacctcctctctttaacttgactctatttttttctctccccgtctcttccctggccttgccctctctctttctgccctgtagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgtgagtgggggtagacacggggctggtggagggctgcatgcgagggtggcttaggagggtgtccttgagcaggaggctgcaaggtctccaggacaacccacttgctaccagaccccggggaaggagggcacaatccctgggcatggacgccacctcttccctgcatgctgcccctgggagggacctcattgctcaaccagagccctcaagcagggaagagggtgtcctggaggagaggggatgggccgggggctgtcagggatactccagctccttgggaacccaagtcgggagggctcagaggtctccgagattcagtcctgtgtctgacaggttcctgctggagtggagtgtctggggctcctggtacgacagaggggccgagggtgagtgcacggagctgcagggccatgtgctgaagagcagtggcattttggtgaccctgaagcatcgttgttcacatctcaccctgcgtggccttctctcatcacatccctcactcctggctctgtgtgtgacatcatcttgggacaccgccactccatgtgccatcatcaccaccccatgacatcctgccctcatgtgccaccatgttttcctgtgccgtgtccaccctgtgctgggcttatgttccggccagccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaagagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccacaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggcgcttcccccgctcctccatcaccctcagcctccacacttcaaagttcaagttcaaagctgttcaagtttcctaccagcaaatagccctaacttgcctctagagtaggccaaatgccaactctgtaaaacacacttacattataggttacagaatgtcactcttaccgtcatgtcttgcaacaaccctgtgaggacagtattaatgcccccttacagcagaagacactgcagctcggagaagacagcttaagtggcagaataatgctagaacagctaaggtttacatgtaccaaataacatgtttcagctcattccatcctcacaacagccccctgaaagtgggtactatcattagtcccatgttatagaaactgcagcagagttgaaaattgcctccaaattaccggaagagtgtatgaagattgaatgtgatgtattcacgtaacatgcttgaaactgcctggcatatactaaacgctaaataaatacatgctaactgcgatcattaaaataccttg

SEQ ID NO: 459898 - DNA, 3532 bp, Homo sapiens
tctgccctcgttgttttctggaatgggagcctcatcactgctgggcattttctgtcgctcttcttccagtgggaacgagagaggctgccgtctctgttcttcccccacccctcccactccccagaaaccccagtttgcactctgccctctgactcagtcctcccatccgctgcggtctctctcctcagttcctgcggaagcacctcctctctttaacttgactctatttttttctctccccgtctcttccctggccttgccctctctctttctgccctgtagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgtgagtgggggtagacacggggctggtggagggctgcatgcgagggtggcttaggagggtgtccttgagcaggaggctgcaaggtctccaggacaacccacttgctaccagaccccggggaaggagggcacaatccctgggcatggacgccacctcttccctgcatgctgcccctgggagggacctcattgctcaaccagagccctcaagcagggaagagggtgtcctggaggagaggggatgggccgggggctgtcagggatactccagctccttgggaacccaagtcgggagggctcagaggtctccgagattcagtcctgtgtctgacaggttcctgctggagtggagtgtctggggctcctggtacgacagaggggccgagggtgagtgcacggagctgcagggccatgtgctgaagagcagtggcattttggtgaccctgaagcatcgttgttcacatctcaccctgcgtggccttctctcatcacatccctcactcctggctctgtgtgtgacatcatcttgggacaccgccactccatgtgccatcatcaccaccccatgacatcctgccctcatgtgccaccatgttttcctgtgccgtgtccaccctgtgctgggcttatgttccggccagccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggtgcgggttgaggcggatcgagggtgggctggattttcatccccaaaccctctgtgcctgggtctgtgcccctctgctctgcgttcgcaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccacaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggcgcttcccccgctcctccatcaccctcagcctccacacttcaaagttcaagttcaaagctgttcaagtttcctaccagcaaatagccctaacttgcctctagagtaggccaaatgccaactctgtaaaacacacttacattataggttacagaatgtcactcttaccgtcatgtcttgcaacaaccctgtgaggacagtattaatgcccccttacagcagaagacactgcagctcggagaagacagcttaagtggcagaataatgctagaacagctaaggtttacatgtaccaaataacatgtttcagctcattccatcctcacaacagccccctgaaagtgggtactatcattagtcccatgttatagaaactgcagcagagttgaaaattgcctccaaattaccggaagagtgtatgaagattgaatgtgatgtattcacgtaacatgcttgaaactgcctggcatatactaaacgctaaataaatacatgctaactgcgatcattaaaataccttg

SEQ ID NO: 459899 - DNA, 2784 bp, Homo sapiens
tctgccctcgttgttttctggaatgggagcctcatcactgctgggcattttctgtcgctcttcttccagtgggaacgagagaggctgccgtctctgttcttcccccacccctcccactccccagaaaccccagtttgcactctgccctctgactcagtcctcccatccgctgcggtctctctcctcagttcctgcggaagcacctcctctctttaacttgactctatttttttctctccccgtctcttccctggccttgccctctctctttctgccctgtagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccacaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggcgcttcccccgctcctccatcaccctcagcctccacacttcaaagttcaagttcaaagctgttcaagtttcctaccagcaaatagccctaacttgcctctagagtaggccaaatgccaactctgtaaaacacacttacattataggttacagaatgtcactcttaccgtcatgtcttgcaacaaccctgtgaggacagtattaatgcccccttacagcagaagacactgcagctcggagaagacagcttaagtggcagaataatgctagaacagctaaggtttacatgtaccaaataacatgtttcagctcattccatcctcacaacagccccctgaaagtgggtactatcattagtcccatgttatagaaactgcagcagagttgaaaattgcctccaaattaccggaagagtgtatgaagattgaatgtgatgtattcacgtaacatgcttgaaactgcctggcatatactaaacgctaaataaatacatgctaactgcgatcattaaaataccttg

SEQ ID NO: 459900 - DNA, 2810 bp, Homo sapiens
tctgccctcgttgttttctggaatgggagcctcatcactgctgggcattttctgtcgctcttcttccagtgggaacgagagaggctgccgtctctgttcttcccccacccctcccactccccagaaaccccagtttgcactctgccctctgactcagtcctcccatccgctgcggtctctctcctcagttcctgcggaagcacctcctctctttaacttgactctatttttttctctccccgtctcttccctggccttgccctctctctttctgccctgtagccgcgggcgtccaaatgaagctggaattcctccagcgcaaattctgggcggcaacgcggcaggatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccacaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggcgcttcccccgctcctccatcaccctcagcctccacacttcaaagttcaagttcaaagctgttcaagtttcctaccagcaaatagccctaacttgcctctagagtaggccaaatgccaactctgtaaaacacacttacattataggttacagaatgtcactcttaccgtcatgtcttgcaacaaccctgtgaggacagtattaatgcccccttacagcagaagacactgcagctcggagaagacagcttaagtggcagaataatgctagaacagctaaggtttacatgtaccaaataacatgtttcagctcattccatcctcacaacagccccctgaaagtgggtactatcattagtcccatgttatagaaactgcagcagagttgaaaattgcctccaaattaccggaagagtgtatgaagattgaatgtgatgtattcacgtaacatgcttgaaactgcctggcatatactaaacgctaaataaatacatgctaactgcgatcattaaaataccttg

SEQ ID NO: 459901 - DNA, 1050 bp, Homo sapiens
  misc_feature (12)..(12): n is a, c, g, or t
  misc_feature (18)..(18): n is a, c, g, or t
gcccaattgccnactccntcgggacaatcaaccaacacccctttcaagtttgggggtggtgctgtcccggggccacggagaatacatccttctggggaacacgtctgtggaagaaggcctgcatgacttgcttcacccagacctggccctggccggtgactggatctactgcatcacagatattgacccagaccaccggaagctcagccagctagaggccatgatccgcttcctcaccaggaaggacccagacctggagtgtgacgaggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagccaggaatcaaactgagaaagaagcccattcaaacctgaagcaaatccagatatattcaccagatgtatttccttgaagcaaggcagaagcatcagaaccgcctcctgcctgagcctcggggaaaggggcatagtatttggttctgtgtgagctttgctactaattagaaacgtgatgtgggcaagcgaaaaacataaaaaaaaactgagactagtctccc

SEQ ID NO: 459902 - DNA, 3442 bp, Homo sapiens
tctgccctcgttgttttctggaatgggagcctcatcactgctgggcattttctgtcgctcttcttccagtgggaacgagagaggctgccgtctctgttcttcccccacccctcccactccccagaaaccccagtttgcactctgccctctgactcagtcctcccatccgctgcggtctctctcctcagttcctgcggaagcacctcctctctttaacttgactctatttttttctctccccgtctcttccctggccttgccctctctctttctgccctgtagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgtgagtgggggtagacacggggctggtggagggctgcatgcgagggtggcttaggagggtgtccttgagcaggaggctgcaaggtctccaggacaacccacttgctaccagaccccggggaaggagggcacaatccctgggcatggacgccacctcttccctgcatgctgcccctgggagggacctcattgctcaaccagagccctcaagcagggaagagggtgtcctggaggagaggggatgggccgggggctgtcagggatactccagctccttgggaacccaagtcgggagggctcagaggtctccgagattcagtcctgtgtctgacaggttcctgctggagtggagtgtctggggctcctggtacgacagaggggccgagggtgagtgcacggagctgcagggccatgtgctgaagagcagtggcattttggtgaccctgaagcatcgttgttcacatctcaccctgcgtggccttctctcatcacatccctcactcctggctctgtgtgtgacatcatcttgggacaccgccactccatgtgccatcatcaccaccccatgacatcctgccctcatgtgccaccatgttttcctgtgccgtgtccaccctgtgctgggcttatgttccggccagccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccacaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggcgcttcccccgctcctccatcaccctcagcctccacacttcaaagttcaagttcaaagctgttcaagtttcctaccagcaaatagccctaacttgcctctagagtaggccaaatgccaactctgtaaaacacacttacattataggttacagaatgtcactcttaccgtcatgtcttgcaacaaccctgtgaggacagtattaatgcccccttacagcagaagacactgcagctcggagaagacagcttaagtggcagaataatgctagaacagctaaggtttacatgtaccaaataacatgtttcagctcattccatcctcacaacagccccctgaaagtgggtactatcattagtcccatgttatagaaactgcagcagagttgaaaattgcctccaaattaccggaagagtgtatgaagattgaatgtgatgtattcacgtaacatgcttgaaactgcctggcatatactaaacgctaaataaatacatgctaactgcgatcattaaaataccttg

SEQ ID NO: 459903 - DNA, 3232 bp, Homo sapiens
  misc_feature (12)..(12): n is a, c, g, or t
  misc_feature (18)..(18): n is a, c, g, or t
gcccaattgccnactccntcgggacaatcaaccaacacccctttcaagtttgggggtggtgctgtcccggggccacggagaatacatccttctggggaacacgtctgtggaagaaggcctgcatgacttgcttcacccagacctggccctggccggtgactggatctactgcatcacagatattgacccagaccaccggaagctcagccagctagaggccatgatccgcttcctcaccaggaaggacccagacctggagtgtgacgaggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccacaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggcgcttcccccgctcctccatcaccctcagcctccacacttcaaagttcaagttcaaagctgttcaagtttcctaccagcaaatagccctaacttgcctctagagtaggccaaatgccaactctgtaaaacacacttacattataggttacagaatgtcactcttaccgtcatgtcttgcaacaaccctgtgaggacagtattaatgcccccttacagcagaagacactgcagctcggagaagacagcttaagtggcagaataatgctagaacagctaaggtttacatgtaccaaataacatgtttcagctcattccatcctcacaacagccccctgaaagtgggtactatcattagtcccatgttatagaaactgcagcagagttgaaaattgcctccaaattaccggaagagtgtatgaagattgaatgtgatgtattcacgtaacatgcttgaaactgcctggcatatactaaacgctaaataaatacatgctaactgcgatcattaaaataccttg

SEQ ID NO: 459904 - DNA, 3116 bp, Homo sapiens
  misc_feature (12)..(12): n is a, c, g, or t
  misc_feature (18)..(18): n is a, c, g, or t
gcccaattgccnactccntcgggacaatcaaccaacacccctttcaagtttgggggtggtgctgtcccggggccacggagaatacatccttctggggaacacgtctgtggaagaaggcctgcatgacttgcttcacccagacctggccctggccggtgactggatctactgcatcacagatattgacccagaccaccggaagctcagccagctagaggccatgatccgcttcctcaccaggaaggacccagacctggagtgtgacgaggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcaggatctggactgcttcgtcatcgacaacaacgggttcattctgatctccaagaggtcccgagagagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccacaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggcgcttcccccgctcctccatcaccctcagcctccacacttcaaagttcaagttcaaagctgttcaagtttcctaccagcaaatagccctaacttgcctctagagtaggccaaatgccaactctgtaaaacacacttacattataggttacagaatgtcactcttaccgtcatgtcttgcaacaaccctgtgaggacagtattaatgcccccttacagcagaagacactgcagctcggagaagacagcttaagtggcagaataatgctagaacagctaaggtttacatgtaccaaataacatgtttcagctcattccatcctcacaacagccccctgaaagtgggtactatcattagtcccatgttatagaaactgcagcagagttgaaaattgcctccaaattaccggaagagtgtatgaagattgaatgtgatgtattcacgtaacatgcttgaaactgcctggcatatactaaacgctaaataaatacatgctaactgcgatcattaaaataccttg

SEQ ID NO: 459905 - DNA, 1811 bp, Homo sapiens
tctgccctcgttgttttctggaatgggagcctcatcactgctgggcattttctgtcgctcttcttccagtgggaacgagagaggctgccgtctctgttcttcccccacccctcccactccccagaaaccccagtttgcactctgccctctgactcagtcctcccatccgctgcggtctctctcctcagttcctgcggaagcacctcctctctttaacttgactctatttttttctctccccgtctcttccctggccttgccctctctctttctgccctgtagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgtgagtgggggtagacacggggctggtggagggctgcatgcgagggtggcttaggagggtgtccttgagcaggaggctgcaaggtctccaggacaacccacttgctaccagaccccggggaaggagggcacaatccctgggcatggacgccacctcttccctgcatgctgcccctgggagggacctcattgctcaaccagagccctcaagcagggaagagggtgtcctggaggagaggggatgggccgggggctgtcagggatactccagctccttgggaacccaagtcgggagggctcagaggtctccgagattcagtcctgtgtctgacaggttcctgctggagtggagtgtctggggctcctggtacgacagaggggccgagggtgagtgcacggagctgcagggccatgtgctgaagagcagtggcattttggtgaccctgaagcatcgttgttcacatctcaccctgcgtggccttctctcatcacatccctcactcctggctctgtgtgtgacatcatcttgggacaccgccactccatgtgccatcatcaccaccccatgacatcctgccctcatgtgccaccatgttttcctgtgccgtgtccaccctgtgctgggcttatgttccggccagccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggtgcgggttgaggcggatcgagggtgggctggattttcatccccaaaccctctgtgcctgggtctgtgcccctgcagacaggagcatatagggatgccaatgaacacacctgtgcctgtgcttctcgggggaaacattcgcgtttatgccctgtgacactgtgatataataagaaacagatctt

SEQ ID NO: 459906 - DNA, 912 bp, Homo sapiens
ctacacatggacagcaaatcctatgctcactggctctaccttctgctttgcttgtttcagagctagtccatcaggctctaaatttttaaacgtaagcagaagaatgatgaaagagatggggccaacactctcagagctgagcactgtggaggcggaagatacagagagctccattgcagccacagtgatggatggcatcgatagagaaaatcccacaaaagagcttgacttttctcatgaatctgcagtttcttccgaaaaagtgaaattttatcaaatgatcttgggaagcccatctaagggcttccaaagagaaaatgctacttatcaagaatcatgcctttcctgttgcagagtagaagtaaacaaaatcaagaaatctccaatgctcacacaattttaacaggtttggccaatacaacagagacgtgaaaaccaacagatgtcccccaccaatccaggaatgagtgaattcttgctctatcaggacctgtgagacttccctcaagagctggttgttaaaaagagcctaggacctcttccctctcttgcttcctctcttgccttgtgatcttcacatcctgactctccttcaccttccactctgagtggaagtttcctgaggctctcgcaagaagcagatatcggcaccatgcttcttttacagtcttcatagtcctgagaacaaaacagttcagatcaactcaacaatattccaagtgggctttgcagagcatcttctggactaagtagaaggagaaggagaaggagccagaccttccctgtggccatgctttctctaaaacagccctgatgacttactttttcaggttgaggtctgagtaagcctccatattatgtaataataattatattattatgtaataatataaaataatgatatcaattatc

SEQ ID NO: 459907 - DNA, 890 bp, Homo sapiens
ctacacatggacagcaaatcctatgctcactggctctaccttctgctttgcttgtttcagagctagtccatcaggctctaaatttttaaacgtaagcagaagaatgatgaaagagatggggccaacactctcagagctgagcactgtggaggcggaagatacagagagctccattgcagccacagtgatggatggcatcgatagagaaaatcccacaaaagagcttgacttttctcatgaatctgcagtttcttccgaaaaagtgaaattttatcaaatgatcttgggaagcccatctaagggcttccaaagagaaaatgctacttatcaagaatcatgcctttcctgttgcagagtagaagtaaacaaaatcaagaaatctccaatgctcacacaattttaacaggtttggccaatacaacagagacgtgaaaaccaacagatgtcccccaccaatccaggaatgagtgaattcttgctctatcaggacctgtgagacttccctcaagagctggttgttaaaaagagcctaggacctcttccctctcttgcttcctctcttgccttgtgatcttcacatcctgactctccttcaccttccactctgagtggaagtttcctgaggctctcgcaagaagcagatatcggcaccatgcttcttttacagtcttcatagtcctgagaacaaaatctaaatcctaggattccttgacattctgttactgagagtctgcagtctcaagactttaaggataatagttccaaaggaatgttatctgtacgttttttctgagtaaacacttccatttcaagcaaaacatttgggattctatttgttggctgtttctccagcttccatttccctccccctttttttttctgccatcagc

SEQ ID NO: 459908 - DNA, 1963 bp, Homo sapiens
gctagcagcctccgggatttaaactacccagcttgcggtcctttgttatggcagccatgggaaaagactccagcagacagcaacgcaagggggcatctatgcgattgaccatggccggaagcacacctccatgcgatgcggtgaggggacaaactaatgcaggaacagaaaatcaaatagcccatgttctcacttataagtgggagccaaatgatgagaacacatggacacagaggggaacaacacatactggggcccacttgaggttagagggtggaggagggagaggagcagaaaagataactattggagttgccccagctgaaaaccttctgcagagcccagtgcagaaggaagatgtggagcctcagccaggaccagggaagtcaatccccccttcccacaagcctgtggccccaacctacagtggacaggccaccccaaagggatccagggtggtcaagagccctggatcaccagggaaaagatttcttgactccacttggggaggaatttatcttgattgaatgtgaacagttagatgagttttcgtaaatgtatacagttgtgcctgagggaactgctctgtgagctgacaaccaaaggataggagtaatttaatgagacaaaggaagtaaaaaactgctccaggcagagatgatggcgtgagcctctgcagggagcatagcacatttaaggaactcaggtgaatcctgaattgccatgaaagggcaaaatatgtcaccccagttcattcactgtgcttcctatttcatatttaatatttctttccaaacatgtgagagtcaacagcatattaatgcctaaatgcataaactctagttatgcaaaacacttgtctagaacaactcagtccctgatggtttactcaaggttttaccataacaagaagtaaatattaggattgtaaaattcagaatggtccctgagggggaataaaattgtaataaaaaaatttcctcctttttcaggtcttgtttcagtgagaatgtaaagtacgtgagctatgtgctttgtgatgaagtcgttgatttatttcactttggaacaagcacaccacaacaaagtgagaatgagaaggtaattcagagggagaagaaggaaacggaactgtacgtagaaatatatcctcatatgaacttagattctgaaataaatctaggttgtaaaaacaccaaaaggctgtttccatgagccacgtttccctttgtaaaggtaacataaatttccacttgtaaaggaattgtgaagtggtgcctctctccaataccagaagaggagaataactgttaatcactggagatgacttatcactggagacattaccaaggtcctgcctcttgcttcttttgccctggtgttaatcccatgcagctggtgcagaaacagaaccaagagcttggaagtcacaaggtggcgccaccccaactaggactgttctttcaaagcccagtgcccagttggtgaaatgacccaccagcattgcacaggagagccccagagagatatgtccaggatatacgatcagtctggtgttctgagccttaaggtatggttgcagcgatgacgcattgcagaaccaaaggaatttgtccttaggatagaccttccaaaggccgatcaacagcgacaaaaaacaagctttcaaaccaacaagagaagacatgattgcagtgccttcataacgacattgctttattgatgaaatgcaaggaaaactacgttagaatctactgattctctttgagatctaataatacgctttattcaaatcttattcacaaaccacttcctccacgggtctttcacaggaactgaaattggccagttacaaacagaattggttctactgtcctttgaaatcacagacgcagacatgttttagaatacaaaagacaccaagctttctttgggaaacacgtcctgtttggaaaaaaaaaaa

SEQ ID NO: 459909 - DNA, 1096 bp, Homo sapiens
ctggcggcggatggaagccgttgtgcagcagcccgttcacagcggcggcgctggtgcccacgggggcccctggagagtgcgggaccgagcgctcctgctgcccgctgcggtcgcccatgccgggggctggcggggctgtgcgcgggccccggctcaggcggcctcgctggaggtcattctccggcgtctttatttccccggatcctccctgcggcttccgattcagcagccgcagagccggcgcctggggatggcgaacccggcgctcctcccctcctcctgccgactcccccacctcctctgcgccctgccccccgcgcgccggccccacggcgccggcctggagcacgccagccccgggcgcggaatcggggatccccgcgcacccccagccggggctcccgccgcccgccttcccctgatccccaggccgcgcgacttcaaacgcggcttcctcgcctcccagactggtccccgccactgagcatgcccagtcctgcccgccaccgccaccgacgagtttcaacatggggaatcaagttctctgggcttgcagagaggagatgggcgggttgggctttgtatggcgatgtgaaaaccagatgggtctgggagagacagcgaaaggagcgaaccgtttcaggaggaatacgggaggaagacaattatttgcagaggtgtcaggggatttgatgcagatgatcatcatggcttggagaaacaatgaaggaagcaaagtatgccatctatgctgcgggaggtaactccagaagaccccagagagaacgagtttggacttttaactgagggccattggaaactactgaagagttttaggcagcataagaactactagattttcattgtgggaggatcctcagcagcagcctcagaaaggagattggggaaggagatccctagtcagggagaccaagaagactactggaaaaaaacaggggaatcctcaaggacctgcaaacaagaaaccaaatccccccactccccccagccaaaatgtgttcattttgaccagctgtgtgtgtgttttaaattaaaagtttgaattagaaagcaagtaggataaatttatatactt

SEQ ID NO: 459910 - DNA, 3718 bp, Homo sapiens
ctgggacctgtcccgcgtccacgtgaatgcggggggcagcattcaccatcccctccctgaaacagcgcccctgcatggtctgccctgagcggcggggacgcacgaagagctccctggctccaccagcccgttccccagatgcaggacctcagatcagcaaggacctggagcccccgccccacggttgccaggaggcggacaggggcggctcctggggggctaccaccccgaggcctttccgccagaacttgagcgacttgggaaggcacagtgtcctgcccttgaagaggaacctgtgtcctggaggcagcagcctgggagctcctcctccgaggacaccgcagaggcgagtgactctggcggcgcagcgctggctttcccgtccgcagaggagagctgtggggctgggtgagctggaccagggagcacggctggctgctctcggcctctgatggggagtggacagcttagggggttgcccccgtgccagccagcctgctggccactctgggcttcatcacagcctcacctgcctgtgccagcacctagcactgaaggctggagcttctggccatgctggtcaacttccccaacgagcctctgctgcctgggaacagcaaggccagagctacaccgtcctgcacttggcagccatgtaccttggagatggtgaagctgctagtggggacataggacgccgatgttgacatcagggaatacattgggaaaagggcctcccagcatgacaaaaaaaaaatgcaaattgttacaaaactggtagtatttgtaagtgcaagcactacacgctgctttgttcttttaccaattgcatttgcattttaaggtactactggtacagccatggtggagaacagtttggaggttcctctaaacactgaaaatagaggtgccacatgatccagcaatcccactgttggatatataccccagaaataagaaatgagtatatcgaagaaattatctgcactcccatgttggttgcaccactgttgacaatagctaagatttggaagcaacctaagtgtccatcaacagattaatgtattaaagaaaatgtggtagatacacacagtggagtattattcagccctaaaaaagaatgagattcagtcatttgcaacaacatggaaggaactggatatcattatgttaagggaaataagccaagcacggaaaggcagacattacatgttctcacttatttgtgggatctaaaaatctaaacaattgaactcatgaacatagtaagtactgggggctgggggggggggagacagggcacgggtaatgggtacggaaataggcagaaggaatgaataagacatactatttgacagcacaacagggggactctagtcaataattgtacatttaacaataactaaaagaatctaattggattgtaacacaaaggaaacatgcttaaagggatggataaccactctccatgatgtgattagttcatgctgcatgcctgtatcaaaacatctcatgcaccccataaatatatatgtttattatatactcacaaaaatgcttgaaaataaaaataaaggaactactgaaggtcaggtcagagtggaaatgtaaaaatactaattagagaataatgtgaatacaacaggaatcctgttggtattctgtttatattgtaagcagcagttcaattgttttgtaaaagtaatttcaattttaatcactgaactaaagaaatgggcaaggctgacttccgtaatatatgttctacctaaccatctctaacaccgctgtcaaggaggaccagtgttaaggtacattactaacaaccacacaaatttttaaaagaaaagaacactcttagcagcctatggtactttgaaatgaaatattgcctctcattctcacttgtgttgccattccaaaagtatgaatttgctgaggtttatattctgggtattatataaccattggttctgtttggcataaccctattaaatggtgctcagagctgaattacctacagaaactttctggtttaattagcataaattggtataaatattagtgagcccatacttctgtgatataattaaaccaacttaatgattctcacataaggtgtcaatttattttactaatgcattcataatctatgctttgtagcaacatttttcaaatgtttaaaatgctaaatcttctcaattttccaatcttttcttgaatctattagatacctatagtgtagttactgaatagctaggagacaaatacacctagttagaaatggcactgctttataaaaggcactagagaaaagacgagactattcctatatttaaatgctgctggcaagtgaattcctttgtatataaatgaaagataccattcattaaaatgaaagacgtgttttaagtatgattcttacatttcattcatttatgatagagtaaatggctttataattactttaaaatttaactcactagtacattaaatctgttcattgcaagattagaatcaactgtgaggggaactaatttaaacaagcccttccttagtcttattgagtctcatatttgctgaaagtacctacagcttgcaggataagggagttcacggaccatagggtgagtgaacccatgcacaaattgcaaactgcccagagctactacatttaggatttttagacctttaattttccaagtcatagaaatttgttacaggttcatcacatctttgtctacatggcaactgaatttctttaaagataggttaaaaaaaggcataaaactatgaattattatccatttgtgtgcctctatttttgctttagaattatggaaatggaccctgtgaatttgggaaacactgttatgtatacacatgggtgaaaaacaatctaacattgtgtaaattaaaatatttttttgaagttgaaaaacatccatttgttctaaatctatatatattatgtgtatctagtacagaataaggtgtaacttctcattcattaatcttaggttttacagatacgtaaagctgaagcaactctaaagagtagacacttcagaacaggaaggttctggtcaatgttgagagtagacactttcactgaaggttctggtgaaatgtgggtaactaattgcttgaaatctgtaatttgctatatagctaactattaagttaaaatgtcatttaccatgccttttacactaaaagctttaacttttgtgagaaaataatattttaaatgttcaattattacttctgaggaaagctacttctagcattctttgtcatgatgtgcttgtgtgcagtaagcagagcattttcagccacttacctctacaatgttcctgtttttcaatttctgatttagattataaaaggcaaatgattaatttaatttgatactcagagttgtgtttacttttaatggacaaatatatgtcagatactttgatgtttattgatatgacaccgtgtggttaaacaacgcaagtatgtccacgtgtttcttatagggtacacttgaaactaatgatgtttatgcagttcacttatgtaacttgaaaatctggtactattgcattcaggactgaaatcttggagtttaggtgtcttgtctctcattttgaaaataagtgaaagttgagaatgtaaaatctataaagttcatttttttaactaggaaaaaaacacaaattaatgacagaca

SEQ ID NO: 459911 - DNA, 467 bp, Homo sapiens
ctcccattttgaaacccttaataaaaacttgctggtctgagactcagcaggcagcacagacttactgatatgtactgtcacctccagcggcccagctgtaaaattcctctctttgtagtgtctctctttatttctcagctggctgacacttatggaaaatggaaagaacctatgttgaaatattgggggcaggttccatcaatagttcttacatggatttacttattttttgtctccctccataccctagaaactcctggagggcagagctgtgtctgccatcttcatcattgcattaccaccaccaagcacagtgcctggcacaaaagagttgctcaataaataaatcaggatgaatggataaatacatggataggcactttgagctacagatgagtttaaatactttgtgtttttcttagtcaaacatgtgcaattaagcatgtgataaatgatatgatgaccac

SEQ ID NO: 459912 - DNA, 1156 bp, Homo sapiens
agcaggtgagtggtaacaggctttaatcctttcaaagcatgctgtgggatgagatattggcattgagcgggagcgtctgtgatggtcctgtaggcttccgaggcgatcgattgggcagtgtcggtctgcagctgctaagccaagaagatctgggaaggagtcagtcagagagccttgggctggagttccaggggctctgggagtggctgccaggaaacactgaagactgccaggagaccacaggaagctacgaagaggcaaggcaggactccccgacaagtgcaggagggagcgtggccctgctggcacctccgtttcagactgctggctaccagagccacaagacaatcaatttctctggtttcaagtcacccagcttttggacccgtggcttgcttctaatctatatctatggaaaagttgaagggattttgcagatgtaactaagcccctaatccattcactttgagttaatcaaaagggagattattcagggtgggcctgacatcttcagacagacaaggggaggggctcctgtgatgggatcagtcagatgcctgcctggccgctccccctgaggggacttgggctcctcttaacattggcaggctggtataaacttccggctcagatcaagctatgcctgatgctgccttaagccttatgaggtcgccacggaaccgcagaaactcctggagggcagagctgtgtctgccatcttcatcattgcattaccaccaccaagcacagtgcctggcacaaaagagttgctcaataaataaatcaggatgaatggataaatacatggataggcactttgagctacagatgagtttaaatactttgtgtttttcttagtcaaacatgtgcaattaagcatgtgataaatgatatgatgaccacacctgtgtgttgcctgatgttctttgcaatcactaaatgaagtcaattgtgcctgttttgacagttctgttttcaacctaatgatctgtttcttttaacttctggctgttggctttgtttgggtttgttagcctgacaaagtggcagacattagtatttgctcttttgtttaaatgtcatgaactttaaaaatgcctttgcttttgggtcacaatatggcaaccagagtgtcagttggagctggggtctcatc

SEQ ID NO: 459913 - DNA, 1141 bp, Homo sapiens
atagctatgaagaatcatggtcatgtattttataaaacattcttcacagtttaaaaggcaatcacccaaaaccaaccgtggctacccattcaagactgtttccacactgtggaagctttgtactttcactctgctcaataaagcctgcagctttttctcactctcagtccatgtctctttcactcactgtggtcagcttccacaccatttctttggtgtggcttggcaagaacctcaggtgttacatcttggcgagccagacaggagactccagaaaaggtatctagatcatcatgcagatcaaagccatcaagctacaaatgatcttacaaatggaacctcaaatgagctcagctcacggcttctaccgaggacccctggatcaacccgctggtccctcaattaccctagaaaattcccctctggaggacaccaaactgcagggccccttcttcacccctaaccagcaggaagtagccagaacgactgccacacggttcccaacagcagttggggtgtcctgtttagaggcaggactgagaggaggtgccagctgggcttcctgggtcaagtaggggctcagaaagctgtgaaactcactcatttcctgcatcaggacttacttcagtcctggatgaataatattgaagatatacgcttaaaatattcctaacaccaggattcgtgcatgtgttttcttccccaagaaagctataaacagtgaaaaatttgctgtaagtttccctgtatcttctctccctctctcccttcccccgcccctgaaactaaaataaaggaatgttaactgctcatttttctgtgaccagtggaccttatctacactcccaattcagattccttgtaaacatactttgtaaagtcctgtaagatcctgtctcctttgccatgctgctgcaaggtcctaaagtagataaaacctaagttgcaattccggttttcctcaaaatctaagacatgtcacaaaataatttactgcctttgtttccggctcctgtaacaagcttcccacctcatgtatctcccgctttaaagagtttaaaaggcaatcacccaaaaccaacagtggctacccgttcaggacccctcccatgctgtggaagctttgtactttcactctgct

SEQ ID NO: 459914 - DNA, 1122 bp, Homo sapiens
atagctatgaagaatcatggtcatgtattttataaaacattcttcacagtttaaaaggcaatcacccaaaaccaaccgtggctacccattcaagactgtttccacactgtggaagctttgtactttcactctgctcaataaagcctgcagctttttctcactctcagtccatgtctctttcactcactgtggtcagcttccacaccatttctttggtgtggcttggcaagaacctcaggtgttacatcttggcgagccagacaggagactccagaaaaggatcaaagccatcaagctacaaatgatcttacaaatggaacctcaaatgagctcagctcacggcttctaccgaggacccctggatcaacccgctggtccctcaattaccctagaaaattcccctctggaggacaccaaactgcagggccccttcttcacccctaaccagcaggaagtagccagaacgactgccacacggttcccaacagcagttggggtgtcctgtttagaggcaggactgagaggaggtgccagctgggcttcctgggtcaagtaggggctcagaaagctgtgaaactcactcatttcctgcatcaggacttacttcagtcctggatgaataatattgaagatatacgcttaaaatattcctaacaccaggattcgtgcatgtgttttcttccccaagaaagctataaacagtgaaaaatttgctgtaagtttccctgtatcttctctccctctctcccttcccccgcccctgaaactaaaataaaggaatgttaactgctcatttttctgtgaccagtggaccttatctacactcccaattcagattccttgtaaacatactttgtaaagtcctgtaagatcctgtctcctttgccatgctgctgcaaggtcctaaagtagataaaacctaagttgcaattccggttttcctcaaaatctaagacatgtcacaaaataatttactgcctttgtttccggctcctgtaacaagcttcccacctcatgtatctcccgctttaaagagtttaaaaggcaatcacccaaaaccaacagtggctacccgttcaggacccctcccatgctgtggaagctttgtactttcactctgct

SEQ ID NO: 459915 - DNA, 551 bp, Homo sapiens
ctcgttgttttacttctaagaaactgaaggcatgatattctgaagactagaggtgattcaatagcctatgaatcttcttcatttggaaccccactgggcctgatctgtttcccatcaccaatgcacttctgctaaacctatatcctatcaagtactctccctaaatgctcagagaccataacagaagatgagggtgtgtgagattataaaagccaaattagtggagtggaatctggaggctaaagcaactccatcttggatgctaatctgccatgttggcttctgattaaccccagttctggagggcctctgaggtttccaatttatctactgtcccttgtgtaagaacaagtacttatcataaatcctgctattagggcaaatttctacccattccctctgaagcatgtgcacctctcctctacatgtaatctcccctacaatagataaacccctctgggtctgggggctaatagtgtgggaacccatcatcttgcctcactgctgcacaagccacaggtgtggcttctgtttctaagtccctattaaat

SEQ ID NO: 459916 - DNA, 1657 bp, Homo sapiens
atagctatgaagaatcatggtcatgtattttataaaacattcttcacagtttaaaaggcaatcacccaaaaccaaccgtggctacccattcaagactgtttccacactgtggaagctttgtactttcactctgctcaataaagcctgcagctttttctcactctcagtccatgtctctttcactcactgtggtcagcttccacaccatttctttggtgtggcttggcaagaacctcaggtgttacatcttggcgagccagacaggagactccagaaaaggggtgattttcctgtaccagtccaatgcctccagaggaagatcatacatttgccattttactgcttagtacgcatgcttgagcctgctcgcccaactgctgagatcttattcagaaactgctgatcaccaactccaggtgtttttattacacaagacaaaaacggaaaaacagtaacaaatgattggttaagcctttcaaaacaaagaagttgaaggtcactggaataggttcattacactcaagcaaaggcctggggaaatgatagaattacctctgttgacccagaagagcaccaaaagcaccagtgtgcagaaatcagagacctcaagctaaaagtcataaaaggacaagaacctggaagtcgtcgaactgtggaagcaaaagacctgtaatgctcctgcttgccgagctgtgagcagtggtagtaaaagagcagtaacattctctcctgcttgccaaacaggagagaagccactggcaccactccctcccactcactgaactatagaagagaaaaaattgaaacaccaaaattggggaaatgcgacttttgcgaaaatttgaaagtgcatgcttcacagaaggaagggggagctggtctattatgtctcactataacaagactaaaattttgcaaataaattgttcctgccataatttatccttggtagaaatgaagaaattggagagagaaaaaattggattctaggtcctgaccattgtttttgaatttttattattttcctacaatttaggctaaattctgaactatttgctggctacaagaggcctctaaaaaagagctgggttttagttttcttcatgctctttaaagcatgatattctgaagactagaggtgattcaatagcctatgaatcttcttcatttggaaccccactgggcctgatctgtttcccatcaccaatgcacttctgctaaacctatatcctatcaagtactctccctaaatgctcagagaccataacagaagatgagggtgtgtgagattataaaagccaaattagtggagtggaatctggaggctaaagcaactccatcttggatgctaatctgccatgttggcttctgattaaccccagttctggagggcctctgaggtttccaatttatctactgtcccttgtgtaagaacaagtacttatcataaatcctgctattagggcaaatttctacccattccctctgaagcatgtgcacctctcctctacatgtaatctcccctacaatagataaacccctctgggtctgggggctaatagtgtgggaacccatcatcttgcctcactgctgcacaagccacaggtgtggcttctgtttctaagtccctattaaatgtttctagataccagaaata

SEQ ID NO: 459917 - DNA, 1249 bp, Homo sapiens
agcacaggatatccaaaagttctgttctctctcagaggacatgctgtcccaaaatatggcactttggcatataaaatgttttaagctgaaggaatttgagaaacagcaggtgaaggaaagattttctgaccctcccctaatgcaggctataaaaccctcacatgagaagtaccctccttatgcccagagaaaaggaacatctttgtctccaaagacacagggacacggagatgatgaacaggccttgctaagtttcctccactctattacccttagcttgtacctttatccaaccacattcttccatgactctccagtcttcatcaaacctggcataaaaacactcagacttaaccacttctttgggtcttcatttccttatgaaggctccagtgcaggtattgtaaaaggtaccacattccaaactctccaatttcagtgtggaactgaaggtttccagaattctggagacaatgaaataagatttgcacactgtgacaacacaggtctctaacagcgaatccaagactgggatttttttaaagctctcttcccttccccaccttgagtgtacaatggagagtgctagtgtggtgtcacatggtgcaacatggctcagtgttgtgtgaaactaagatttggggcatattttataatgaacataacatatgagcataacagtcgtgattaacgtatacaattaaagatatgtggaaatgactccatctccgaccacacatcctctgagtaattttgatggggatggcttatgttctactgccacctcgtggtgggcattctgtgaacatgcatcttggaacagtggggagaaccagtttggacttctgaggatccaaaagcccaagaaaaaaatctgagttctcacgacaaagtcacttcctgctacaacacctggaaaatgtcatgacccgagctagtctcacttcagagtccctggtttctagtacggtgcctgacagatagatgactttctttatatgttgctgaagacaggcagagaggaagaaaggaagagaggataaagggaggaataaacttgatataagcatctttgcataattaacaactgggtcaaattttcttcatttcattgagattcttgatacaagcctctgctgatgaattggattccaaaaaggtagttacaatttacatttatgccaagtgcaagcacatacatttattacatctttgctaaaatcataattatctttaaaactttgcccaa

SEQ ID NO: 459918 - DNA, 1288 bp, Homo sapiens
agcacaggatatccaaaagttctgttctctctcagaggacatgctgtcccaaaatatggcactttggcatataaaatgttttaagctgaaggaatttgagaaacagcaggtgaaggaaagattttctgaccctcccctaatgcaggctataaaaccctcacatgagaagtaccctccttatgcccagagaaaaggaacatctttgtctccaaagacacagggacacggagatgatgaacaggccttgctaagtttcctccactctattacccttagcttgtacctttatccaaccacattcttccatgactctccagtcttcatcaaacctggcataaaaacactcagacttaaccacttctttgggtcttcatttccttatgaaggctccagtgcaggtattgtaaaaggtaccacattccaaactctccaatttcagtgtggaactgaaggtttccagaattctggagacaatgaaataagatttgcacactgtgacaacacaggtctctaacagcgaatccaagactgggatttttttaaagctctcttcccttccccaccttgagtgtacaatggagagtgctagtgtggtgtcacatggtgcaacatggctcagtgttgtgtgaaactaagatttggggcatattttataatgaacataacatatgagcataacagtcgtgattaacgtatacaattaaagatatgtggaaatgactccatctccgaccacacatcctctgagtaattttgatggggatggcttatgttctactgccacctcgtggtgggcattctgtgaacatgcatcttggaacagtggggagaaccagtttggacttctgaggatccaaaagcccaagaaaaaaatctgagttctcacgacaaagtcacttcctgctacaacacctggaaaatgtcatgacccgagctagtctcacttcagagtccctggtttctagtacggtgcctgacagatagatgactttctttatatgttgctgaagacaggcagagaggaagaaaggaagagaggataaagggaggaataaacttgatataagcatctttgcataattaacaactgggtcaaattttcttcatttcattgagattcttgatacaagcctctgctgatgaattggattccaaaaagatattgttgtccaggccacaccatacgggacttaccactcccagttgctaacatctgcacgtatttgcctggaggtctcctctggtcaccagatcctactctgcctgggccacatgacaaggtgatgtg

SEQ ID NO: 459919 - DNA, 1870 bp, Homo sapiens
gaacagtccatggggcctgaggctcctgggaatccgccgaacctccaccgcccccgctgcctccccaaatgtccggcgcctggagtataagcccatcaagaaagtcatggtggccaacagaggacctaggaatctaacttcttgtttctttgccctctaggtgagattgccatccgtgtgttccgggcctgcacggagctggcatccgcaccgtagccatctactctgagcaggacacgggccagatgcaccggcagaaagcagatgaagcctatctctatcgccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgggcggagctcgagcagagggagatgccagctcacctgtgcacaggttctgcctggtgcctggggctgcagtgccaagttgccacagcccggcagttagggaggacccgcatgtgggctctgaagtggacatagagtacacggaggcaggcagtgcccagaggaggggcggcgcctcccaggggaagagactgctgggcgcccaggtcaggaggaagccgtgagggtgggagcggggagcaggctggcttggtggagcaaaacgcagggacccagacacaaagccagcccctgaccctccagctcccacaggagccccacgcctggctgccgacggagcccaagcaccacctcccatctgagggatgggctgacatggcaggacctgggggtgggggtggcaaaggactgggcccagaggtcccaatggagtctgagccaagctcaggggcccatcaaggatgggggagggagtcggagatggcggcacaggagggagaccgagaggtgttccggagcggagagggcataggatccgcctggataatgttccgccttccaaggagccgtcatctcgccccactacgactccctgctggtcaaagtcattgcccacggcaaagaccaccccacggccgccaccaagatgagcagggccttgc

SEQ ID NO: 459920 - DNA, 1216 bp, Homo sapiens
aaaactctaagttactaccaagcacgtctattgtctttacggatgaagacctgcacgcaagctgcatctcacagtggcatggcagccacacaccagaaggcagtgaaaataattgcatacaaaaatggggatgggtatcgtaatgggaagttaattgtggctggaacattccccatggacaaatccttgaaactcctcagcgtggccctttataatcttgttctctggcggcgagtagcggcatgtcagccagccaccatggttcctaccaagagccctgtgcagcccgtggtggttgaaggaggctggaccgaacagactcaacaggaaattaaactcatggaacttataagacatacagaggcacacctttctgaaatccaagaaatggaatccaaaataaattttccaattgcaaccaaacgtatagcagtcaagccgagcaacctgtataagcagcccaacacaaaacgagtgtggatttatctaaatggaggcagacctgaagatggcacttatgcctggggcaaaactatttcagagctgctgcaagactgctcctctcgtctcaaaatgacccacccagctagagcactgtacacccccagtggagagccaattcagtcctgggacgacatagagcgagatatggtcatctgtgtgtctatgggacatggtttcaaaaccccaaaagagttaaaacaactgatggagatcagagcaaattatgccagaatccgaaggcagcagggccctcaagccacagacattgtggtgtcaccatccacgaagctgctgtctctggcacatctccacaattaactcctatcagaaccatcggattttctgctgtatttttctggaaagaaaactttctttacccacttataaacagaagactgtgacaagaaggccaattatttccatcgctgaagactctaaatttggcaaatcttctaaataacaatcctgcatagtttattaaaaaaaattagtcgtaaaatttatccttcaaaaatctgcattttaaataaaccctgacagtgatttctcaagactgtaaagatattagtctgagaatgcaactctaacagactgctctgggcatcttttctctttgccttggccaggcctctcagaattgagtgagcgtgtgactccatttgcacagtgggacagatgagtacaactgaaataaaaagtggaggcctctgca

SEQ ID NO: 459921 - DNA, 518 bp, Homo sapiens
cagatagttcagatttccggtcagtcttagtaaagaccccttttataacattgataaaattttatcacagagctatgaaaacaaaattagatttcataactcacatcaggccttgaaggggatgcctctataaattttacaaaccctatcaagtttaatgcacctattctgataattttttcaatagcaaattctactgaacttcatatatactatgtgtgtatataaatgtgtgtatgtgtgtgcgtgtgttcatgtatatacatatatatagatttgtttctctctctaccttacaggaaagaaaactttctttacccacttataaacagaagactgtgacaagaaggccaattatttccatcgctgaagactctaaatttggcaaatcttctaaataacaatcctgcatagtttattaaaaaaaattagtcgtaaaatttatccttcaaaaatctgcattttaaataaaccctgacagtgatttctcaagactgtaaagatattagtctgagaat

SEQ ID NO: 459922 - DNA, 1725 bp, Homo sapiens
tcctgtccctgaccccagcttcactatgtgtccacaggagtgctttcactggtgctgtgactttttacaagctcattatgggaatatgactattaggtgggctaaaaagagcacagcattgcagacaggcaagaatagcagattaaaaggcaaaggtggtgtagcagctgggccagttttggagtctgcaaagaagttaggagaggagagactgggagaaggattaaagacccaaaatgagagacctagattaaagacctacaatactcccctcaaaaacaatactataaaagtactagaagaaaatataggatctgatgtttcatatactttcagtagggaaggccttcctaagtaccacaagaaacctaacttgaaacttgaaatttctaaaaataaaagtaaccgtctcagtcagttttgtgtttgctataaacagaataccatagactagctaatttatattcccaatatggagatatctagactgttcactatgattttttttctttttcaagtttttttcaagtttccctatggtacatgtccatttatcctgatctgtaaaatggggatattaaaatcagtttaaatcatataacttgcagttctgtaggtctaatatggtaaaaaaaaaaaaaaaaaaagacaatttcctatgatctttcctaatagtacctattccataaagctcatgagaaaattaaaacatctaatgtgtctaagctcttagcacaatataaatatgctggaataagcttctataaattttagttactattcctactgttattaaaataagaaaagccaaaaagtattaggtcaatatgcaagtgaagaaatacattcaaaataatactatccagtagccaaagtaattcagaataagttacttttttaagtttctcaaagtaagaataattagcctttatttgcctttctggaaaataaatgttgttgaaacaatatgcatgactttgtatgcattcaatgcaataatctttcaagaaatcaccccagaaatattttgatactgcctttagctcatatcattaaaaggttttcagtatccagctttaaattataacattgtacagttttaatatagttattttgttccataacaattgagaccaaaaagctgagagaattactgaagtggattcaaactcaaaatatctaaaatctgaatagactttggggaagactaacatcgcaaattgcaaattcgtccaattgattttagaagtataatctattcaatgaagcaatcataataaattcagaggatatttaatctctgagaacttgaattttatgactatgaaaagctgagaagtagcaggtatatttggataatatttcacttattctactgcattaagacctgtcttatggttttaaagatgttaagtatattcttaataattttctatatttcggtaggtttatctgaccatttacagatgagcgtgcttatatacaaatatgtcaatgaccacataaacctagaaacaattacatctctcaaaatgttagtggatatgaagggctacaactagaaatgggaaaaaaagagcttgaaagagaagctgaaaaggactctaagcacctgtcaagagattggcatttacatttcttaaatgtgaaaggagggaaaaaaagaagctctgtgggtatataagtaagttttagatctggttattaaggaagttggcattcagc

SEQ ID NO: 459923 - DNA, 3435 bp, Homo sapiens
gggctgccctcacctctacatctgtaggcgatgctgttttcagtaaaaaacaaaactgggcaaactaaagtacgtcaagaaacaaaagcaaagtaccatgatgcctcacccttcaaaaacaaaagcaagtatattaagacattaaaaaatgaaacaagcatttttttttattattttcttagaaaaggcggcgagaatcctgagtggaagggatctgaactttcatgtcatgtacttcgagaagagggtagatgagactcaagaatgataatcagaccagtcctactcctcccaacccccaaaagatggcatttacacatcacggaaacctatgggtctaacaggttattctctctctctcagttcttgggaaaagggagacaagccctcggccagattcctttagggaagagttctctgtgccggtggctggagcttgcggtgcgtgctcagccaggaggccccagccaggcacctctagactccgatgtgccacagagggcaggggctcccgctgtcacttccattttagaccaaacagctcctgggtgcagcgactctttcaccctctcttcagggtggggagaaacggggtggactggagcccgcgcggccctcacgaactctccctgagcagccccagcttccgcagggcctccctgcgcgcctcctccgaggagccgcggcccgcgaactgcacggtgatgccctggggccggggcagggagtctgcgcggcgccagtcctgggcgccgttgggctgccggggcccggggaagctctgacgggcccgcgtgctgggcagggccgggccagggcggaagcagagggacttcccagcgggcgcgaaggagctgggtgcgctcttcagggcctcgtgcgcacttgggaagccgttggccagcgccgggccccgcggagcctgaccccctgcccggagactctcagcggggcccggcaggccccggccacgcgccacccgctccggggaggagccgccccctggggccccctcgccggcgtcccccgcggcggggaaggcgccggcgtggccgtggatggtggccaacacctgcgccctgcgctcctgcacgctgacggccgccctggacagggtcctgcggggctcccgggccgcgccgttggtgcaggccctggaagacaagggaggagcctgtgagccaccggcccacgtgaaagtaaatgcatgaagttccctctcgctgaactgaaaagagcctcaacctggacctgacaccaacttcgccggtgctgcctggctggttgctctagcgccctgaaggagaggaatgcagtcatatttcactgtgattttcagtgtcatttccacgaagactaatgatgttgagcttttttttctccataatacaggaaagagacccaaacccatgaagaatgagatacatgtacagttttgattataaaaccaaagaataatggcttcacaagatgacggctgggctcctgggctgccttcagtgtctttaaacaggtaatacagatcttgctttcttctctctctctctgagagatcttgactgagacagacacaccccaagtgtgcagcatttgaggcgctccgagaccctcatgagcttgggtcctccatggctgcctcgtcactatatggtgagttcctaaaagggggcaaactgagtcttatcccatcacctctcagttcttatatgcagtaggcatgtatgaaatgttgagtgaattggccttttagaaaagctactgagttatgttttaaagcagctgtttgaccaggaccatttggattccagctgggtgagaaggcagcatgaaagggcggggttatggctgatggggcggctcctccctcaaggcacctccggttcagtgtcccctcctgaagtcacagagcaaacagcacatcagatttctagcacactcctcagactttgctccggcccggccacgtgggaagccccccagtgcttgccatgccttcttagtccatgagccatgtgtggggccaaaggtgtcaagtgctctggagcaacagggtggctcaggagctgccggctgcctggtcacagaccgctgtgtgacttcagggccacagcacttgtgggcgtagggagagggggattcgagacagttcatcaaatattaaatcctaaaaactcattcataaatttggatcactgtttctgcccaagccagaggtaaaaacaaataacaggtagacttgggatgtccccagccaccctcacaaaagcagccatgctgttccagctccactccttgagaaccatgcgagtgcagagctctccgccctttccgagcagccaaatcctatttcttctagaggaagcttcgggatgtgtgaaggcagacccgacttcaggacctcattcagagtgagagcctgggaacgctggtgtgaggcagcaccgtgccctcgccgtgcacccagggggttttgtgagacgaggcacaggaaagcatgaaagaaaaactgtcactcaccaaagtgaagcttctggagcgagagctgctgcttcgactctccaggctgccgcctctgctgaaggctcggagcctgcagctgggggacgtgtctgagttcatgtcagatgcgtctgatttccgggccggctcgatcacaggaagcagggcaggagccagcagcccattctgcggcaacagctcactcctagagacaccaaacacgaatgacaatggagcaaatggccacactcgggtatacggagcagctcaagcaaccaggtcttcctgccattcccctgaaagggctggttttgccaaacgccagagccacattccagctgccgagccctgcagactcttcctttacgacgtcagttgtatccacttcccttctggtcccacacccaagttcaggaccattttagcacgtgcctacattattgccacagccattgtcttcatctgttttgtgctgctgtacaaggaacaaacttatttggcttgtggtttgggaggttgggaaatccaagatccagggccacatctgctgaaggccttcctgctgtaccgtaacataacgggaggcatcactggtgagagagagagagcacaagaaagggccaaactcgcttttatagtgaacccactcctgcaataacaacgttcaaatgctaaccacctcttcccgtccctgcccctcaacatggccatgctggggattaagtgtccaacacatgagctttgggatacatgttccaactacagccgccacctgctgtcctccttgccttctccctcttctctacacttctgccggattctctagttggattaatcttgaaacatcacttaattgttaccactctcccaaaagcagtcaattttaacccattcccaacaggcttgagaataaaagtttcagccaatcagtcatca

SEQ ID NO: 459924 - DNA, 757 bp, Homo sapiens
tgtccttgcccagtgtaagtttcctggagctgcagcagcctttttgtcaccatgagggcagctggtgggaaccctaggaaagcaggaaatcacctagagccggaacagcctgagcctctgaaccaacccacagctgactacccgtcactttgtcgtgtctctgtgatttgagtccatcatttcaactgcggttgaaggtatactttgacaaagccctgttcttaaccattatggtgaaacgcatgaatccctcttcgggctatttgctgcatgatcctcagcaaattaaatagttaatctccctcagtttcctcatttataaaggataggatgataaagcatagagatcgtgaggattacatgaggcatttacctagaagatacttagaacaatgctggacacaaactaagtacttaacaaatgtaacatttctcctattagttagtactcctaagactaattatgccaccactgattcacagtcccttatcaaaaacctttcaggccagatgtgtttgtgaaattcagaattttttgaatgtttaaaaaaggtgagatatattgtatgcccccgtagtcaaacaatgtttctatagcagaaatgtgtgagtattcacaaatattcaccctaagtgggatatataaaggttgtaaatagggccaggcacagtggctcatgcttgtaatcccagtactttggaaggccaaagcgggaggattgcttgaaccgcagttgaaagacgcagcctcggcaac

SEQ ID NO: 459925 - DNA, 2079 bp, Homo sapiens
ctgatttgccaatgaacacactcattttggccatgccaagggggatctgtgtgtgtgatggggccgggccaaggagcagtttgattcaacttttgcaaagccatgacttctgtttttccatttacccaatcttccccctttcaaactcccatgacgtcttttaaaaagcaccatgtctgctcatcttactgagatgtacaagataacacgtaaagcctgtagtagggagcctggcatggagtaggcatttccgaggcgctccttccatgccctgctgccctcttatttaaacattcccagcacttccttgggcactagaataaggttagattttacctttgaaatttacggtttctttagatattacaataacaataattggttatcgtctttacctggaaatgcttccccctttgattagtctgttttgcactgctataaaggaatactgaggctgggtatttacaaagcagtttatttgtctcatagttctacagactgtacacgaagcaacggtgtcagcatctgcttccagtggggcctcaggaagctttcaatcatggcagaaggccaaggggcagcggggtctcacgtggcaagagagggaggaggaggtgccagcctctttaaacaatcagctcttgcatgaactcttagagccagaactcactcactacctggaagacggcatggagacaataatgagggatccacccccatgacccaaactcctcccactaggcccacctccagcactggtggtcacagttcaacgtgagatttggaggggacaaacatccaaaccgtatcacccctcaacccctcaactacacctggtttgctccttgttttctagattttgactgaaatgtccccttcccggcaaagccgtgtggaccacccgggctaaagcagccacctggtgctggcctgtgtggcccaattccagttctccagggtgctcatcactctgtggcagtttgtcttctggtttgtgagagaagaataaatctgagggacccaaaatcactaaagggaaaagtcaagctgggaactgcttagtgccaacctgcctccccttctattcaaagtcacccctctgctcaatgaaataaatgcatatctgattgcctcctttggagaggctcatcacaaactcaaaagaatgcaaccatttgccttttatctacctatgacctggaagccacctcccgcttcgagttgtcccgcctttccggactgaaccaatggcatggctttctgacatgagcctctgttgcacacgcttgtgtactctttattctgcatctgaagtggcttgtgcagggccatgtgtgattaaggggtttgtctgcttccccaccagactccttgctggtcccgcttaccagccagttgccggggcctgtactgccccggggccgtgtattccaggcttggcttcatgccatgccctctccacctctctcctcctgcgaggtgcagccagtgttgcatggggacttcccatcgtggctcaggcttgctcctctgacctctcctggcacttggtcctccaaaggagctcccctttctgctggccatctgcgtttgctcacctggacttgctgagggagctcgggtgccctgtgtgtgcttatctgtgtgtcccggcgcccggcacaggcagggcccagagtgggtgcctgctcgaggccaggggatgggtgagttcagcagttagctgtggggtgtctgcttaggcccagcccttgggggcctctaggaggggtccccctgctctcctgccctcctgccctctctgcaggagaggctccagtgaagcagacacagctcgatgttaagtgagacaagtcggtgctgttgataaataaaaatattaataaaccacaaatgtaccttccaaagtcaatagttttatgtttgaatggaaagtactatctcccatcttaacctacccctgcttctaagagcttgacaatgtttgttaaatgccacacaccagtgtcctttctaagtcatgttttatttcaacaatagattgaaattttaccatgatgttttatatttcatcctaag

SEQ ID NO: 459926 - DNA, 1787 bp, Homo sapiens
tgtccttgcccagtgtaagtttcctggagctgcagcagcctttttgtcaccatgagggcagctggtgggaaccctaggaaagcaggaaatcacctagagccggaacagcctgagcctctgaaccaacccacagctgactacccgtcactttgtcgtgtctctgtgatttgagtccatcatttcaactgcggttgaagttctacagactgtacacgaagcaacggtgtcagcatctgcttccagtggggcctcaggaagctttcaatcatggcagaaggccaaggggcagcggggtctcacgtggcaagagagggaggaggaggtgccagcctctttaaacaatcagctcttgcatgaactcttagagccagaactcactcactacctggaagacggcatggagacaataatgagggatccacccccatgacccaaactcctcccactaggcccacctccagcactggtggtcacagttcaacgtgagatttggaggggacaaacatccaaaccgtatcacccctcaacccctcaactacacctggtttgctccttgttttctagattttgactgaaatgtccccttcccggcaaagccgtgtggaccacccgggctaaagcagccacctggtgctggcctgtgtggcccaattccagttctccagggtgctcatcactctgtggcagtttgtcttctggtttgtgagagaagaataaatctgagggacccaaaatcactaaagggaaaagtcaagctgggaactgcttagtgccaacctgcctccccttctattcaaagtcacccctctgctcaatgaaataaatgcatatctgattgcctcctttggagaggctcatcacaaactcaaaagaatgcaaccatttgccttttatctacctatgacctggaagccacctcccgcttcgagttgtcccgcctttccggactgaaccaatggcatggctttctgacatgagcctctgttgcacacgcttgtgtactctttattctgcatctgaagtggcttgtgcagggccatgtgtgattaaggggtttgtctgcttccccaccagactccttgctggtcccgcttaccagccagttgccggggcctgtactgccccggggccgtgtattccaggcttggcttcatgccatgccctctccacctctctcctcctgcgaggtgcagccagtgttgcatggggacttcccatcgtggctcaggcttgctcctctgacctctcctggcacttggtcctccaaaggagctcccctttctgctggccatctgcgtttgctcacctggacttgctgagggagctcgggtgccctgtgtgtgcttatctgtgtgtcccggcgcccggcacaggcagggcccagagtgggtgcctgctcgaggccaggggatgggtgagttcagcagttagctgtggggtgtctgcttaggcccagcccttgggggcctctaggaggggtccccctgctctcctgccctcctgccctctctgcaggagaggctccagtgaagcagacacagctcgatgttaagtgagacaagtcggtgctgttgataaataaaaatattaataaaccacaaatgtaccttccaaagtcaatagttttatgtttgaatggaaagtactatctcccatcttaacctacccctgcttctaagagcttgacaatgtttgttaaatgccacacaccagtgtcctttctaagtcatgttttatttcaacaatagattgaaattttaccatgatgttttatatttcatcctaag

SEQ ID NO: 459927 - DNA, 1398 bp, Homo sapiens
catcttccaccatgattgtgaagcctccccagccgtgtggaactgtgactccattgaacttctttcctttataattacccagtctcagaacactagaagtccctgggagactctgactagtgaagctcatacaactaactgtgatggtggagatgaggatagtcttaaaggtaacacggttgcaacagactcatctatgcgaatataaagactcttccttctgcagcaagtagaaggcatgactgaagcaactcaagtctacatcatcccagcttcgcaatctcccaagagaacaagagccccagttggccaacatctgaacataaattctcatcagtccaccttcataagcagacggggagggtctccagggataacaggaatttaaccaacttcagcaatgagcctggtttacagcctcctgccctgcagcctgttcttccacaaaccctgggtaaaatgcagtcaccttgttggtttaaaccagctcttgacagacccccggcaacatacagatgaacgcaagtgaactttctcatgaccacgctaaagtctccaccctgggcaacctgtagcttcattaccatgacatgcaacctatgcgctgacgtaatgactcactgcatctgtgcaactagacctctcctcgtcatgcaatgatgctccctgtctcctctccattgcgccataaaaccctcctgtcactttccctcggaaagacactgctttggagaatacccccagtgtcacccttacttgagttaaataaaactcctattgatcaaagacagtgttcttgtggagagtcctttgttattcatgagccagcccctggtcaattggggaaactctgggaaatagaacaaggccctaatgaaaatccatcagtattcctaaagatactacgagaatggctccaggattacaccctttggaaaccagaggaccctgaaaagctgagtagtgcttggttcccaattcatctctcagagtaccctagatattcagaggaaactccaaaactggtgataaatccaggcactctcccttcccaactgatagacattgccttcaagatcaacaaaaatagagatgtggcatctgacaaaagggaggacaagaagatggagagacaggctcattttctggcagtagccctacagactacttcaggtgaaccaggaggaaggaagaagaaagcatggataagtaagcagagaccccgccatgggactcagagggtgcctaagctgggacccacacaatgtgcttactgcaagcaggagggacactggaaaaggaagtgtccagatcctccccggagggggaagaaagaggacaaacccaagcaccagttccctgtaaatggagagaaaactgactaacagggtcctgggg

SEQ ID NO: 459928 - DNA, 1178 bp, Homo sapiens
caagggacaattactgctgccaatgataatttttaagccttcaagccagaattaaaagtttagaaaatgttagagacagggtttcaccatgttggccaggctggtctcaaactcctgatctcaggtgatccgctcctctcagcctcccaaagtgctgagattacaggcgtgagccaccatgcccatctgtttaaaacatttctgagaacagtacctgatctaccaggcaatctgggtcaccaaaatcctaatatagttttggtattacctaaggtgccagacactggctttacccacagacattctgatttaattgatgatatagccaactctggaaaaacaggctggcgctgggtggttaggagtcttctgggaccacgtttggactttgggaatttggagtttattctctaggcaatgaagtacaatgaaaagtctttaaaaggggaagtgacatcaaagtttcagaaagtggtttaccgtggtgtgctctttccaccacgcggatagcataggctgacatgtatgataagcaaccttgagagcaaagggaatgcattgcaccatgaatatggagagtgagctttaaaatagtatgaaagacaaatgtttaaaggtatacatttctttcagagaactttttctctctctttctctctctgacagtgtgtgtgtatctcctgtgtctctctttccctctctcacatgcacacataagtgcacacacacacttctcttggaaactgaaggaggcaagaatatgatgccattaacaaatgctctttggtggacagcaataataacaactgctaactttcactgaggactacttatgtgccagataccatgtgaagcgctttgcttgtattagatcatcgaaacctcagaaaaactctataaagtgggtgctaatattttctagatttttcagatacaatactgaggatcagggagattgaataagttgtccagtgtcacccctggtagctgagagagctggtttggatgcctagggctgtttgtctccaaacctgtgccttgcacccttagctctggttcctcccctctcatgtcatgtaatcagcacaaatttcctgaagtaaggctgcatgcatataacaagaataaaggaataaaaatagaggatgccgtggaatgggagaaagtggactacttac

SEQ ID NO: 459929 - DNA, 1500 bp, Homo sapiens
ggacctttggcaggagacacatcccttctcctgtgatgtgtcagttagtgtagagaagcaagctggcatggacttgagagccggggagatgaaagcatggaaataaaaaagcaaattacagggatgagaagattgctgaacgacagcactgggcggatctatcagcgagttggcaaagaaggagagaaactaaaagaagagccccaggacctggatttagtctggcctccacgtttgaactcctctgctgaggccccgcaaagcctccacccgtcttcacgtggtgtgtggaatgagctaccgccccagagtggacagttttcagggcagtatggcacccgttctagaaccttccaaagccagccccaccctaccacgagctccaatggagaacttccagtggtgaattcatcagctggatcaaactgctgtacttgtaactgccagtcaacgttgcaggccattctacaagaactcaagaccatgaggaaattaatgcaaattcaagcagttggaactcaaaacagacaacaacctccaatttcccttatatgctcccagcgaactgctgtctcacgaaagagaaataaaaagaaaaaagtgcccccaaagactgtggaacctcttactgtgaaacagaagcccagtgggtcagagatggagaaaaagtcggtggtggcctctgagctatctgctctccaggcagccgagcacacctccccggaggagagccgcgttctaggattcggcattgttctggaatcaccttcctcagatccagaagtacaacttgctgaaggctttgacgtgtttatgcctaaatctcagctggactctatattgtcaaactacactcgctcaggaagccttctgtttagaaaactggtgtgtgcgttttttgatgacaagactttggctaactccttacccaatgggaagaggaaaagaggactcaatgacaaccggaaaggactagaccaaaatattgtgggtgcaataaaagtcttcacagaaaagtactgtacagctaaccatgtggataagcttcctggcccaagagattgggtacagattctacaggatcaaattaaactggccagaagaaggttaaaaagaggctcagagatcgcggacagtgatgaaagactggacggcattgctctaccaccaacaggactctactgacttccctccaaaggatatctgaagattctctgcccacaaaacccaggaaaaaaagcctgaggcccagaaacattaagtggctttcccacggcctcacagctggttgacggcctggccggaacccaggtccctcgactcccagccatgataccatatagctttctcatacctaagccaaagccagcttttctctgcatgtttcttaaagatcctaagagatgatggatgtgctaatccctttaggagtcctcttcactgtctcagtcttcacaattaaaatgttcgtcgtcagtcggcccggttcactgcagctga

SEQ ID NO: 459930 - DNA, 1539 bp, Homo sapiens
ggacctttggcaggagacacatcccttctcctgtgatgtgtcagttagtgtagagaagcaagctggcatggacttgagagccggggagatgaaagcatggaaataaaaaagcaaattacagggatgagaagattgctgaacgacagcactgggcggatctatcagcgagttggcaaagaaggagagaaactaaaagaagagccccaggacctggatttagtctggcctccacgtttgaactcctctgctgaggccccgcaaagcctccacccgtcttcacgtggtgtgtggaatgagctaccgccccagagtggacagttttcagggcagtatggcacccgttctagaaccttccaaagccagccccaccctaccacgagctccaatggtatggttgtcaacaaacattcagaaggctctcatgggggagaacttccagtggtgaattcatcagctggatcaaactgctgtacttgtaactgccagtcaacgttgcaggccattctacaagaactcaagaccatgaggaaattaatgcaaattcaagcagttggaactcaaaacagacaacaacctccaatttcccttatatgctcccagcgaactgctgtctcacgaaagagaaataaaaagaaaaaagtgcccccaaagactgtggaacctcttactgtgaaacagaagcccagtgggtcagagatggagaaaaagtcggtggtggcctctgagctatctgctctccaggcagccgagcacacctccccggaggagagccgcgttctaggattcggcattgttctggaatcaccttcctcagatccagaagtacaacttgctgaaggctttgacgtgtttatgcctaaatctcagctggactctatattgtcaaactacactcgctcaggaagccttctgtttagaaaactggtgtgtgcgttttttgatgacaagactttggctaactccttacccaatgggaagaggaaaagaggactcaatgacaaccggaaaggactagaccaaaatattgtgggtgcaataaaagtcttcacagaaaagtactgtacagctaaccatgtggataagcttcctggcccaagagattgggtacagattctacaggatcaaattaaactggccagaagaaggttaaaaagaggctcagagatcgcggacagtgatgaaagactggacggcattgctctaccaccaacaggactctactgacttccctccaaaggatatctgaagattctctgcccacaaaacccaggaaaaaaagcctgaggcccagaaacattaagtggctttcccacggcctcacagctggttgacggcctggccggaacccaggtccctcgactcccagccatgataccatatagctttctcatacctaagccaaagccagcttttctctgcatgtttcttaaagatcctaagagatgatggatgtgctaatccctttaggagtcctcttcactgtctcagtcttcacaattaaaatgttcgtcgtcagtcggcccggttcactgcagctga

SEQ ID NO: 459931 - DNA, 1153 bp, Homo sapiens
tggtttgtttggagtatgtcattcttttctttcatgctcaggagaacttccagtggtgaattcatcagctggatcaaactgctgtacttgtaactgccagtcaacgttgcaggccattctacaagaactcaagaccatgaggaaattaatgcaaattcaagcagttggaactcaaaacagacaacaacctccaatttcccttatatgctcccagcgaactgctgtctcacgaaagagaaataaaaagaaaaaagtgcccccaaagactgtggaacctcttactgtgaaacagaagcccagtgggtcagagatggagaaaaagtcggtggtggcctctgagctatctgctctccaggcagccgagcacacctccccggaggagagccgcgttctaggattcggcattgttctggaatcaccttcctcagatccagaagtacaacttgctgaaggctttgacgtgtttatgcctaaatctcagctggactctatattgtcaaactacactcgctcaggaagccttctgtttagaaaactggtgtgtgcgttttttgatgacaagactttggctaactccttacccaatgggaagaggaaaagaggactcaatgacaaccggaaaggactagaccaaaatattgtgggtgcaataaaagtcttcacagaaaagtactgtacagctaaccatgtggataagcttcctggcccaagagattgggtacagattctacaggatcaaattaaactggccagaagaaggttaaaaagaggctcagagatcgcggacagtgatgaaagactggacggcattgctctaccaccaacaggactctactgacttccctccaaaggatatctgaagattctctgcccacaaaacccaggaaaaaaagcctgaggcccagaaacattaagtggctttcccacggcctcacagctggttgacggcctggccggaacccaggtccctcgactcccagccatgataccatatagctttctcatacctaagccaaagccagcttttctctgcatgtttcttaaagatcctaagagatgatggatgtgctaatccctttaggagtcctcttcactgtctcagtcttcacaattaaaatgttcgtcgtcagtcggcccggttcactgcagctga

SEQ ID NO: 459932 - DNA, 437 bp, Homo sapiens
cactgtatctatcctagcattatatctacagagcagaggcaggacctttggcaggagacacatcccttctcctgtgatgtgtcagttagtgtagagaagcaagctggcatggacttgagagccggggtgggtatctgccccatgtggcctggctatggctgctctgttcagggagcctggggtcaggggtggcggccaccaacctgtgccagagaaggctagtctctgcatggacttcagtgcaggcatacccggcctgatggggagggctgtgggtggaaaccacacagaaaagatgcctcctcttgcttgaattgtggtgttaactagccgggaacgtatgtgtctggttgctgaaattaataccgcatttgcctgtgggcttatctttcaggattcctttgggacctcttccagacacaccctgttccgtagcc

SEQ ID NO: 459933 - DNA, 1560 bp, Homo sapiens
aatggggctgtgaaagcattgatcattgttaaatatcaaagagaaacctccacggtatgccacatggaaagtgtaatttactctttcatgaaccatacattcatacctgcctattatgtgccagcagtgaatggaagacgtgatctctgcccttgctttgagcttgcagtcttgatgaacactggacattgttattttaaaaaatcactggttaacgaactcagagtaatggagttggtgtgtatctttcccattcattcttactttgccacttgtgttcccgtcaatcctattcattattgttttgtgtcctgcttacagatctgtggccacagcatcacacgctcagccatcactttatctgaaagctttccccgctacccactcccacccaataatggttctgtttgcacacagtaggtgcatcatgctactcgcattgtgacattttagcatcgctggctcttgctaaaccccttgtttcttcatctcctgccattctcaggaggacaggagagggcccggctcatcactcgacacatctgcggcttggctccccttaggtcaagggtgcatcatcttgcagccaagctgtggcttagagggcactgggacaaagcagtcctgcccatttgggcagcaggggcgagaagtgggcagtttcctgtgaacatcctgatctttctccacgttcacagtcaaccttctgtttggttggtcccccatttctagccccttgaccccaacaagtaaagtactgggtcatgacatcaaatgttccagatacagaaagagaatccttcacctctgcattgcatattacttagttgtcattctagttgatgtatcaaccaagtattgtgtgtagggttgggtttaggtctgaattttttctgagtggtctgctaaaatcagatttctgagcctgcatgctgagaacccattccaagactagaacaattgcaccaagatgtggaggaccatcaggccctgcctgaacaaccagccttgattctagctctttcccaccctctcgtagtgttttacatgccacagtcttcacagaaaagtactgtacagctaaccatgtggataagcttcctggcccaagagattgggtacagattctacaggatcaaattaaactggccagaagaaggttaaaaagaggctcagagatcgcggacagtgatgaaagactggacggcattgctctaccaccaacaggtaaataaaacgcatttacattttcatcacctcctggaaaatacagcccacaaaactatttgcattgaaaacgattttaacattagacatgcagacacttgagcaaactgcttctgcagtggaccaggccccgtcattggagcttctcaaggccccgtactcagagatgtttttcatactgaatagaaaaacgtttttctcacactcttattttcataaaaatctcagaagagcaaatcctaagaactaagtatcataacattttgcctccccaaacctttggacattacaaaatatttttaacgtgaaatgagatttcaccttaaaacgggg

SEQ ID NO: 459934 - DNA, 1443 bp, Homo sapiens
ggacctttggcaggagacacatcccttctcctgtgatgtgtcagttagtgtagagaagcaagctggcatggacttgagagccggggagatgaaagcatggaaataaaaaagcaaattacagggatgagaagattgctgaacgacagcactgggcggatctatcagcgagttggcaaagaaggagagaaactaaaagaagagccccaggacctggatttagtctggcctccacgtttgaactcctctgctgaggccccgcaaagcctccacccgtcttcacgtggtgtgtggaatgagctaccgccccagagtggacagttttcagggcagtatggcacccgttctagaaccttccaaagccagccccaccctaccacgagctccaatggagaacttccagtggtgaattcatcagctggatcaaactgctgtacttgtaactgccagtcaacgttgcaggccattctacaagaactcaagaccatgaggaaattaatgcaaattcaagcagttggaactcaaaacagacaacaacctccaatttcccttatatgctcccagcgaactgctgtctcacgaaagagaaataaaaagaaaaaagtgcccccaaagactgtggaacctcttactgtgaaacagaagcccagtgggtcagagatggagaaaaagtcggtggtggcctctgagctatctgctctccaggcagccgagcacacctccccggaggagagccgcgttctaggattcggcattgttctggaatcaccttcctcagatccagaagtacaacttgctgaaggctttgacgtgtttatgcctaaatctcagctggactctatattgtcaaactacactcgctcaggaagccttctgtttagaaaactggtgtgtgcgttttttgatgacaagactttggctaactccttacccaatgggaagaggaaaagaggactcaatgacaaccggaaaggactagaccaaaatattgtgggtgcaataaaagtcttcacagaaaagtactgtacagctaaccatgtggataagcttcctggcccaagagattgggtacagattctacaggatcaaattaaactggccagaagaaggttaaaaagaggctcagagatcgcggacagtgatgaaagactggacggcattgctctaccaccaacaggaaaaaaagcctgaggcccagaaacattaagtggctttcccacggcctcacagctggttgacggcctggccggaacccaggtccctcgactcccagccatgataccatatagctttctcatacctaagccaaagccagcttttctctgcatgtttcttaaagatcctaagagatgatggatgtgctaatccctttaggagtcctcttcactgtctcagtcttcacaattaaaatgttcgtcgtcagtcggcccggttcactgcagctga

SEQ ID NO: 459935 - DNA, 1283 bp, Homo sapiens
aatggggctgtgaaagcattgatcattgttaaatatcaaagagaaacctccacggtatgccacatggaaagtgtaatttactctttcatgaaccatacattcatacctgcctattatgtgccagcagtgaatggaagacgtgatctctgcccttgctttgagcttgcagtcttgatgaacactggacattgttattttaaaaaatcactggttaacgaactcagagtaatggagttggtgtgtatctttcccattcattcttactttgccacttgtgttcccgtcaatcctattcattattgttttgtgtcctgcttacagatctgtggccacagcatcacacgctcagccatcactttatctgaaagctttccccgctacccactcccacccaataatggttctgtttgcacacagtaggtgcatcatgctactcgcattgtgacattttagcatcgctggctcttgctaaaccccttgtttcttcatctcctgccattctcaggaggacaggagagggcccggctcatcactcgacacatctgcggcttggctccccttaggtcaagggtgcatcatcttgcagccaagctgtggcttagagggcactgggacaaagcagtcctgcccatttgggcagcaggggcgagaagtgggcagtttcctgtgaacatcctgatctttctccacgttcacagtcaaccttctgtttggttggtcccccatttctagccccttgaccccaacaagtaaagtactgggtcatgacatcaaatgttccagatacagaaagagaatccttcacctctgcattgcatattacttagttgtcattctagttgatgtatcaaccaagtattgtgtgtagggttgggtttaggtctgaattttttctgagtggtctgctaaaatcagatttctgagcctgcatgctgagaacccattccaagactagaacaattgcaccaagatgtggaggaccatcaggccctgcctgaacaaccagccttgattctagctctttcccaccctctcgtagtgttttacatgccacagtcttcacagaaaagtactgtacagctaaccatgtggataagcttcctggcccaagagattgggtacagattctacaggatcaaattaaactggccagaagaaggttaaaaagaggctcagagatcgcggacagtgatgaaagactggacggcattgctctaccaccaacaggtgcttgtggtgggccctgcactgttctgccgggtgggagtgcagcggtgacccta

SEQ ID NO: 459936 - DNA, 2896 bp, Homo sapiens
aggtccaggagaaaatggagcggagtccctgcaggaactgcctcagactgcccctgagggggcctggcttgggaccctccctgtgctaccaggctgctgttggggccaggagggcagagagagcagccacctgtacggcatcaagtaacactatcactcagcacacccaacatccacacaacagccacagccctctaccctgagggggcagggaagctcttggtttactgtgtcacccaagcgactgggagccacgtgctgctctgggactgagcctttggagccgaccgatgactgcactgggctgaccgcaacaagctgaccacacacactcctcactcccctggccctgatgggcggcagacaccatggtgcagacggatgtgctcctaccagagccagcaccgcagacagtgtcaccctgcgagctgccctgcaaagagtatgacgtggcccgcaacatgggcaactgctatgctcgctaccaccaggccttcgccgactgcaaccagtcggagcgggagctgcaggggcgcgagagccagcagctggccgcagagacccaggcgctggcacagccgacacagcaagactccacgtgcagggtgggcgagcgactgcaagacacgcacagctggaagtcagagctgcagcacgaggtggaggtgctggctgcagagaccgacctgctgctggcccagaagcaacggctggagcgtgccctggatgccatggaggtgcccttctccatcgccactgacaacatgcagtgcagccagcgccaccagcacgccaaccttgtgcgtgactatgtggagacggagctgctgaaggcctatccccctgcaccctctcagtgcctcaagaactgctgcagctcccgcaaaccttctgcctgcaacaagggtgcctgtgaagtgatggagacactgacagtgcaggaagaggcaaacccagggacagaggggtgcaggactcgggccctggcacacaaggaggaagctgagcccatccggaacattcaggagctgctgaagagagccatcgtgcaagcagtgagccagatccacctgcagcatggagggtccccagtggggccctccctggccacacaccaaggccctgccccacctcgccccagactgaaccgagagcacacggagatctgcgagatggactggttggacaaggtggaggcctacaacctcgacgagacttgcgggcgccaccacagccagagcaccgaggtgcaggctcatccggcactccaccaccttccaagagaggggggccccagctctgcccccgtgcttgccctggctgtggtctcgcctccctctgcttgggggccccagcggcgttccttcccccagcctggcccagatgccttcccccccgatggcttttgggcaatccccgcagcgcctccaccccagagacccggaccaagttcacacaggacaatctgtgccgtgcccagcgcaagcgcctggactcggccaacctgtgggttcttgtggactgcatccttcgcgacacctccgaggacctgggactccagtgtgacgccatgaacctggccttcgggcgccgctgtgaggaactggaggacgcgcggcacaagctgcagcaccacctgcacaagatgctgcgggaaatcacagatcaggaacacaacgtggtggcactgaaggaggccatcaaggacaaggaggaacctctgcacatagcccagacccggctgtacctgccctcacaccggcccaacatgcagctgtgccgcgaagcagcccagttcagccccagctcacaccccccaacacccccaagctggtgagtgaggtggaggagctgtacaagtccatcacagtgccgcgggagaagcttctacaagcagagcagtccctgtgcaacctcgaggacatccacatgagcctggagaaggacatcaccgccatgaccaacagtctcttcatcgaccgccagaagtgcatggcccatcgtacttgctaccccaccatcctgcagctggctggctaccagtgagcagcggcacggtgcttccccccaatcccccaaataaacagtgcgttagctttctgcacagtgtgtgtgtgtgcccggtgggacctccagttgctgtccatctgaactggcctttgggtcccctgtgaggctagctctgcctatggactcgtcatcccaacagttggagatgaggggtcagaactgaggggttccctcatctgcccccttgtacagtggttcctagagatcactctcacaggcattagatgcatggctgaaggactgctggcatcagggagcattgagggaagcacatggagagggggactggggttccccatgactgtgccccagcagacccccacacctttccccacaggggatgctcccagacacttctgagctgccataggtgcccatttcacaggtagggaaaccaaggctcagatccagggagctgcagtatgtgtgcatccacctgtctttctccacaagccccaggagctcagggacaacaatggggagcccccgccctggttgcccctaccctgccacaggcccacagtctccccctggggatgtggctgcccacctgcaaagctgtgtcctcatcacccaggtctcagccgtgcagagctggttccaatggctgcaggcaccacagtcacagagctggaagaaacaagcatcctccccaagagtctgcagagggagcgcatttctgcccacaccttgattttagacttgtggcctccagaactgtgagagaataaattcctgatgtcgtaagccatcactacagcagctcccggacactaatattgctcaatccgtccaggctcctctctctgtttgttgctgttctagg

SEQ ID NO: 459937 - DNA, 1740 bp, Homo sapiens
cacgcaagcacgccttaaacacacagatatagacatgacactgggcaggtcatgggtcgggggcctcccagtgccagggacctgtgcccacgtggtctcaccccaccctgtgctacctcatcttcccgggaggaagctccttcagacaaggtgagctcctggaggccacggggccagagaggccagagagggccattccctgctgccctgagggtgttgtccccacctctggtggaaagtatgacctacgcctgggctacaggcatagatgggccgtccttttgtttcccttgttaacggatgcctggtggccccttctgagcctaagtacctttcttccttccctgcccctcagttccttcaaggaactgggtgcctccttccgtcaaatatcaggaatgaaaagaactgagcctggtcggctgaggccagtcctgtcctgtcagggtcgagattgcacgcgggtcactcattcccactcaggcccgcgctccctgggaggaccctcgtaatttatgctctgccctagagccgctttcctggtgggatcctttcatggcgtcttcccaggacctcctgccagctcccattgggagttttgggtcccctccaccccagtaggtgcatacttcttccctccccagccccagctcacaccccccaacacccccaagctggtgagtgaggtggaggagctgtacaagtccatcacagtgccgcgggagaagcttctacaagcagagcagtccctgtgcaacctcgaggacatccacatgagcctggagaaggacatcaccgccatgaccaacagtctcttcatcgaccgccagaagtgcatggcccatcgtacttgctaccccaccatcctgcagctggctggctaccagtgagcagcggcacggtgcttccccccaatcccccaaataaacagtgcgttagctttctgcacagtgtgtgtgtgtgcccggtgggacctccagttgctgtccatctgaactggcctttgggtcccctgtgaggctagctctgcctatggactcgtcatcccaacagttggagatgaggggtcagaactgaggggttccctcatctgcccccttgtacagtggttcctagagatcactctcacaggcattagatgcatggctgaaggactgctggcatcagggagcattgagggaagcacatggagagggggactggggttccccatgactgtgccccagcagacccccacacctttccccacaggggatgctcccagacacttctgagctgccataggtgcccatttcacaggtagggaaaccaaggctcagatccagggagctgcagtatgtgtgcatccacctgtctttctccacaagccccaggagctcagggacaacaatggggagcccccgccctggttgcccctaccctgccacaggcccacagtctccccctggggatgtggctgcccacctgcaaagctgtgtcctcatcacccaggtctcagccgtgcagagctggttccaatggctgcaggcaccacagtcacagagctggaagaaacaagcatcctccccaagagtctgcagagggagcgcatttctgcccacaccttgattttagacttgtggcctccagaactgtgagagaataaattcctgatgtcgtaagccatcactacagcagctcccggacactaatattgctcaatccgtccaggctcctctctctgtttgttgctgttctagg

SEQ ID NO: 459938 - DNA, 967 bp, Homo sapiens
agccactggtcaggaccaccctctggacacagccccaggagctgggtaggaccagactggtctccacattccatatgcccgggcatgggggcactggcccaaggggcactgtcctgtctgcagatgctgcgggaaatcacagatcaggaacacaacgtggtggcactgaaggaggccatcaaggacaaggaggaacctctgcacatagcccagacccggctgtacctgccctcacaccggcccaacatgcagctgtgccgcgaagcagcccagttcaggtactgcctgggcctctgaagcagtcccaggtgcccccatccacctcctcgctgttaccctctccaataaacactccaatctccacacacacatcccccacaggtgctgagaggggagggagactttgcggccacacacaacacgcaagcacgccttaaacacacagatatagacatgacactgggcaggtcatgggtcgggggcctcccagtgccagggacctgtgcccacgtggtctcaccccaccctgtgctacctcatcttcccgggaggaagctccttcagacaaggtgagctcctggaggccacggggccagagaggccagagagggccattccctgctgccctgagggtgttgtccccacctctggtggaaagtatgacctacgcctgggctacaggcatagatgggccgtccttttgtttcccttgttaacggatgcctggtggccccttctgagcctaagtacctttcttccttccctgcccctcagttccttcaaggaactgggtgcctccttccgtcaaatatcaggaatgaaaagaactgagcctggtcggctgaggccagtcctgtcctgtcagggtcgagattgcacgcgggtcactcattcccactcaggcccgcgctccctgggaggaccctcgtaatttatgctctgccctagagccgctttcctggtggga

SEQ ID NO: 459939 - DNA, 1595 bp, Homo sapiens
ccagcgcggtcgtgtagctgagcagccctggggtgtggttctatgtccctgtggctatgtttccagtgtcctctgggtgtttccaagagcaacaagaaacgaataaatctctgccccgcagcgcctccaccccagagacccggaccaagttcacacaggacaatctgtgccgtgcccagcgcaagcgcctggactcggccaacctgtgggttcttgtggactgcatccttcgcgacacctccgaggacctgggactccagtgtgacgccatgaacctggccttcgggcgccgctgtgaggaactggaggacgcgcggcacaagctgcagcaccacctgcacaagatgctgcgggaaatcacagatcaggaacacaacgtggtggcactgaaggaggccatcaaggacaaggaggaacctctgcacatagcccagacccggctgtacctgccctcacaccggcccaacatgcagctgtgccgcgaagcagcccagttcagccccagctcacaccccccaacacccccaagctggtgagtgaggtggaggagctgtacaagtccatcacagtgccgcgggagaagcttctacaagcagagcagtccctgtgcaacctcgaggacatccacatgagcctggagaaggacatcaccgccatgaccaacagtctcttcatcgaccgccagaagtgcatggcccatcgtacttgctaccccaccatcctgcagctggctggctaccagtgagcagcggcacggtgcttccccccaatcccccaaataaacagtgcgttagctttctgcacagtgtgtgtgtgtgcccggtgggacctccagttgctgtccatctgaactggcctttgggtcccctgtgaggctagctctgcctatggactcgtcatcccaacagttggagatgaggggtcagaactgaggggttccctcatctgcccccttgtacagtggttcctagagatcactctcacaggcattagatgcatggctgaaggactgctggcatcagggagcattgagggaagcacatggagagggggactggggttccccatgactgtgccccagcagacccccacacctttccccacaggggatgctcccagacacttctgagctgccataggtgcccatttcacaggtagggaaaccaaggctcagatccagggagctgcagtatgtgtgcatccacctgtctttctccacaagccccaggagctcagggacaacaatggggagcccccgccctggttgcccctaccctgccacaggcccacagtctccccctggggatgtggctgcccacctgcaaagctgtgtcctcatcacccaggtctcagccgtgcagagctggttccaatggctgcaggcaccacagtcacagagctggaagaaacaagcatcctccccaagagtctgcagagggagcgcatttctgcccacaccttgattttagacttgtggcctccagaactgtgagagaataaattcctgatgtcgtaagccatcactacagcagctcccggacactaatattgctcaatccgtccaggctcctctctctgtttgttgctgttctagg

SEQ ID NO: 459940 - DNA, 1440 bp, Homo sapiens
ccagcgcggtcgtgtagctgagcagccctggggtgtggttctatgtccctgtggctatgtttccagtgtcctctgggtgtttccaagagcaacaagaaacgaataaatctctgccccgcagcgcctccaccccagagacccggaccaagttcacacaggacaatctgtgccgtgcccagcgcaagcgcctggactcggccaacctgtgggttcttgtggactgcatccttcgcgacacctccgaggacctgggactccagtgtgacgccatgaacctggccttcgggcgccgctgtgaggaactggaggacgcgcggcacaagctgcagcaccacctgcacaagccccagctcacaccccccaacacccccaagctggtgagtgaggtggaggagctgtacaagtccatcacagtgccgcgggagaagcttctacaagcagagcagtccctgtgcaacctcgaggacatccacatgagcctggagaaggacatcaccgccatgaccaacagtctcttcatcgaccgccagaagtgcatggcccatcgtacttgctaccccaccatcctgcagctggctggctaccagtgagcagcggcacggtgcttccccccaatcccccaaataaacagtgcgttagctttctgcacagtgtgtgtgtgtgcccggtgggacctccagttgctgtccatctgaactggcctttgggtcccctgtgaggctagctctgcctatggactcgtcatcccaacagttggagatgaggggtcagaactgaggggttccctcatctgcccccttgtacagtggttcctagagatcactctcacaggcattagatgcatggctgaaggactgctggcatcagggagcattgagggaagcacatggagagggggactggggttccccatgactgtgccccagcagacccccacacctttccccacaggggatgctcccagacacttctgagctgccataggtgcccatttcacaggtagggaaaccaaggctcagatccagggagctgcagtatgtgtgcatccacctgtctttctccacaagccccaggagctcagggacaacaatggggagcccccgccctggttgcccctaccctgccacaggcccacagtctccccctggggatgtggctgcccacctgcaaagctgtgtcctcatcacccaggtctcagccgtgcagagctggttccaatggctgcaggcaccacagtcacagagctggaagaaacaagcatcctccccaagagtctgcagagggagcgcatttctgcccacaccttgattttagacttgtggcctccagaactgtgagagaataaattcctgatgtcgtaagccatcactacagcagctcccggacactaatattgctcaatccgtccaggctcctctctctgtttgttgctgttctagg

SEQ ID NO: 459941 - DNA, 2847 bp, Homo sapiens
ttgtttgtttcagaaacgggtatgcaggagattagaagccagtgggcatgagcgtggctgccaccaggtgaatgcctgtgccctggcgtcctggggcccagaggaccgggagcttccatcaagaggctgcctcccagcaccaaggccagagagtggccaggggaggctaagtacagggatttctcagaatggtggaaggagctcagcccagccttgcccaagatgtattgcaggggaatctatggagttttgctctcgttgcccacgctggagtgcaatggcatgatctcagctcactgcaacctccgcttcccaggttcaagcgattctcctgcctcagccacccaagtagttgggattacagggacattttagccataccaagaatcattagaagatgcaagctggaaaaaagaaggtcccagttttggttttgaacccttcatgttgcagcaaatgtgaatctcctacagatgggtttggggacttacctgttcaaatagcagcccggtgtcctctgtgggtggggggaggtttgtctgtcctttcattctagtaaatccaccatcctctgcacgagagccaggagaatccacatcacttcaaaagagcccccaaatccttactacgtactacagcctcctttcgaatgttcctggttgagagggagatcaattgcattatttacaagtcaaaaaattttgtatcaaacttcctatgagcttgggcactcatggcctatggaggcccacccagacgcagccccgccatcatgctttttcgttgttttgtggatgtacccagggctatttacacactctttcattaaaaggcttatttttatatttaaaatgttctaatcttggagtgaattttactaaatgctagtgtccaatctgttccccaactgaagttatcagagacagaatcccttttatattcaagtggaaattactcattttctcttgggttttcaatgtatcgtctgactgtgaggctggcattattttctctgggtttgaaagcttcctgagatgtcctgtttgtaagctcctgtccgcatcacgttatctgcagggaatgtgctccctccagggagtgtcctcggcactgatgtgggaagagccccctctataagtcatcatggcattcggtcatgggagagttccatacgggaaagatggagcagaggaagacaaggtgttgaaaccagtacagcaccacctgggatatggatgatccagaattacaggacacgtcttcattaagcctgggtaagatcccagagctatgactcgatcaaaaaatgccagttcgtgccaaacaaccaaagccgggaaagagggagaaggtattggcgtttgtagccttacgaaagatctttatgaagagctttagtttgttcttctcttttccaaaatgagatacacgtctaatttttacgggaaaaaaagaaaactcttagatggacagcatgttcttttttgtgtgtaaactcttccttctcaccctcgttcatggagagagcaggtgtccacccggtgtcaggtgggtgttttgtagctgacgtggcacgcgtccctccagctgttcatacgaagctggcttttgtagagaacagtccccgggcatcctcctgccccaaggaaaatgcccccgcttcagagtcagacagacgtgagttcccatctcatctccaccgaccatctccacctgaccttgatgagtccttagacttcttggagcctctggttcccatctgtgtggtggggaggttgcccttggggtttgcccttagcccacagtgtgactcctcagtgtcagtgccctccctcctggtacacagcccctccaccccaaagcaggccttcggttctggaaaagcaaagctcacaaaacctgatgacccaggtgacaaggacgaaagggatgaggtgtaactggccagaatgtgggtgtattagggttctctagagggacagaataggataagtgtatatgtgaaggggagtttattaaggagtattgacttgcatgatcacaaggtgaggtcccacaataggccgtctgcaagctgaggagcaaggaaggcagcctgagtcccaaaacctcaaaagtagagaagtcgatagtgcatccttcagtctgtggctgaaggcccaacagcccttgcaaaccactggtgtaagtccaagagtccaaaagctgaagaacttggagttcgatgttcaagggcaggaagcatccagcacgggagaaagaggaagcctggaagactcagccagtctagtctttccacattctcctgcttgcattattctggccaagctggcagctgattagatggtacccacccagattgagggtgagtccgcctctcccagtccactgactcaactgtgaatctcctttggcaacaccctcacagacacacccaggatcaatacttggcatccttcaatcaagttgacacttgatattaaccaccacagtggagaaccagcagctttatccaggtgctggattttccagactgtgaagggaatggaggagcttgtgactgggtacctaaaaagggggatggcaacattttcttggtgttttcagccattttagtacaggccatgaaatagaaggctcagaaattccagattttcctaggtgtggtccacacctcagtcccatcctactctggcctcgtgtgaacagaggtcctgcccgtggccttgttgtcccctggcagccgccctccacccaccccctgacttgctgtcacagctgccctggcatccatcctggccttcagccccacctccctggctccagagtcatccctggccacaggac

SEQ ID NO: 459942 - DNA, 849 bp, Homo sapiens
ttgtttgtttcagaaacgggtatgcaggagattagaagccagtgggcatgagcgtggctgccaccaggtgaatgcctgtgccctggcgtcctggggcccagaggaccgggagcttccatcaagaggctgcctcccagcaccaaggccagagagtggccaggggaggctaagtacagggatttctcagaatggtggaaggagctcagcccagccttgcccaagatgtattgcaggggaatctatggagttttgctctcgttgcccacgctggagtgcaatggcatgatctcagctcactgcaacctccgcttcccaggttcaagcgattctcctgcctcagccacccaagtagttgggattacagggacattttagccataccaagaatcattagaagatgcaagctggaaaaaagaaggtcccagttttggttttgaacccttcatgttgcagcaaatgtgaatctcctacagatgggtttggggacttacctgttcaaatagcagcccggtgtcctctgtgggtggggggaggtttgtctgtcctttcattctagtaaatccaccatcctctgcacgagagccaggagaatccacatcacttcaaaagagcccccaaatccttactacgtactacagcctcctttcgaatgttcctggttgagagggagatcaattgcattatttacaagtcaaaaaattttgtatcaaacttcctatgagcttgggcactcatggcctatggaggcccacccagacgcagccccgccatcatgctttttcgttgttttgtggatgtacccagggctatttacacactctttcattaaaaggcttatttttatattta

SEQ ID NO: 459943 - DNA, 526 bp, Homo sapiens
gttctttgaccatatttaaaatggctgaggtgaagtctctgggacattttagccataccaagaatcattagaagatgcaagctggaaaaaagaaggtcccagttttggttttgaacccttcatgttgcagcaaatgtgaatctcctacagatgggtttggggacttacctgttcaaatagcagcccggtgtcctctgtgggtggggggaggtttgtctgtcctttcattctagtaaatccaccatcctctgcacgagagccaggagaatccacatcacttcaaaagagcccccaaatccttactacgtactacagcctcctttcgaatgttcctggttgagagggagatcaattgcattatttacaagtcaaaaaattttgtatcaaacttcctatgagcttgggcactcatggcctatggaggcccacccagacgcagccccgccatcatgctttttcgttgttttgtggatgtacccagggctatttacacactctttcattaaaaggcttatttttatattta

SEQ ID NO: 459944 - DNA, 376 bp, Homo sapiens
ttgtttgtttcagaaacgggtatgcaggagattagaagccagtgggcatgagcgtggctgccaccaggtgaatgcctgtgccctggcgtcctggggcccagaggaccgggagcttccatcaagaggctgcctcccagcaccaaggccagagagtggccaggggaggctaagtacagggatttctcagaatggtggaaggagctcagcccagccttgcccaagatgtattgcaggggaatctgtaagtgcattaaccttcttgctgtgacataaaagatagacttcttcttaaatattagatccataaaacaaagttaataaaaactgcaattatgtttctgaagaatgaggaacataaataaaaaggtgaaaattg

SEQ ID NO: 459945 - DNA, 865 bp, Homo sapiens
gtattttcattctcttgctattcctcaaagtactataggaaagaagggaagtaacatttattgaaagtcttctgtgtaccagtcactactggaaatgctttaaatatcttaattataatgtaatatatattaatatatctataaacagatacctcaggaattaagttatcacttacaagtagtcattttaaatgtagtgctttgtgttggcaaatgtatatatagccaaggtgtattaatttggccaaggtaaattaattcccgcaatgtgctgttttatctttgtagggacattttagccataccaagaatcattagaagatgcaagctggaaaaaagaaggtcccagttttggttttgaacccttcatgttgcagcaaatgtgaatctcctacagatgggtttggggacttacctgttcaaatagcagcccggtgtcctctgtgggtggggggaggtttgtctgtcctttcattctagtaaatccaccatcctctgcacgagagccaggagaatccacatcacttcaaaagagcccccaaatccttactacgtactacagcctcctttcgaatgttcctggttgagagggagatcaattgcattatttacaagtcaaaaaattttgtatcaaacttcctatgagcttgggcactcatggcctatggaggcccacccagacgcagccccgccatcatgctttttcgttgttttgtggatgtacccagggctatttacacactctttcattaaaaggcttatttttatatttaaaatgttctaatcttggagtgaattttactaaatgctagtgtccaatctgttccccaactgaagttatcagagacagaatcccttttatatt

SEQ ID NO: 459946 - DNA, 2017 bp, Homo sapiens
accatcttcttccactttctttattttcaattagtttggatacaagttatggggcaggtcaagtatatcaggggtcaccaaacactgggccacagaccagtccatgacctgttagcaactcggccacacagcaggagactattcaaagcaagaaatgaaaatggtcctcaaacatgtgaaaaaatatattcatccttactcataataatacaaatgagcattaaaattatacctcgcatttatcaaaaacctaaaaatttgacaacaagctcagttgtatggaaacaggaatatccatgcattgcttatggaaatgcaacaagctttaacgcttatggtgaagaacacagcaatatctggaaaaactttagggaatttattactctcacccaattggccacttgcaggagtctatcccaaatatatactagcaaacttataaaattacttaggcacaaaattattatttatggttatatttgtaatgccacatgattggaaacaaatatctctcaatttgggactgattggtaatctataaaatatgaggaccttttgcaaaaattcttttggtcacttaacagaatttatttgcttctactgtttgtgcattataatgtatgaaatagcttatgtttacatacactgaaaattatgcttatgtgtctaggtgtctttgaaggtgccttctttgatcgtacatgaactgtagagtcagagctgccttgcccacaccggcactgcccaccgtgatgactttgtgtaaggccaaattattctgacccttgggcttatttgcggccatcttgtgttgtagttctcaccaacagatgctgaacaattcatgaactacttgctgaaattcaataagcaattcatgaatacttgaattaagagtttttttaagtcagaaactggtaaataccatcaatgacaaatattattccatcaaattcaatctggttatgaaatatctcagtttttaaactcatcctgaatacactcagcagtgaaaaagatgaggtgtgactacaaggtatccatgtactgcatgtctaggttatccatcaataactacgcattgcatatgcagctattcatagagaaaattttagttccatcccctcatttgtgtgcaatttcacatctgataatgaattttaacatgtctaccaccacttagatatattaaatatgtgagaaggacttgattcaatccatcatcactgtgaaacactgctcaaagtgaatacatttgggagagttatgaggacaaaatgcatttacgaacaaagtgactaaaatacatagatggatcctggacttctgtgaaatcttccactcaagaattctacccaggaggattagagatggctttatctctgttatgtatgtagagattcctattgttgggtaaattttctagtctgttttatgccagatccttgtctctcaatttaccactctaatagtattttctcattcagcatacatttaagaggaaaatgatgtatatttgcatatattaaattactgtcatcctttcttagatttatatctctaagtgttttcattttaaaaacaagtaatttaggcctttcaaatagcatccaaaacaaattaaggattgcaaaacttgaatttcaacgtaagccttgaaaaaatgtgaggttcaatagttatctggttttaatatgtctttttggtttctctgttgactgatatattcctgcctaaaattttgatccaaatttaatatctcttgttacacaagatttatgtaaaaagtaaattcagttgctttcaaattcattttgtgtctcagtgaaaacagaatttactaattgcaaatcttctggaaagcattgttttttcctgcctctaattgtacctttaaaacttcagtccataatttattcttttaaagaaaagtacaatttatagtatagttgttaagattgtttagtaaagcaaatatgttggtaaaataagcaactttttaaaaatctgaaattat

SEQ ID NO: 459947 - DNA, 1114 bp, Homo sapiens
ctcgatataccaggtccataaaaacaatataagtttcaactactgaaatgaaaagacaaaatcaaagctgtgtggttgaattcatcctcctgggcttttctaactttcctgagctccaggtgcagctctttggggttttcctagttatttatgtggtgaccctgatgggaaatgccatcattacagtcatcatctccttaaaccagagcctccacgttcccatgtacctgttcctcctgaacctatctgtggtggaggtgagtttcagtgcagtcattacgcctgaaatgctggtggtgctctctactgagaaaactatgatttcttttgtgggctgttttgcacagatgtatttcatccttctttttggtgggactgaatgttttctcctgggagcgatggcttatgaccgatttgctgcaatttgccatcctctgaactacccagtgattatgaacagaggggtttttatgaaattagtaatattctcatggatctcagggatcatggtggctactgtgcagaccacttgggtatttagttttccattttgtggccccaatgaaattaatcatctcttctgtgagactcccccggtactagagcttgtgtgtgcagacaccttcttatttgaaatctatgccttcacaggcaccattttgattgttatggttcctttcttgttgatcctcttgtcttacattcgagttctgtttgccatcctgaagatgccatcaactactgggagacaaaaggccttttccacctgtgcctctcacctcacatctgtgaccctgttctatggcacagccaatatgacttatttacaacccaaatctggctactcacccgaaaccaagaaactgatctcattggcttacacgttgcttacccctctgctcaatccgctcatctatagcttacgaaacagtgagatgaagaggactttgataaaactatggcgaagaaaagtgattttacacacattctgattgtgttgagaagctgagtaagatttggccactgcctgagtgaactctatttaaatttaataaagggtgaaaacagactgcattttttgtatgactatatcaggtcaataaactttcactta

SEQ ID NO: 459948 - DNA, 3248 bp, Homo sapiens
acactaatttaggttcctattcagcaaaggttggtctggaacacttcacgctggtgcacagctgagtggcaagtggaagactgcagaacatgcagccatctcgggctggggaaggtctggctggcatccagcatggttcaggagggagacctggaggaagagaagtctgacattgtgtgtcctggctgccactgcagaccccctgattatgagaagggagttttgattttgcttctattttgccttctgaggggcatcattgtcatgtacaactcttgggagagctgggtctgcacagcagcagaggaatgcgggtatgggtcctggctgtgcccaaagctgaaggctcacagctggccagacacagtgcctgtagtgtcagaagaagagggaagaaaagaagcaggttccaagaagaaggctccagacatgctgctgttagcaaagaaattcagcttccctgatactctggagcctgcagagctgttgggaagatacagcgtgtgcccccacccctcacctgaatggaggagtcctggtgtccagagggagccatgtgctgagggctggtgccagatcgccagccgtctgtggcagcatttccctgtgtctggcccagtgtccaggatgagggcttcgtgggaggagctgctcagctctgctgagggccgtggggaaggggctgaggctcggcactgcctagagaacagtggacagtggccagagatggctctggccattaggagctgtgtgacattggtcaagtgtgataactcctccaagctttggtttcctttcctgcaaagtggggttaatagcagcacacaggaggcctgttgcgttgtcatctccctgggttctggggcagatgagcccacctcccccaagaggccgaagagcatctctgagccacagcacagtgatgcggaaggggacgctgcctctcccctgccctccgagtggacctcagtgaggatcagccctggggaggaagcagctggacaggatgtgctggctgtgcgtgtcctggtcaccagcgaagacagcagctctgacacagagtctgactatggtggcagcgagggctcccacacagaaccctgtgaagagaaaccctggcggccaggatccccgcatctaccgcacacgtccctaggggaggccctgagcagggcagtctctccacagtgccctgaggagcccagagctgtgcacgcagctctgcaacgggccaatagcttccagtctccaaccccaagcaaataccagaactggaggagagaattctggtggagtgagtcactagctctctgggggtgggaggctggggctgggcagaagatctctggttaattctcaggggcagccgttctcattccttacatggtatctctctggcatggcctcctggttgtcagaggcaagaaataaaatataagcttgactttatttccactgctgactagagggagccttttccaagggactcaagatcttcccatccccctccaccccacccctggctcaggaattatggagccttaggattctacagtttcacccagacagggccttagccatcattgcctctaagctttttgaaatacagatgaaggcattactgccccatcacagctggttctggccccaagccccaggtgggagggccggaggggatatgtggctgccctgggcaccctccccagctgatcatgctgccagatgacctctaggatctacgagaaaggttgctgctgccagagggcccagagaggaggcttgaaccttctaatcgtgggctgcgatgggggtgcggtagtgggaggcaggccagccgcctccccagcagctccttcctgccgccctcagatcagatctgttcccagaattaccttttccctccaaagctttctgcgaggcctccctctgggagcttgctgaccgtgtgcgtgtggtgccatctgttcagagcccacggctgggacacacagtcgcacatgagcttggcatgggcccactccatatccttccaatgatttgatactcactgtaacctccctctcttgtgtgctcttaaaatctcaaacgactcttcctgtctgagagcctcttggcacacatatgagaagaaagagcccatctcattagtcgtggatgtctatcctgtctgtgcccatggctaaaggtctagcatcttgtgggaagaaagctcaggtggtttattgactgagtgatttaacacagcccagctcccaaccacaatggttttaggatgctctttggaggcagatgagcatttctaagaaatgttctggaaatgccctgatacacctctcaagagcatcatcgcatgagtctgaaacacaatggttattagacttctcaccctgggacttcctttgccccacgggaccctgccactgctctacccattcctctgagtcccacgccttgggcaccaggaacctctgagtcaggctctgacatcttcctctttctgactgtttatagaattggagcttcacttaaagcctcctcttttcttgataaaataataacacctttgtaatgaagagtgtgttctttccttggtaggtttgacgccagtgaacaaaagaactatgtcacctcctaaggacccttctccttctcttcctcttccttcatcgtcttcccattcatcttccccaccatcttcttcttcaaccagtgtttctgggaatgctccagatggttcctccccgcctcaggtgagtgtccctgagggtcctgcccaggtgtcaggaagctaacctacctgtactcttcccaccttccacacttatctctggattccacgtgctcataggtcaacctaagtgcaaagccagcgccagaagatactctgtcaagggtctaccccagctgccttcatgtatacctttcacaaaagctcctgctgttccttcacagccatccctgaggacacagtcattccctcagcaaactttacagggtttagactccatgccaggtctccatgagatacagagctgctaggacacctttcccttgagaacttgcaaagggcattgaggaatttgcagctgtaggatggcaggcacagaagtgagggtccctttggtagggtccaagaaccttggaagcaacatctcccttgaatataaaatgtcatcattggtatgcaggctggactctttccttctgtatgtatttatcaagcctctgttacctgccaggcctgttct

SEQ ID NO: 459949 - DNA, 1947 bp, Homo sapiens
acactaatttaggttcctattcagcaaaggttggtctggaacacttcacgctggtgcacagctgagtggcaagtggaagactgcagaacatgcagccatctcgggctggggaaggtctggctggcatccagcatggttcaggagggagacctggaggaagagaagtctgacattgtgtgtcctggctgccactgcagaccccctgattatgagaagggagttttgattttgcttctattttgccttctgaggggcatcattgtcatgtacaactcttgggagagctgggtctgcacagcagcagaggaatgcgggtatgggtcctggctgtgcccaaagctgaaggctcacagctggccagacacagtgcctgtagtgtcagaagaagagggaagaaaagaagcaggttccaagaagaaggctccagacatgctgctgttagcaaagaaattcagcttccctgatactctggagcctgcagagctgttgggaagatacagcgtgtgcccccacccctcacctgaatggaggagtcctggtgtccagagggagccatgtgctgagggctggtgccagatcgccagccgtctgtggcagcatttccctgtgtctggcccagtgtccaggatgagggcttcgtgggaggagctgctcagctctgctgagggccgtggggaaggggctgaggctcggcactgcctagagaacagtggacagtggccagagatggctctggccattaggagctgtgtgacattggtcaagtgtgataactcctccaagctttggtttcctttcctgcaaagtggggttaatagcagcacacaggaggcctgttgcgttgtcatctccctgggttctggggcagatgagcccacctcccccaagaggccgaagagcatctctgagccacagcacagtgatgcggaaggggacgctgcctctcccctgccctccgagtggacctcagtgaggatcagccctggggaggaagcagctggacaggatgtgctggctgtgcgtgtcctggtcaccagcgaagacagcagctctgacacagagtctgactatggtggcagcgagggctcccacacagaaccctgtgaagagaaaccctggcggccaggatccccgcatctaccgcacacgtccctaggggaggccctgagcagggcagtctctccacagtgccctgaggagcccagagctgtgcacgcagctctgcaacgggccaatagcttccagtctccaaccccaagcaaataccagaactggaggagagaattctggtggagtttgacgccagtgaacaaaagaactatgtcacctcctaaggacccttctccttctcttcctcttccttcatcgtcttcccattcatcttccccaccatcttcttcttcaaccagtgtttctgggaatgctccagatggttcctccccgcctcaggtgagtgtccctgagggtcctgcccaggtgtcaggaagctaacctacctgtactcttcccaccttccacacttatctctggattccacgtgctcataggtcaacctaagtgcaaagccagcgccagaagatactctgtcaagggtctaccccagctgccttcatgtatacctttcacaaaagctcctgctgttccttcacagccatccctgaggacacagtcattccctcagcaaactttacagggtttagactccatgccaggtctccatgagatacagagctgctaggacacctttcccttgagaacttgcaaagggcattgaggaatttgcagctgtaggatggcaggcacagaagtgagggtccctttggtagggtccaagaaccttggaagcaacatctcccttgaatataaaatgtcatcattggtatgcaggctggactctttccttctgtatgtatttatcaagcctctgttacctgccaggcctgttct

SEQ ID NO: 459950 - DNA, 1035 bp, Homo sapiens
aatttaatcctgtcagcaaactataatgtagaaatgcaaattctgaagacccattggggcctagtgaatcagaaactctgcagcaaaggggtcctgagacaccagccctgcaccagcaccctgctgcagcacgagagggaaccttgcttaggagtggaaggaagctctggaagtgccacttacttttgttacaccgaggtccgtatttattgggatcagagcagaactgacactgggagccttggaagccctcctcacaaatgcatccctggcaaggtcatatgtgtgctgattgacatcagtgttgggtgtgggccctttctaacccctggccgcagtcatttgtactggcctctccctattctccttgtccacatggtgtccccactcatggctgatactttccccttgaaaaagccacgttttagaggcgggcttattaaatgcacagatgtataatttccctgtatgaaccacagctacttttgcctccaagctagatgagttaagttgcccttttctttggcagttgatggcatggctagtgctcagtcatctggtcaccacaactctactgagcccctcccctgggtgctggactggctctaacactgtgcgaacagacagaggaaggctcatgcttgtggagccaacgttctaagttggggaagagtcaatgtatgaattttaaaaacagtaaaacaagatcatttcagagaacggaagacaacagcaagcacgggccacctgtgaccacgtggaccctaggacccaagagcatggccctggagctgcctggccctactggcctagactgggcctcggccacgcgctcctcaccttcacagtggcattgcagtaccgggcacagccgctcttcaggctcccaaacctgccactgtagacacatctgtgtgtgaagagtgcctggagaaagccaaggagggaaagcatggcagtcagcatgtttaggtcctccaggcactgcacaccctctgcagacacttgccattgtacttccatttcaccactgac

SEQ ID NO: 459951 - DNA, 1323 bp, Homo sapiens
tggagtccggagctgtgcagggccctcctgggctcgctcctgttccctgcagggcatctgccagcaggggcagggatgttgtatggggaagccttcccttccatgaccagcttctctgtctgtctgtccctaggtgcccaggagctggtgcggatggacagctcaagacaggctttggggatgttcgatcctaatgccatcaactctattgaccaaagagaaacttgtccccaaattcctgaggctgaagttctagaagtgtctgtgatttttggcttcctggctgtgcccggggttgatggccccggagacgtcttcttcccatccctggaatttggctgccagaccccaggcctggctgctgctgtgtggagagggaggcggcccgcagcagaacagccaccgcacttcctcctcagcttcctctggtgcggccctgccctctcttctctggacccttttacaactgaacgcatctgggcttcgtgaatacttggtgctttccaacacactttcacatgtgttgtaacttgtttgatccacccccttccctgaaaatcctgggaggttttattgctgccatttaacacagagggcaatagaggttctgaaaggtctgtgtcttgtcaaaacaagtaaacggtggaactacgactaaaccctgggtctcctgcttcctcctcactgaatggattggtattatgggccagggcctggcttggccttcaccttggacttgcttagagcacatacaagggctctgggagatgaacttgtgcccacaggtccagggctccactgtactgcacaccagaaacgttcctatctgtgctctgcctgccctggcctgggccttcttctgggtccagaagacgctgctgctgatgggtaggctccttccatatcagctcctgccactcccttttctgcctgccaactgtggagctagaggactcctgataggcacagtggcccatgcacccctcttgcttgcattaggggatggggaagggagaaaccctcagcagctgagccccagggtctcttggaggaacttagccagttgtatgtggagcatctgggcagctgtggaacatccctcaagaagccaggccaagggaagggtctggatgtacttgtgctgggtcagggaaggccagccttcttggtgccacagagggtgagggccaggctgggaccttctgatctcaagccaggggaagcagagttcacaatagcagggtccaagtctaataaacagaaggggcctctgctctaaagacatgaggtgtactgccaagagcagtgtccccagctcataga

SEQ ID NO: 459952 - DNA, 1231 bp, Homo sapiens
  misc_feature (14)..(14): n is a, c, g, or t
ggctgcatggaatngggcacgagattctgaggcagccagagcggctcctgttcatcctggatggctttgatgagctgcagaggccctttgaagaaaagttgaagaagaggggtttgagtcccaaggagagcctgctgcaccttctaattaggagacatacactccccacgtgctcccttctcatcaccacccggcccctggctttgaggaatctggagcccttgctgaaacaagcacgtcatgtccatatcctaggcttctctgaggaggagagggcgaggtacttcagctcctatttcacggatgagaagcaagctgaccgtgccttcgacattgtacagaaaaatgacattctctacaaagcgtgtcaggttccaggcatttgctgggtggtctgctcctggctgcaggggcagatggagagaggcaaagttgtcttagagacacctagaaacagcactgacatcttcatggcttacgtctccacctttctgccgcccgatgatgatgggggctgctccgagctttcccggcacagggtcctgaggagtctgtgctccctagcagctgaagggattcagcaccagaggttcctatttgaagaagctgagctcaggaaacataatttagatggccccaggcttgccgctttcctgagtagtaacgactaccaattgggacttgccatcaagaagttctacagcttccgccacatcagcttccaggacttttttcatgccatgtcttacctggtgaaagaggaccaaagccggctggggaaggagtcccgcagagaagtgcaaaggctgctggaggtaaaggagcaggaagggaatgatgagatgaccctcactatgcagtttttactggacatctcgaaaaaagacagcttctcgaacttggagctcaagttctgcttcagaatttctccctgtttagcgcaggatctgaagcattttaaagaacagatggaatctatgaagcacaacaggacctgggatttggaattctccctgtatgaagctaaaataaagaatctggtaaaagaaccattaaagaggagtatgcaggaaactgagtgctatgactttcagtgtcaggagtaaggccttttcagtgattttacttctctcctagcaacagatttcttttgcttattatttggtgtttcttagactgattgggggtgggaaaaagagcttttttggtcgttcttatgcatattagtctt

SEQ ID NO: 459953 - DNA, 1378 bp, Homo sapiens
caactctcgccagaaaaatggtgttggactgggccaccggtactctgtacccaggccggtttgattatgtcttttatgtaagctgcaaagaagtggtcctgctgctggagagcaaactggagcagctccttttctggtgctgcggggacaatcaagcccctgtcacagagattctgaggcagccagagcggctcctgttcatcctggatggctttgatgagctgcagaggccctttgaagaaaagttgaagaagaggggtttgagtcccaaggagagcctgctgcaccttctaattaggagacatacactccccacgtgctcccttctcatcaccacccggcccctggctttgaggaatctggagcccttgctgaaacaagcacgtcatgtccatatcctaggcttctctgaggaggagagggcgaggtacttcagctcctatttcacggatgagaagcaagctgaccgtgccttcgacattgtacagaaaaatgacattctctacaaagcgtgtcaggttccaggcatttgctgggtggtctgctcctggctgcaggggcagatggagagaggcaaagttgtcttagagacacctagaaacagcactgacatcttcatggcttacgtctccacctttctgccgcccgatgatgatgggggctgctccgagctttcccggcacagggtcctgaggagtctgtgctccctagcagctgaagggattcagcaccagaggttcctatttgaagaagctgagctcaggaaacataatttagatggccccaggcttgccgctttcctgagtagtaacgactaccaattgggacttgccatcaagaagttctacagcttccgccacatcagcttccaggacttttttcatgccatgtcttacctggtgaaagaggaccaaagccggctggggaaggagtcccgcagagaagtgcaaaggctgctggaggtaaaggagcaggaagggaatgatgagatgaccctcactatgcagtttttactggacatctcgaaaaaagacagcttctcgaacttggagctcaagttctgcttcagaatttctccctgtttagcgcaggatctgaagcattttaaagaacagatggaatctatgaagcacaacaggacctgggatttggaattctccctgtatgaagctaaaataaagaatctggtaaaagaaccattaaagaggagtatgcaggaaactgagtgctatgactttcagtgtcaggagtaaggccttttcagtgattttacttctctcctagcaacagatttcttttgcttattatttggtgtttcttagactgattgggggtgggaaaaagagcttttttggtcgttcttatgcatattagtctt

SEQ ID NO: 459954 - DNA, 2087 bp, Homo sapiens
  misc_feature (2074)..(2074): n is a, c, g, or t
  misc_feature (2076)..(2076): n is a, c, g, or t
  misc_feature (2078)..(2078): n is a, c, g, or t
catctgtaggcacacatacacactctctttacagtcagccttctgcttgccacagtcatagtgggcagtcagtgaatcttccccaagtgctgacaattaatacctggtttagcggcaaagattcagagaggcgtgagcagcccctctggccttcagacaaaaatctacgtaccatcagaaactatgtctctgcagatggtaacagtcagtaataacatagccttaattcagccaggcttctcactgatgaattttgatggacaagttttcttctttggacaaaaaggctggcccaaaagatcctgccccactggagttttccatctggatgtaaagcataaccatgtcaaactgaagcctacaattttctctaaggattcctgctacctccctcctcttcgctacccagccacttgcacattcaaaggcagcttggagtctgaaaagcatcaatacatcatccatggagggaaaacaccaaacaatgaggtttcagataagatttatgtcatgtctattgtttgcaagaacaacaaaaaggttacttttcgctgcacagagaaagacttggtaggagatgttcctgaagccagatatggtcattccattaatgtggtgtacagccgagggaaaagtatgggtgttctctttggaggacgctcatacatgccttctacccacagaaccacagaaaaatggaatagtgtagctgactgcctgccctgtgttttcctggtggattttgaatttgggtgtgctacatcatacattcttccagaacttcaggatgggctatcttttcatgtctctattgccaaaaatgacaccatctatattttaggaggacattcacttgccaataatatccggcctgccaacctgtacagaataagggttgatcttcccctgggtagcccagctgtgaattgcacagtcttgccaggaggaatctctgtctccagtgcaatcctgactcaaactaacaatgatgaatttgttattgttggtggctatcagcttgaaaatcaaaaaagaatgatctgcaacatcatctctttagaggacaacaagatagaaattcgtgagatggagaccccagattggaccccagacattaagcacagcaagatatggtttggaagcaacatgggaaatggaactgtttttcttggcataccaggagacaataaacaagttgtttcagaaggattctatttctatatgttgaaatgtgctgaagatgatactaatgaagagcagacaacattcacaaacagtcaaacatcaacagaagatccaggggattccactccctttgaagactctgaagaattttgtttcagtgcagaagcaaatagttttgatggtgatgatgaatttgacacctataatgaagatgatgaagaagatgagtctgagacaggctactggattacatgctgccctacttgtgatgtggatatcaacacttgggtaccattctattcaactgagctcaacaaacccgccatgatctactgctctcatggggatgggcactgggtccatgctcagtgcatggatctggcagaacgcacactcatccatctgtcagcaggaagcaacaagtattactgcaatgagcatgtggagatagcaagagctctacacactccccaaagagtcctacccttaaaaaagcctccaatgaaatccctccgtaaaaaaggttctggaaaaatcttgactcctgccaagaaatcctttcttagaaggttgtttgattagttttgcaaaagcctttcagattcaggtgtatggaatttttgaatctatttttaaaatcataacattgattttaaaaatacatttttgtttatttaaaatgcctatgttttcttttagttacatgaattaagggccagaaaaaagtgtttataatgcaatgataaataaagtcattctagaccctatacattttgaaaatattttacccaaatactcaatttactaatttattcttcactgaggatttctgatctgattttttattcaacaaaccttaaacacccagaagcagtaataatcatcgagntntnttttattta

SEQ ID NO: 459955 - DNA, 328 bp, Homo sapiens
catctgtaggcacacatacacactctctttacagtcagccttctgcttgccacagtcatagtgggcagtcagtgaatcttccccaagtgctgacaattaatacctggtttagcggcaaagattcagagaggcgtgagcagcccctctggccttcagaatgaagatgaaaagaagatgtgtttaggaaccttctctgcttccctaaaagaaccctaaaaacaggagtaaaaacagtgaagaaaacaaaggaccttcaaagtgcactcgttaaaacctaataactgtatttctattactaaatgtagaagtggtaaacatctttaacagg

SEQ ID NO: 459956 - DNA, 706 bp, Homo sapiens
cactctctttacagtcagccttctgcttgccacagtcatagtgggcagtcagtgaatcttccccaagtgctgacaattaatacctggtttagcggcaaagattcagagaggcgtgagcagcccctctggccttcaggtaggtctgataccttcatttctaccaaagctaaaaaatgggagcctatgttagtaaactttaagggaatgaagatgccacattttggcagtgtgttagtcacaagtggatttggtgtctagatagggaagggatgagtagaatttggaaaatgtggggctttctgttctctggctgcttcagggatttaattattaggcctttagagcactattattaatcttcgtacataaatcgttctctggcctaagacaggaaggaagacctaatcctggttttactgccagcagaaataaaataatatatgcctcaaacctgattaacagtgcaagatactgttattcacacattaaatgcctgaagttacttacatgaggttacttgctactctggagcaatcaagaaaacatggccagcacggatcagcaagatttaatgtttcacagtacagtatctttctttggaaaagaaaaagtcagttcagatattaggaactataaacccagacctcatactatgagtcctttcattatactcaactatgccctagcatcagagagaataaatgaa

SEQ ID NO: 459957 - DNA, 975 bp, Homo sapiens
agctgcttgtcaggccaggaagacagcagccctgatgatcagttcttcctaaagccatccggctcctggggagaggcaggacagccccccagggcagggagagcactcggaggggccagcaggaggcgtccggctcaaggtcttcaacgccaccttttatgatgaaagtgtccttgaatgagagagtggtgggcagtgacgcacggctttgtgaatagcctgtcaagcaccgagctgcaaactttaacatggagaattttacggcatgtgaattacttctccattaaaaaaccttttttttttttttgaaaatcacctttttaatgagtgaagactttcctggctacaagatccaccatcttggcccgacccctgacgttccctgtccttcttcacagcatctttcttctcctcagtggctatcatgggacgtgccatatacaggcctcctcctctagcacgcagcctccataaggggcagggcctgcgggctgccctccttctttctgccttccctcctctgcctgctggctttcatcctcatgtggttcacctcacagtcacaagttggctgctgccattcaacatcacgtccaagttcacagaccgatgggcaacccttaactcccaagacacgttcaggggagcgagcaaagggtgcaccccctcttcttcagagcagaaaacaaaggtgtacaaaaaggggcagagatcgggcagggactcagctgtggggcccaggggcccatttgctcttggagcctttcacagcctttctggttgtgtgcaggggaacaaacctcacccacatgtgagtcagaagacctggtttttagtgtgcaccctgaaaccgatctcctgtgcaaccttggccttttcgctcttaattttgtcatctacatacaagagagttgggtgagaggatcaccggagacagtgcatgtgagctcatgatgttctacacaaatgtgagac

SEQ ID NO: 459958 - DNA, 3393 bp, Homo sapiens
gaagtgcacggcagggccaggacgggtcgctgtgggtggggactggtctccacacccgcagacggaactggtactgaagggcagtgataactggccggttcctcccatgaatcacctcctgtctgctcttcctttaggaggtgttactgaagcgggcggcggacctggtggaagccttatacggaatgcctcacaacaaccaggagatcatcttgaagcgagcggcggacatcgccgaggcgctgtacagcgttccccgcaatcacaaccagatccccaccctgggcaacaaccctgcacacacgggcatgatgggcgtcaactccttcagcagccagctagccgtcaacgtgtcagagacgtcacaagccaacgaccaagtcggctacagtcgcaatacaagcagcgtgtccccgcgaggctacgtccccagcagtactccccagcagtccaattacaacacagtcagcactagcatgaatggatatggaagtggcgccatggccagtctaggggtccctggctcgcctggatttcttaatggctcctccgctaactctccctacggcatagtgccgtccagccccaccatggcagcctcttcggtcaccctcccttcaaactgtagcagcacacacggcattttctcattctcacctgccaatgtcatctccgcagtgaaacagaagagcgccttcgcgcccgtggtccggccccaagcctctcctcctccttcctgcaccagcgccaacgggaatggactgcaaggctctctgctgggtgctgaggacgtagccgcggagaagacaaactggcccttttgtgaagtcggtggcatatttcactttgatgaactaatgctcaaaaaaggaactggaaagctatgtctgggctggtagtcccgccaatgtgagggacttctgtttaccttccgcagcacccagcatcaaaggacggacttcaggggacacgtttagtatattaagacatgctgatggaaacagtatcttcaaaaaaatcagcagcaattgaaatgctacaaaagactttgtttaaagattttatttaaactattaagaatcaacatgcaaacagcctacttcttcatgaacaattccattttattgactgaacttttctcatattttcacatttctcagtcctgaagaataaggaaaacaaagcgacgcctattttgtataaagtttccgactccgtcttggccatgtctagtaattgctatgtgttgggagaaactttgtgaatgcaccattttgatgatcatgaaacgctgatgaaaaatgcctccaaacatttttctgtactcatacttagattcacaatggttgtgtatctctataatgtgaaatatttttttgtggtgataaaaagagggccaaggaggtatgagccatcagactggaaaaaaggatgactatatgatgaggagaaactggggtggcagggagggagggagggtttatcactgcttaacttcatcttcatgaaatgaaactttgtaacttattgtagttagaaattgtaactttgatattgaattctcttgccttcaacaagcacactgacagagaaaaaatgctactgtctgttggttccaatattctcccactgctagagcttcctgttaagcaagtgtgatctgcaacattttttcaacttttgctagcactgtatactattgcattcttaggctactgtgaggtctatgtttcttgtaccagaaattgtccttttgacttctagatccttcttccctaatgtgttttgtatgtggttataaaattgtagacttttgtgattttgccaaagttgtagctaaatatttatacacttgtcttgaatttttttcagatccacttaaaatatttagaaaaacaagttttattccttatgtgtcttataaggaataaaatggtcttcatttgacacttactttcccatgaacacttgcagttgctaagggactttattttgtaacatatcaattataaatattgtatttatctttgaaattttgtacattgcttttcccaccttttcctttttcttctttcttgtctgtattggtttttgatcacggcctggtgttgtgatactgggaagagcattagccaagaacttgtctctttgatctgtttcgttaagctgaaccagtgtctttacatttcatttgtacttcaaaaaatatgctattgtttagactttccatccttttttttttttattttgaggaaaagtcaaattcattgtttatttttatattatttttaagttatctgaacaaatacttttgaaaaaaaagtttgttgtatagtcaaaacaaatcggtgccacccggccgtgacaaatcctagtagattctgtgcatgtggagcggccgcgaagaggtgacaccgtttggggctgtgtccttattttattttatttttttgtagaatgtaaaaagtcattttagatgccacccattgactttgccacatagctgaactgtgtttactggaaaaattcagaggcctaaagtttaaaataaaatttacttctgatgttttaattaaaatgtttgccacattaacttttctgatgccttaaaagtgaacttctttaaagaacctttgtgctattttatcacaggcttacactacaattgttaataaatacttcatttggagatgtatggtgtaaaacacacaaacacacacaaaaaagcacaagcccgctgcatgacccgtctctcctttctgggactatttctgctgcgtcctgcaccctcctgggcccacctccgattcacagaggtttcagggggacccaaatcactgctggttttcaatttttttttaacaatacatttttgtggtcagttccaacagcactgtccgtacttttaaaactggaatgacctccttcagatatcgtgcctcttagtgccaaacccacagtgagaccaaaagtgtcaggtgtttttttttttttctttctcctttgcactaagtgctttgcagacacggcacagcaaacattttgcaaactgcagcagaaatcgaatttaaaacaaaaaggagggactttaaaataccttcttgacaaaaatcaacaatgcacaacttacaaagtgttcattctagggacaaaattaaataaacagaatgtccccaggagtcagcaggtcacagtctggctttgtgatggttgacaaggtctagctacatgggaaagcctgagaagtcactttggaactaaattgcctccattttattttgtacgagtaagggtttgatctacaaaagagctcacatggacgcactgagaacgcctgccagcttccccatgccctcacctgtgggggaaggggggatcctctaatcacccatg

SEQ ID NO: 459959 - DNA, 1763 bp, Homo sapiens
ccgagggcacagctgtccacagatgaggccacacggggtgggcaccctgtgcctgcccagcgcctggcccatctgagctgtgcaggctgcacgtggcctgtgatgtgtgtgacgggcagagccacatgggtgcccccaggcctcatgaacttgcgagtggccctttgtgaggtgctgaggcccgcaggcacttaaattaagtggccgtcatctggcctctttcagacaccacctttggtatatgctcctcccagtgactcaaatccagttactcctttagaaacaagaacttgtctctttgatctgtttcgttaagctgaaccagtgtctttacatttcatttgtacttcaaaaaatatgctattgtttagactttccatccttttttttttttattttgaggaaaagtcaaattcattgtttatttttatattatttttaagttatctgaacaaatacttttgaaaaaaaagtttgttgtatagtcaaaacaaatcggtgccacccggccgtgacaaatcctagtagattctgtgcatgtggagcggccgcgaagaggtgacaccgtttggggctgtgtccttattttattttatttttttgtagaatgtaaaaagtcattttagatgccacccattgactttgccacatagctgaactgtgtttactggaaaaattcagaggcctaaagtttaaaataaaatttacttctgatgttttaattaaaatgtttgccacattaacttttctgatgccttaaaagtgaacttctttaaagaacctttgtgctattttatcacaggcttacactacaattgttaataaatacttcatttggagatgtatggtgtaaaacacacaaacacacacaaaaaagcacaagcccgctgcatgacccgtctctcctttctgggactatttctgctgcgtcctgcaccctcctgggcccacctccgattcacagaggtttcagggggacccaaatcactgctggttttcaatttttttttaacaatacatttttgtggtcagttccaacagcactgtccgtacttttaaaactggaatgacctccttcagatatcgtgcctcttagtgccaaacccacagtgagaccaaaagtgtcaggtgtttttttttttttctttctcctttgcactaagtgctttgcagacacggcacagcaaacattttgcaaactgcagcagaaatcgaatttaaaacaaaaaggagggactttaaaataccttcttgacaaaaatcaacaatgcacaacttacaaagtgttcattctagggacaaaattaaataaacagaatgtccccaggagtcagcaggtcacagtctggctttgtgatggttgacaaggtctagctacatgggaaagcctgagaagtcactttggaactaaattgcctccattttattttgtacgagtaagggtttgatctacaaaagagctcacatggacgcactgagaacgcctgccagcttccccatgccctcacttggtttgtgttttaggttaagtagtcaatgcccacatcacttcactgtctcaagactgagcacttcactaaatggtagattttactgttaaagaccctacaataagattgttttatctgtacattttttcagatatttaactgtataaaaatgttcattttacacaatatttaattaaagtatttcttgtctgtgaatttcacttttggtaattttctctgtttttgattattaaaatgactaaacactaacat

SEQ ID NO: 459960 - DNA, 3613 bp, Homo sapiens
gaagtgcacggcagggccaggacgggtcgctgtgggtggggactggtctccacacccgcagacggaactggtactgaagggcagtgataactggccggttcctcccatgaatcacctcctgtctgctcttcctttaggaggtgttactgaagcgggcggcggacctggtggaagccttatacggaatgcctcacaacaaccaggagatcatcttgaagcgagcggcggacatcgccgaggcgctgtacagcgttccccgcaatcacaaccagatccccaccctgggcaacaaccctgcacacacgggcatgatgggcgtcaactccttcagcagccagctagccgtcaacgtgtcagagacgtcacaagccaacgaccaagtcggctacagtcgcaatacaagcagcgtgtccccgcgaggctacgtccccagcagtactccccagcagtccaattacaacacagtcagcactagcatgaatggatatggaagtggcgccatggccagtctaggggtccctggctcgcctggatttcttaatggctcctccgctaactctccctacggcatagtgccgtccagccccaccatggcagcctcttcggtcaccctcccttcaaactgtagcagcacacacggcattttctcattctcacctgccaatgtcatctccgcagtgaaacagaagagcgccttcgcgcccgtggtccggccccaagcctctcctcctccttcctgcaccagcgccaacgggaatggactgcaaggctctctgctgggtgctgaggacgtagccgcggagaagacaaactggcccttttgtgaagtcggtggcatatttcactttgatgaactaatgctcaaaaaaggaactggaaagctatgtctgggctggtagtcccgccaatgtgagggacttctgtttaccttccgcagcacccagcatcaaaggacggacttcaggggacacgtttagtatattaagacatgctgatggaaacagtatcttcaaaaaaatcagcagcaattgaaatgctacaaaagactttgtttaaagattttatttaaactattaagaatcaacatgcaaacagcctacttcttcatgaacaattccattttattgactgaacttttctcatattttcacatttctcagtcctgaagaataaggaaaacaaagcgacgcctattttgtataaagtttccgactccgtcttggccatgtctagtaattgctatgtgttgggagaaactttgtgaatgcaccattttgatgatcatgaaacgctgatgaaaaatgcctccaaacatttttctgtactcatacttagattcacaatggttgtgtatctctataatgtgaaatatttttttgtggtgataaaaagagggccaaggaggtatgagccatcagactggaaaaaaggatgactatatgatgaggagaaactggggtggcagggagggagggagggtttatcactgcttaacttcatcttcatgaaatgaaactttgtaacttattgtagttagaaattgtaactttgatattgaattctcttgccttcaacaagcacactgacagagaaaaaatgctactgtctgttggttccaatattctcccactgctagagcttcctgttaagcaagtgtgatctgcaacattttttcaacttttgctagcactgtatactattgcattcttaggctactgtgaggtctatgtttcttgtaccagaaattgtccttttgacttctagatccttcttccctaatgtgttttgtatgtggttataaaattgtagacttttgtgattttgccaaagttgtagctaaatatttatacacttgtcttgaatttttttcagatccacttaaaatatttagaaaaacaagttttattccttatgtgtcttataaggaataaaatggtcttcatttgacacttactttcccatgaacacttgcagttgctaagggactttattttgtaacatatcaattataaatattgtatttatctttgaaattttgtacattgcttttcccaccttttcctttttcttctttcttgtctgtattggtttttgatcacggcctggtgttgtgatactgggaagagcattagccaagaacttgtctctttgatctgtttcgttaagctgaaccagtgtctttacatttcatttgtacttcaaaaaatatgctattgtttagactttccatccttttttttttttattttgaggaaaagtcaaattcattgtttatttttatattatttttaagttatctgaacaaatacttttgaaaaaaaagtttgttgtatagtcaaaacaaatcggtgccacccggccgtgacaaatcctagtagattctgtgcatgtggagcggccgcgaagaggtgacaccgtttggggctgtgtccttattttattttatttttttgtagaatgtaaaaagtcattttagatgccacccattgactttgccacatagctgaactgtgtttactggaaaaattcagaggcctaaagtttaaaataaaatttacttctgatgttttaattaaaatgtttgccacattaacttttctgatgccttaaaagtgaacttctttaaagaacctttgtgctattttatcacaggcttacactacaattgttaataaatacttcatttggagatgtatggtgtaaaacacacaaacacacacaaaaaagcacaagcccgctgcatgacccgtctctcctttctgggactatttctgctgcgtcctgcaccctcctgggcccacctccgattcacagaggtttcagggggacccaaatcactgctggttttcaatttttttttaacaatacatttttgtggtcagttccaacagcactgtccgtacttttaaaactggaatgacctccttcagatatcgtgcctcttagtgccaaacccacagtgagaccaaaagtgtcaggtgtttttttttttttctttctcctttgcactaagtgctttgcagacacggcacagcaaacattttgcaaactgcagcagaaatcgaatttaaaacaaaaaggagggactttaaaataccttcttgacaaaaatcaacaatgcacaacttacaaagtgttcattctagggacaaaattaaataaacagaatgtccccaggagtcagcaggtcacagtctggctttgtgatggttgacaaggtctagctacatgggaaagcctgagaagtcactttggaactaaattgcctccattttattttgtacgagtaagggtttgatctacaaaagagctcacatggacgcactgagaacgcctgccagcttccccatgccctcacttggtttgtgttttaggttaagtagtcaatgcccacatcacttcactgtctcaagactgagcacttcactaaatggtagattttactgttaaagaccctacaataagattgttttatctgtacattttttcagatatttaactgtataaaaatgttcattttacacaatatttaattaaagtatttcttgtctgtgaatttcacttttggtaattttctctgtttttgattattaaaatgactaaacactaacat

SEQ ID NO: 459961 - DNA, 1044 bp, Homo sapiens
gaagtgcacggcagggccaggacgggtcgctgtgggtggggactggtctccacacccgcagacggaactggtactgaagggcagtgataactggccggttcctcccatgaatcacctcctgtctgctcttcctttaggaggtgttactgaagcgggcggcggacctggtggaagccttatacggaatgcctcacaacaaccaggagatcatcttgaagcgagcggcggacatcgccgaggcgctgtacagcgttccccgcaatcacaaccagatccccaccctgggcaacaaccctgcacacacgggcatgatgggcgtcaactccttcagcagccagctagccgtcaacgtgtcagagacgtcacaagccaacgaccaagtcggctacagtcgcaatacaagcagcgtgtccccgcgaggctacgtccccagcagtactccccagcagtccaattacaacacagtcagcactagcatgaatggatatggaagtggcgccatggccagtctaggggtccctggctcgcctggatttcttaatggctcctccgctaactctccctacggcatagtgccgtccagccccaccatggcagcctcttcggtcaccctcccttcaaactgtagcagcacacacggcattttctcattctcacctgccaatgtcatctccgcagtgaaacagaagagcgccttcgcgcccgtggtccggccccaagcctctcctcctccttcctgcaccagcgccaacgggaatggactgcaaggtgagggtggtgcggggccgtgggccagtgctgggtcctctccaggggtggggatgggagtgggggtgggggctcggcctttctcctggcacctctgtgactgctgcatgttctcccgtggcccaccttgatgcgtgccacctctgcctggtgttcacagcgaggacccctgtgcactgagccccagaaaggaccagattcctcctcttggtttttgtccagctcacccttccgacggcacctagtgtacttacggtggagcaccctgtgccccta

SEQ ID NO: 459962 - DNA, 795 bp, Homo sapiens
  misc_feature (4)..(4): n is a, c, g, or t
  misc_feature (6)..(6): n is a, c, g, or t
  misc_feature (414)..(414): n is a, c, g, or t
atgncntacgaccgctacgtggccatctgcaaccccctgatttacacagctattatgacgcagcgggtctgcagggagttagtgataggggtctatacctatggcttccgaaactctgtgatacagacagctctgacgtttcagctgtctttctgcaactccgacgtcatccaccacttctactgtgctgacccccctctcctggccctctcctgctctgacacccacaacaaagaaaagcagctcatgatcttctctgcagtaaatctcactgggtccctccttaccatcttcatctcctacatttgcatcctcttttccattataaaaatccagtcttccgagggcaagtgcagagcattttccacccgtgcctcccacctcactgtcgtcaccatcttttatggcacactntttttcatgtacctgcagcaaccaaaagcggggaattcatggaagccaaacaaagtagtctctgtgttttatagtcttgtaattcccatgcttaaccctcttatctatcgcctgagaaacacagaagtaaaggatgccctgaaaaaaatgctagagggcaaagagttatagtgagtgagttaatggaacgcagcatactgaaagtttgatatattgacaagcctcgattctaatacttctttcaaaataattcttaaggcaaacaaatctgccataaaaatgtttattttcctcctattttcaaaagtgattactgttaagtaatttttaatggtttgtaacatatactaccaattaattacaagtaagtttaaaattaat

SEQ ID NO: 459963 - DNA, 1675 bp, Homo sapiens
catagatcaaagtagctccagactgacactttagggaggcttttaaaaaggactgattcctggaccctggttcgcgtctactaaagaagtctggtattcaggaaaaacatgacttaagaagtaaatatggctgagaatgatattatacaaaataaaaagttagccgaattgcttttgatccaaatatgccagggctacgggattccactggctgtagcacctcatcgcctgctcttgcgtcgctgctcctgtctccgtgtaactcacaataaagagattttggcatcaaccgtgagcttaggggtagaagggtatatgttaggaggtgggagcagaatcaattcttcaaatcttaatgatggtgaagaagagtgctcaccagattcccttctggtctggaaaaagaaatcccttcttttgtggatgtcatctctaccatctctcggtgaaaaatatttcaagagaatcctaagatggagagagcattggaagtcatccggcccaattcccttgtgcaattcaaagcttctttgtaagaaaaatgcccccagaagtttgtttgcatcatgaagatcagattttgaggatccagtctggctcttccctgtacaaaacattcctcacaaacagaatatggacaattgttaaatgtcaaaggtaaagttattgtgggaactccttcaaaaagttcaagtgagagcccattctatgaatgaccatttacatctaatttttttctgtgctatgttacttattctgaagtggttgatccaattcctaaaagggaatatttcattaccttttatttcctatagcatccattctgaccccttttcggtttaattattccctgattccagtcttcattcactcatttatttgaggaatatttattgaccaacaactatgccaggtcccattctatgtgtagggactataaagttgaacaagacagaggaggtactggcctcagaatttacattctagtagatgagaaagtaaaaataaacacatgaaaacatgaatgaaccggatattgtagactgtgataggtgtagtttgggtaaagcacagagtgcagtagtaaagataaactgcactcagagtggggctattttagatggaatggagatctctgaggaaatgaaatttgagctgagacctaaaaggtcacccaaggactcatgggaaaactcagttgtttctatcaaaatttagcttcatgaactccaggcccttgcaaatgatggttaccaggtgagaaatgtctcactggcaacagaggttggcagacccagctccagttccatcccagccaacataccaatgtcattaaaataaggccattcatcaaggtggagactattactagaaacaagcattctaaagtgccatttgagtgccaggctctcaacactgggcgtagcactgctccatgaggcttttgagagcatatactgaggcatgaccaaaaaaattaagtcccatgtaagtgatgcaactgctccccaattactgtggaagtatctgcagactaactattgtgcgtgtgtgtttgtttgctttaatgaataaattcagtcaaccaaccatctagctattgactaaatccattctttttcttccaaaatgtctattggctgaagtttactggtttttatttctattcgcatac

SEQ ID NO: 459964 - DNA, 1469 bp, Homo sapiens
cgtggtcaggtccggagtccttgggatcttgcgtcgctgctcctgtctccgtgtaactcacaataaagagattttggcatcaaccgtgagcttaggggtagaagggtatatgttaggaggtgggagcagaatcaattcttcaaatcttaatgatggtgaagaagagtgctcaccagattcccttctggtctggaaaaagaaatcccttcttttgtggatgtcatctctaccatctctcggtgaaaaatatttcaagagaatcctaagatggagagagcattggaagtcatccggcccaattcccttgtgcaattcaaagcttctttgtaagaaaaatgcccccagaagtttgtttgcatcatgaagatcagattttgaggatccagtctggctcttccctgtacaaaacattcctcacaaacagaatatggacaattgttaaatgtcaaaggtaaagttattgtgggaactccttcaaaaagttcaagtgagagcccattctatgaatgaccatttacatctaatttttttctgtgctatgttacttattctgaagtggttgatccaattcctaaaagggaatatttcattaccttttatttcctatagcatccattctgaccccttttcggtttaattattccctgattccagtcttcattcactcatttatttgaggaatatttattgaccaacaactatgccaggtcccattctatgtgtagggactataaagttgaacaagacagaggaggtactggcctcagaatttacattctagtagatgagaaagtaaaaataaacacatgaaaacatgaatgaaccggatattgtagactgtgataggtgtagtttgggtaaagcacagagtgcagtagtaaagataaactgcactcagagtggggctattttagatggaatggagatctctgaggaaatgaaatttgagctgagacctaaaaggtcacccaaggactcatgggaaaactcagttgtttctatcaaaatttagcttcatgaactccaggcccttgcaaatgatggttaccaggtgagaaatgtctcactggcaacagaggttggcagacccagctccagttccatcccagccaacataccaatgtcattaaaataaggccattcatcaaggtggagactattactagaaacaagcattctaaagtgccatttgagtgccaggctctcaacactgggcgtagcactgctccatgaggcttttgagagcatatactgaggcatgaccaaaaaaattaagtcccatgtaagtgatgcaactgctccccaattactgtggaagtatctgcagactaactattgtgcgtgtgtgtttgtttgctttaatgaataaattcagtcaaccaaccatctagctattgactaaatccattctttttcttccaaaatgtctattggctgaagtttactggtttttatttctattcgcatac

SEQ ID NO: 459965 - DNA, 1577 bp, Homo sapiens
gaactctctaagggaaaattagcagtatcagggctgggatgacgtatgatggactacccaatttcagggttggacagtaacataggggggtcgcctaataaatttaaggcccgaaaccaaatacctactgggtttgagtcagcactcttctggtggtcaactattaagattgtgaattggattaactacatctattgtaatcaacaaagattcatcagttatacttggaatgcactcaaagggatggtgtatgtttcatgtggagaactctggatcaatcctgacctgtccattgctcagcaaaagaaacaaatattcctgaggaacctagaatcagacattgccaaaattcaaatcttctgcagcacacataaaatagaagaagtccaaagtgacattgtatctggaagcaagcttgctgtgcataaacctgtagcaatttttggagaagagaagcaagttacagaaccggaagaaaagcaaatgcaagaagatcctctaacaacggaaaatgcttccagtgaaattctgtatgcctggcaggaaacttcacatgactttgatgaggatgacagtcttccaaagaaaacggaaaaagggctctttgaaaatgtggaaccacagaagaaacacagctgttcaccaaagcatagtaaattgcacaagcattgtcatcagcagttcgaatacagagatgggcagattataagccatgctgctcctcagctagtcttgggggttcaaggtcccaatctccgatcaggcatggaggtggttttggtggagaagaaatctgatggtagtcatcagcgctggatacaccaggaagacagcagtaaccctgaccttgtgctggcagtgtctatgaccaagactagaaatgaagtttgtggctatccagttattgttcagaaatataagccgtacaacaatggagctgccaatcaaaagtggcattacatgaaaaatataaaagcacttgtggcctttcatagcactgccttggataaggaaattacatcagcaaattatgctggtgtctgtacatcatctgtgattaaagaagaaaacattgatcaaccaggatactgttatctctcacctgatggaaagagaaaaactatgctctgcttggcttgtggacaatccatgagaacagagaaaggactgaaacaattgcttccaggggttccattcctctgtatttcaggcaccaagactcagaagcccttcttacaagggcccttcaaggtcatcagtgtggctgaggtatgtaatgatctgagctctgctaatgcatgtatggcaacaatttggaaactttgatgcattcattatctgccttgcactcaagttcatctccactcatccaattcatcttcctcagatgcacctttaccattctacctgcattgatttccttttccccattgtaatttaaaatgcattgtctattaatagttcaatagactctttgaagttaattgggcacttctgcagctttaatcatttactgacatatttcactgttctcagtgttgcttttaggtgaggaagtaactgcaaatctttacttc

SEQ ID NO: 459966 - DNA, 1307 bp, Homo sapiens
ggtggagcgccgcgggggcccccctgagccggggcgggtcgggggcgggaccagggtccggccggggcgtgcccgaggggagggactccccggcttgcgacccggcgttgtccgcggtgctcagcgcccgcccgggcgcgccatggggaaccgcagcaccgcggacgcggacgggctgctggctgggcgcgggccggccgcgggggcatctgcgggggcatctgcggggctggctgggcagggcgcggcggcgctggtggggggcgtgctgctcatcggcgcggtgctcgcggggaactcgctcgtgtgcgtgagcgtggccaccgagcgcgccctgcagacgcccaccaactccttcatcgtgagcctggcggccgccgacctcctcctcgctctcctggtgctgccgctcttcgtctactccgaggtgagccgcgtccggccgcacgagcatcctcacctgctcctcggttccccgtccctgtccctacggaggacccggcgcgacccggcccctttctggtgcggagcttccagctggggcggcggcaggggcgctgcgccttgtccctcggcgatacacccaccgccgccacctcgcgaccttccacccgctgcgctgtctgtcccccgaccctcgttcctcttctccttccccgtctgtcttggcgtctgttatccaggagatgcccgtccttctatccagggaccccggaaacaggcgactttgtcaagcccagtcccctccgtagctggatttcacctccagggcagccagctggacagacaggcagatgcaggctcagccccctggctgccgtgggacacacacacacacacactgccacagccactgcccaccacacacacctagtgcagatgctggcacacccccagaaggaggctcacagctcgcaggggagacctgggctggacaaaacccaggggaggggagggtgtgtggggaccaggcccctgctgagaaccctggggggaagcctgagggggaattgggggatggagcccacactccacaccaggtctggccctcgagtgggtcggccttggtgccagcccctctgcggccagagaaaagcagcttagggctgagctggagacgcggtgtccccgactgtgggggagggggactcgaggtttccccttgatggacacagtgaatccaggcggctggggcagagaccagcagcacgggacacgcgtgacctgtgctcctttcgagccgcagacgtcacagtgacgacgtttaagctcctaatctccccaaatcggcgggaaggattagaggg

SEQ ID NO: 459967 - DNA, 1756 bp, Homo sapiens
ggtggagcgccgcgggggcccccctgagccggggcgggtcgggggcgggaccagggtccggccggggcgtgcccgaggggagggactccccggcttgcgacccggcgttgtccgcggtgctcagcgcccgcccgggcgcgccatggggaaccgcagcaccgcggacgcggacgggctgctggctgggcgcgggccggccgcgggggcatctgcgggggcatctgcggggctggctgggcagggcgcggcggcgctggtggggggcgtgctgctcatcggcgcggtgctcgcggggaactcgctcgtgtgcgtgagcgtggccaccgagcgcgccctgcagacgcccaccaactccttcatcgtgagcctggcggccgccgacctcctcctcgctctcctggtgctgccgctcttcgtctactccgaggtccagggtggcgcgtggctgctgagcccccgcctgtgcgacgccctcatggccatggacgtcatgctgtgcaccgcctccatcttcaacctgtgcgccatcagcgtggacaggtgcgccgccctccccgcccgcgccccggcgcccccgcgccccgcccgccgccctcaccgcggcctgtgcgctgtccggcgccccctcggcgctccccgcaggttcgtggccgtggccgtgccgctgcgctacaaccggcagggtgggagccgccggcagctgctgctcatcggcgccacgtggctgctgtccgcggcggtggcggcgcccgtactgtgcggcctcaacgacgtgcgcggccgcgaccccgccgtgtgccgcctggaggaccgcgactacgtggtctactcgtccgtgtgctccttcttcctaccctgcccgctcatgctgctgctctactgggccacgttccgcggcctgcagcgctgggaggtggcacgtcgcgccaagctgcacggccgcgcgccccgttttcccagcggccctggcccgccttcccccacgccacccgcgccccgcctcccccaggacccctgcggccccgactgtgcgccccccgcgcccggccttccccggggtccctgcggccccgactgtgcgcccgccgcgcccagcctcccccaggacccctgcggccccgactgtgcgccccccgcgcccggcctccccccggacccctgcggctccaactgtgctccccccgacgccgtcagagccgccgcgctcccaccccagactccaccgcagacccgcaggaggcggcgtgccaagatcaccggccgggagcgcaaggccatgagggtcctgccggtggtggtcggggccttcctgctgtgctggacgcccttcttcgtggtgcacatcacgcaggcgctgtgtcctgcctgctccgtgcccccgcggctggtcagcgccgtcacctggctgggctacgtcaacagcgccctcaaccccgtcatctacactgtcttcaacgccgagttccgcaacgtcttccgcaaggccctgcgtgcctgctgctgagccgggcacccccggacgccccccggcctgatggccaggcctcagggaccaaggagatggggagggcgcttttgtacgttaattaaacaaattccttcccaaactcagctgtgaaggctcctgggggctgatggggagtggggaagaggggtttctgcctcagtggccccaggccccccagccagttaacctctttctccccgccaaggaagcccacagagcagaccccaccaagccggccgcctgctcagg

SEQ ID NO: 459968 - DNA, 1661 bp, Homo sapiens
acaaatcagccgggggtggtggcgcgcggctgtaatcccagctactctggagactgaggtgggaggatcgcttgagctcaggaattccaggctacagtgagccatgatggagccacagcactccagccgcggtgacacagcgagaccctaactcaaaacaaagggagatctgcgtggggaaggggtgtttccctgcccggtcctctggcctctggctcacagccgggcccccttctccgtattcagccctggaactacccataagagtgggggggggtcacaagggcccgcggtggctgggaaacctcagggcctgtggtgtcgccgcgcaggtccagggtggcgcgtggctgctgagcccccgcctgtgcgacgccctcatggccatggacgtcatgctgtgcaccgcctccatcttcaacctgtgcgccatcagcgtggacaggtgcgccgccctccccgcccgcgccccggcgcccccgcgccccgcccgccgccctcaccgcggcctgtgcgctgtccggcgccccctcggcgctccccgcaggttcgtggccgtggccgtgccgctgcgctacaaccggcagggtgggagccgccggcagctgctgctcatcggcgccacgtggctgctgtccgcggcggtggcggcgcccgtactgtgcggcctcaacgacgtgcgcggccgcgaccccgccgtgtgccgcctggaggaccgcgactacgtggtctactcgtccgtgtgctccttcttcctaccctgcccgctcatgctgctgctctactgggccacgttccgcggcctgcagcgctgggaggtggcacgtcgcgccaagctgcacggccgcgcgccccgttttcccagcggccctggcccgccttcccccacgccacccgcgccccgcctcccccaggacccctgcggccccgactgtgcgccccccgcgcccggccttccccggggtccctgcggccccgactgtgcgcccgccgcgcccagcctcccccaggacccctgcggccccgactgtgcgccccccgcgcccggcctccccccggacccctgcggctccaactgtgctccccccgacgccgtcagagccgccgcgctcccaccccagactccaccgcagacccgcaggaggcggcgtgccaagatcaccggccgggagcgcaaggccatgagggtcctgccggtggtggtcggggccttcctgctgtgctggacgcccttcttcgtggtgcacatcacgcaggcgctgtgtcctgcctgctccgtgcccccgcggctggtcagcgccgtcacctggctgggctacgtcaacagcgccctcaaccccgtcatctacactgtcttcaacgccgagttccgcaacgtcttccgcaaggccctgcgtgcctgctgctgagccgggcacccccggacgccccccggcctgatggccaggcctcagggaccaaggagatggggagggcgcttttgtacgttaattaaacaaattccttcccaaactcagctgtgaaggctcctgggggctgatggggagtggggaagaggggtttctgcctcagtggccccaggccccccagccagttaacctctttctccccgccaaggaagcccacagagcagaccccaccaagccggccgcctgctcagg

SEQ ID NO: 459969 - DNA, 688 bp, Homo sapiens
aactacggtagcatgaagccaaacgagggttccacagaagtctccaatcttcaaatcttcagtgtatgaaagcacagattcctgaaagaatggcctcaaatgaccaggagtaggagctctctatatccctgctcctgaaaaacaagctaactggagtctccatcacctgccaccagctatacacactaccaactacccaactgaactccatgactgatttgccagctaatcatgcccctgacccagcccacatggacatgggaaggacatcagtgaactgtgaaaagagaggctggagtgcaatggcacaatttcggctatccacaatctctgtctcccagattcaagctattctcctgcctctgtctcccgaggagctgggattacagatgaaagcaccattatcaagtcagaagagcacaagtcaaaccactgtaagttgaggattctctgtactttcttaaatgtttgatagaattcacctaagaaagcatgtagcctataattatagaaatatttttaaattaaaaaaattcttcaatacatagagaagctattactttttctatttcattttgcatccgttttaggaattagttttacaaataatttcccatgttattttaattgtcaaatgtattggcctaaagttttcataattatattgatgtctgtaggttctgtagtt

SEQ ID NO: 459970 - DNA, 1295 bp, Homo sapiens
cccaggaggggagacaatggtattactcacagtatcaaagaggttgtacagcccccctgtgatagtttctaatatccaggggatgtataccacccttgtgatattgtttctaatatgtagggggaaggacaatgatattactgtccgtatcacagggggtgtacaacaagccccccgggatatcattcctaatatccatgggaagaaagaatattataatatcacagaagttgtaaaccccctctgtgatattgttcctaatatcaaagacagaaggtactataaatatcgcaaggggtgtacaccccttctgatattgttactaatatccgtggggggagtcgatgatattacttccaatatcacagggcatgtacaccccacttgtgatattgttcctaatatcctgggaggagactacgatattactggcaatatcgcagggtgtgtgcattcccgtgatattgttcctaatgtccagcaagggagaaaatattactcccaatatggcgggggtgtacacttcccatgcgatatcgttcctaatatccatgggggaaaaggatgatattactctaaatggcgcaggaggtgtaaaccgcccctgtgatattgttctcaatatccatagggggagagaatgatattactcccaatatcacaggtggtgtacacccctccttttatattattcctaatatcctaggttgggagagaataatattacaggtaaaatagcagggggtgtacactctgcctgtgatattgttcctaatatcccagggaagagtggacaatattactctcaatatcgcaggatgtgtacaccccctttgtgatattgttcctaatatccataggcggagagggtgataccactcccaatagtgcagaaaaggctggagtgcaatggcacaatttcggctatccacaatctctgtctcccagattcaagctattctcctgcctctgtctcccgaggagctgggattacagatgaaagcaccattatcaagtcagaagagcacaagtcaaaccactgtaagttgaggattctctgtactttcttaaatgtttgatagaattcacctaagaaagcatgtagcctataattatagaaatatttttaaattaaaaaaattcttcaatacatagagaagctattactttttctatttcattttgcatccgttttaggaattagttttacaaataatttcccatgttattttaattgtcaaatgtattggcctaaagttttcataattatattgatgtctgtaggttctgtagtt

SEQ ID NO: 459971 - DNA, 1794 bp, Homo sapiens
ctgttccctttgccatgcaaaagctgtttagtttaattaagtcccagctatttatctttgtttttattgcatttgcatttgggttcttggtcatgaaatccttgcgtatttctaggaggtttctagaggagtccatagggttttctaaacaaaagattatatcatcagcaacaagtgacagtttgacttcctctttaccgatttggatttcctctatttccttcttttgtctgattgctctggctaggacttccagtactatgttgaagaagagtggtgagagtgggctcctcgtcttgttccagttctcaaagggaatgctttcaccgtttccccattcagtattatgttggctgtgggtttgtatagatggcttttattacattaagggatcatggcacaagttgcagtttccaccctgcccatggaagatgaggagtccatggaagatgaggagtccattgaagatgaggagtctgttgaagatgattccgtggagagcaggatggtggtgacatttctcatatcagctcccgagtccacggtgagaccttctgttctaacatgatataattgggtagaactgggtggtagataaggttgatttgtttttgtagaacttataattttatgatttgtagttctaatgagtagatctttttctggaatagtagttatggtcaaacacttctaaccaaatgtgccatgttgtccagtctggtctcaaaatatggggctcaagagacctgcccaccttggcctcccaaaatactgggattacaggtgtaagccgctgaatctggccagatatttttctttttatggctgaataatactctgtgtatgtatatattacattttctttatctattcacctactgatgggcattaggtttgggctaccttttggccactgtgaataatgctgctgttaatcgggtgtacaaatacctgtttgagtccctgctctcagttcttttgggtatatatgcttaaagggtgtggatggatcatataattctatgcttcatatttttaaggagctgctaaaccattttccacagtgggctgtaccattttacattccaaaaagcaatgcatacagcttccaatttctctatagcattgctgacagttaatattttctgtttatgtattgtatttttatagtgtttgaaattaatctgaggctttttgctgataccaaaatattaggaaaggttttccaaaaataatactgcttattataaaggattttacgtgttacttgatgccctgtgatctgttttctaagtaagaagaggaacttcttggctgggcacagcagctcatgcctgtaatcctagcacttttggaggccgagctgaaaatagttaattttatgtatattccaagtcagaatacatcctatttttgaatatttgatgactttaggatactatattaactcttaattgaattaatacaagtttaggtgtaaagatgatgtttatgttgacaaaaatgattaatgttttacatatatgaaagtaacaatatcatatatttttcatacttgtagaatactttgaaatctattattagctaatattttatattcattttgggttttcacattattgttagatccagagaaaagtaatattttgtgaatactcaaatcataaacattttgctggatgcattcatagatactttatttaaaaagtacactaattgaagttttacaccattttatgattcatcaaacacagcaactgaatactggcgtatatcaacattacagatgatgtt

SEQ ID NO: 459972 - DNA, 1490 bp, Homo sapiens
gcgcctgcgccggcgctgtgcgactttgcgagggcggagctgcgttcttcccagcacagacaaggagagcatcgccagggcggagggatcatggcacaagttgcagtttccaccctgcccatggaagatgaggagtccatggaagatgaggagtccattgaagatgaggagtctgttgaagatgattccgtggagagcaggatggtggtgacatttctcatatcagctcccgagtccacggtgagaccttctgttctaacatgatataattgggtagaactgggtggtagataaggttgatttgtttttgtagaacttataattttatgatttgtagttctaatgagtagatctttttctggaatagtagttatggtcaaacacttctaaccaaatgtgccatgttgtccagtctggtctcaaaatatggggctcaagagacctgcccaccttggcctcccaaaatactgggattacaggtgtaagccgctgaatctggccagatatttttctttttatggctgaataatactctgtgtatgtatatattacattttctttatctattcacctactgatgggcattaggtttgggctaccttttggccactgtgaataatgctgctgttaatcgggtgtacaaatacctgtttgagtccctgctctcagttcttttgggtatatatgcttaaagggtgtggatggatcatataattctatgcttcatatttttaaggagctgctaaaccattttccacagtgggctgtaccattttacattccaaaaagcaatgcatacagcttccaatttctctatagcattgctgacagttaatattttctgtttatgtattgtatttttatagtgtttgaaattaatctgaggctttttgctgataccaaaatattaggaaaggttttccaaaaataatactgcttattataaaggattttacgtgttacttgatgccctgtgatctgttttctaagtaagaagaggaacttcttggctgggcacagcagctcatgcctgtaatcctagcacttttggaggccgagctgaaaatagttaattttatgtatattccaagtcagaatacatcctatttttgaatatttgatgactttaggatactatattaactcttaattgaattaatacaagtttaggtgtaaagatgatgtttatgttgacaaaaatgattaatgttttacatatatgaaagtaacaatatcatatatttttcatacttgtagaatactttgaaatctattattagctaatattttatattcattttgggttttcacattattgttagatccagagaaaagtaatattttgtgaatactcaaatcataaacattttgctggatgcattcatagatactttatttaaaaagtacactaattgaagttttacaccattttatgattcatcaaacacagcaactgaatactggcgtatatcaacattacagatgatgtt

SEQ ID NO: 459973 - DNA, 1420 bp, Homo sapiens
gcaggccaaagcatggctggccccatagacccttgtaataagcttcttagggtttcttggatgctaaaaattgcatgtcaggtcccttccctgctcctttcccagcaaagcaccaactccagtctagaggaaattaactgtcatggtttttctcttgcagcctatcactgggacacctctgattggatgccaggggcccgcctgtcggacatagaggaagtgcccaactatgagaaccaggatggagggtctgcacaccaggggagcacacgggagctggagagcgattactacctgggtggttatgacattgacagtgaatacccaccccctcatgaagaggagttcttgagtcaggaccagctgcctcctcctctcccggaggacttcccagaccaatatgaggccctgccaccctcccagcctgtctccctggccagcacactgagcccagactgcaggagaaggccccagtttcatcctagccagtatctccctcctcacccattccccaacgaaacggatttggtgggcccgcctgccagctgtgaatttagtacttttgctgtgagcatgaaccagggcacagagcccacaggcccagcagacagcgtgtctctgtccttgcacaattccagaggcacctcatcctcggatgtgtctgccaactgcggctttgacgattccgaagtagccatgagtgactacgagagcgtgggagagctcagcctcgccagccttcacattccctttgtggagactcagcatcagactcaagtgtagacatcacatcttgggtacttcaccctgtttgttacagaaaagtggaagcagattggctgggcttctgtcccagtggagcattgtctgtggaatgagaagggaatactgtatttttccactagaaacttcttcacaagtcatactgtcccaacaagcaagcttgattccagttgggtgaaaatgaaaggctcagaaattgtttttgagaggtgactggtaatccttgattttctgatgacatatggcattggtgtgtaaattgtactgtccctagtctgtgcattattcactcagacatatttttagttatttcaattgcgtttaatccacttcttttttatgagtcagtgtttctgaatgtttatgcaaaaaaaaaaatcctttttcattcccaaactttctaagtaagtggatacactacacttcacaagttttccagcctttctcttcctgtctcttggtcagacctactcatggaggtattatccacactgtgatcttgaaataaatgaatttcactaaggctgctttcgagaacaaagtctttggtatttttcttatgtaagaagcacatttgcaagaatcatggaaaaaaatgacaaactaatggcctagaatagagtgactgctacacttt

SEQ ID NO: 459974 - DNA, 2123 bp, Homo sapiens
tttgggcatctgcagagggcgaggaactggtcacggcgccgggtgggcttgcagctgtgacgcttatgtggacacctcagtgtcgctggtggttcacctcggcttcccagtttatttattgacgtcaacaaataaatgttgaataaggaagaagagttagaattgcttgaagccctctggagttttagcactagtcccgcccactcccttctacttccaggtcgggggggggcgggtccaatagaaaggcggaagccagtgtcccaggcgttctcacgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcaggtccctgtggggggactctccaggaagattccgcaagaaccgtgggcgacagttatggagaagcgtctgcaggaggctcagctgtacaaggaggaagggaaccagcgctaccgggaagggaagtaccgagatgctcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaagaaaagcagtattattagtttcatgtgtagggggttgatgcttaatcagacatacacaatatatatgttggtatgtctgtttcatatatgtatgtatgcctattctaatatataaatatatgtatatcaacgtgcttttatttataaatatacagtgtatatatttatacatatacatgaatatatatataaaataggcaggccagtaaataaataaaataaataaataaataaataaataaaaattagcagccgggacagagattgttttttttcaattccaaatgttattaattaatgagatttactattgcatagaatggttgcgatatattcagatcttggagagattttaaaatgggagcatgttaacattctctcctgccacaaggtatgattatggtcttaactgactctaactgtttctaattgcttctccatcatcttccaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccagttccaggatccatgtgcaggatatgcaggtttgttacatagggaaacgtgtgcctcggtggtttgctgcacctatcaacacatcacctcggtattaagtccagcatgtattagctatttttcctcatgttctcccaccccccgccacagcccctgttaaattaatttcttattctccttaatattccatacacattcagattccttctcccctacaaaaatatttgctattttgtccttgctatttctcatacttagatcattcatacactatatttattttttcattaaactattttaaaacctttggagtaaagcatttaagtatttatttaataaacccttcagacctcatgctaaagaaaacacctaagtgaacattttaaattttaataggtgcttatctatagtatcctcatttctcttaaaaaaaaaaaaaaaaaaaaaaaaaaagaccatcctggctaacacggtgaaactccgtctctactaaaaatacaaaaaaaaaaaattagctgggcttggtagcgtgtgcctgtagtcccagctactcgggaggctgaggcaggagaatggcgtgaactcaggaggtggagcttgcagtgagccgagatcacgccactgcactccagcctgggtgacagagagagactccatctcaaaaaaaagaaaaga

SEQ ID NO: 459975 - DNA, 900 bp, Homo sapiens
cagctgggattacaggcatgtgccaccacgcccggctaatttttttgtatttcctttttagtagagacatggttttgccatgttggccagggtgctcttgaactcctggcctcaagtgatccacccactcgggctcccaaagtgctgggattacaggtgtgagccgactatgcctggccaaaagtaaccattttgtttaattttttctttttcttttaattttaagttccaggatccatgtgcaggatatgcaggtttgttacatagggaaacgtgtgcctcggtggtttgctgcacctatcaacacatcacctcggtattaagtccagcatgtattagctatttttcctcatgttctcccaccccccgccacagcccctgttaaattaatttcttattctccttaatattccatacacattcagattccttctcccctacaaaaatatttgctattttgtccttgctatttctcatacttagatcattcatacactatatttattttttcattaaactattttaaaacctttggagtaaagcatttaagtatttatttaataaacccttcagacctcatgctaaagaaaacacctaagtgaacattttaaattttaataggtgcttatctatagtatcctcatttctcttaaaaaaaaaaaaaaaaaaaaaaaaaaagaccatcctggctaacacggtgaaactccgtctctactaaaaatacaaaaaaaaaaaattagctgggcttggtagcgtgtgcctgtagtcccagctactcgggaggctgaggcaggagaatggcgtgaactcaggaggtggagcttgcagtgagccgagatcacgccactgcactccagcctgggtgacagagagagactccatctcaaaaaaaagaaaaga

SEQ ID NO: 459976 - DNA, 887 bp, Homo sapiens
tttgggcatctgcagagggcgaggaactggtcacggcgccgggtgggcttgcagctgtgacgcttatgtggacacctcagtgtcgctggtggttcacctcggcttcccagtttatttattgacgtcaacaaataaatgttgaataaggaagaagagttagaattgcttgaagccctctggagttttagcactagtcccgcccactcccttctacttccaggtcgggggggggcgggtccaatagaaaggcggaagccagtgtcccaggcgttctcacgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcaggtccctgtggggggactctccaggaagagctcccaaccccagagcttcacttgctccttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctggtaagaacggggctaaagggtggctagagagcattaagacaggaacatgaacatctgtgaacattgggggaaaaaac

SEQ ID NO: 459977 - DNA, 1483 bp, Homo sapiens
aggctggtactggcccggaaggtagggatcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcaggtccctgtggggggactctccaggaagaagggtaatttcctgcctccttaaattggctgctactgtcagttattttgctcccaaccccagagcttcacttgctccttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccaggtggatttttgtttctagttctgcacaaacttcactacttagacagtctgagtctttttctgtctatccatctgtttatttctatacctttcaatacatgttattgttgcagatatttggcttgagaaatataatcagaaaacataaaaaaaaaatgggtggaattaatcatatctctggtatagatttttcatgacagtgttgttagatgtacttatatacagaggcgacagcttgcagaggacgacatagtaaggataggcagaaagaattgtcttcctttattttttcagaagcccaaaccaaagtgggaaatatggccgggcgctctagctcatgcctgtaatcccagcacattgggaggctgaggcaggagaatggcatgaacccgggaggtggagcttgcagtgagcagagatcacgccactgcactccagcctgggcaacagagcgagactccgtctcaaaaaaaaaaaaaaatgcaaagattagctgggccaggtgttcacctgtagtcccagctattc

SEQ ID NO: 459978 - DNA, 1342 bp, Homo sapiens
cgctgaggaggcggggtcgtttctgcgggattatttttccggagcctcttctgattgggtggtgtggcgcaatgcgcgcgaccctcaagataccaaactgtacgcatctctgaccctttcctctccttgctcctgctggtaaaccgaagcccaggagacttccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccaggtggatttttgtttctagttctgcacaaacttcactacttagacagtctgagtctttttctgtctatccatctgtttatttctatacctttcaatacatgttattgttgcagatatttggcttgagaaatataatcagaaaacataaaaaaaaaatgggtggaattaatcatatctctggtatagatttttcatgacagtgttgttagatgtacttatatacagaggcgacagcttgcagaggacgacatagtaaggataggcagaaagaattgtcttcctttattttttcagaagcccaaaccaaagtgggaaatatggccgggcgctctagctcatgcctgtaatcccagcacattgggaggctgaggcaggagaatggcatgaacccgggaggtggagcttgcagtgagcagagatcacgccactgcactccagcctgggcaacagagcgagactccgtctcaaaaaaaaaaaaaaatgcaaagattagctgggccaggtgttcacctgtagtcccagctattc

SEQ ID NO: 459979 - DNA, 1723 bp, Homo sapiens
tttgggcatctgcagagggcgaggaactggtcacggcgccgggtgggcttgcagctgtgacgcttatgtggacacctcagtgtcgctggtggttcacctcggcttcccagtttatttattgacgtcaacaaataaatgttgaataaggaagaagagttagaattgcttgaagccctctggagttttagcactagtcccgcccactcccttctacttccaggtcgggggggggcgggtccaatagaaaggcggaagccagtgtcccaggcgttctcacgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcaggtccctgtggggggactctccaggaagaagggtaatttcctgcctccttaaattggctgctactgtcagttattttgctcccaaccccagagcttcacttgctccttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccaggtggatttttgtttctagttctgcacaaacttcactacttagacagtctgagtctttttctgtctatccatctgtttatttctatacctttcaatacatgttattgttgcagatatttggcttgagaaatataatcagaaaacataaaaaaaaaatgggtggaattaatcatatctctggtatagatttttcatgacagtgttgttagatgtacttatatacagaggcgacagcttgcagaggacgacatagtaaggataggcagaaagaattgtcttcctttattttttcagaagcccaaaccaaagtgggaaatatggccgggcgctctagctcatgcctgtaatcccagcacattgggaggctgaggcaggagaatggcatgaacccgggaggtggagcttgcagtgagcagagatcacgccactgcactccagcctgggcaacagagcgagactccgtctcaaaaaaaaaaaaaaatgcaaagattagctgggccaggtgttcacctgtagtcccagctattc

SEQ ID NO: 459980 - DNA, 1754 bp, Homo sapiens
tttgggcatctgcagagggcgaggaactggtcacggcgccgggtgggcttgcagctgtgacgcttatgtggacacctcagtgtcgctggtggttcacctcggcttcccagtttatttattgacgtcaacaaataaatgttgaataaggaagaagagttagaattgcttgaagccctctggagttttagcactagtcccgcccactcccttctacttccaggtcgggggggggcgggtccaatagaaaggcggaagccagtgtcccaggcgttctcacgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcaggtccctgtggggggactctccaggaagaagggtaatttcctgcctccttaaattggctgctactgtcagttattttgctcccaaccccagagcttcacttgctccttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccaggtggatttttgtttctagttctgcacaaacttcactacttagacagtctgagtctttttctgtctatccatctgtttatttctatacctttcaatacatgttattgttgcagatatttggcttgagaaaatttatattcgagaaaatataacaggaaaaaaaaaaaaaaaaaaaaaaaaaaaaaatttgggggcggcttgggccccgggaaaaggttcctaaaaccattcgcgttgtgggccggcgggtgccccaagtagggtatacggtgaacactgggcgccataagcgcgtgtccccaaggggaaacctccggggacaaggaacaacagggcgtgggtttccccacccaaataagaaaaaaccccgggggggaacacccggaaggtgttccgagacacaatacccgagaaagggagaccccggagggcaaaacaagggggacctctccacaaggaggagactccaaagggagaaccccgaataccgagataaccccggcccgcggga

SEQ ID NO: 459981 - DNA, 780 bp, Homo sapiens
tactactactaaattcgcggccgcgtcgaccgtgaataggcagcctaaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccaggtggatttttgtttctagttctgcacaaacttcactacttagacagtctgagtctttttctgtctatccatctgtttatttctatacctttcaatacatgttattgttgcagatatttggcttgagaaatataatcagaaaacataaaaaaaaaatgggtggaattaatcatatctctggtatagatttttcatgacagtgttgttagatgtacttatatacagaggcgacagcttgcagaggacgacatagtaaggataggcagaaagaattgtcttcctttattttttcagaagcccaaaccaaagtgggaaatatggccgggcgctctagctcatgcctgtaatcccagcacattgggaggctgaggcaggagaatggcatgaacccgggaggtggagcttgcagtgagcagagatcacgccactgcactccagcctgggcaacagagcgagactccgtctcaaaaaaaaaaaaaaatgcaaagattagctgggccaggtgttcacctgtagtcccagctattc

SEQ ID NO: 459982 - DNA, 279 bp, Homo sapiens
ttttttttttttttgaccacttggtggggatgttgtagaagggatacagacatcagcacaggccctttaatgtgctcatcactgctgattcttgatctttctcagcaccatgatttaataatactatgtttaattcccacagttgtgaaatagggagtgtttcccttcttaatcataaaaaggcagaacattgacctgaattgcctgaattgactcctctgcaggtttgtatttcaaggtcccattaagtcatccaagagaatagtgaagttatatgct

SEQ ID NO: 459983 - DNA, 513 bp, Homo sapiens
ggacgacatagtaaggataggcagaaagaattgtcttcctttattttttcagaagcccaaaccaaagtgggaaatatggccgggcgctctagctcatgcctgtaatcccagcacattgggaggctgaggccagcggatcacctgaggtcaggagttcaagaccagcctgaccaacagggtaaaaccctgtctctactaaaaatacaaaaattagcctggcaagatgacacacgcctgtggtctcaggtactggaaactagacaattataaatgagccaggctgggcatggtggctcacgcctgtaatcccagcactttggaaggcagaggtagacagatagatagcttgagtccaggagttcaagaccagcctggggaacacagtgaaaccctgtctctataaaagatgcaaagatggccgggcacggtgggtcaggcctgtaatcccagcactttgggaggccgaggcaggtagatcatgaggtcaggagattgagaccatcctggctaaca

SEQ ID NO: 459984 - DNA, 1771 bp, Homo sapiens
tttgggcatctgcagagggcgaggaactggtcacggcgccgggtgggcttgcagctgtgacgcttatgtggacacctcagtgtcgctggtggttcacctcggcttcccagtttatttattgacgtcaacaaataaatgttgaataaggaagaagagttagaattgcttgaagccctctggagttttagcactagtcccgcccactcccttctacttccaggtcgggggggggcgggtccaatagaaaggcggaagccagtgtcccaggcgttctcacgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcaggtccctgtggggggactctccaggaagaagggtaatttcctgcctccttaaattggctgctactgtcagttattttgctcccaaccccagagcttcacttgctccttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccaggtggatttttgtttctagttctgcacaaacttcactacttagacagtctgagtctttttctgtctatccatctgtttatttctatacctttcaatacatgttattgttgcagatatttggcttgagaaatataatcagaaaacataaaaaaaaaatgggtggaattaatcatatctctggtatagatttttcatgacagtgttgttagatgtacttatatacagaggcgacagcttgcagaggacgacatagtaaggataggcagaaagaattgtcttcctttattttttcagaagcccaaaccaaagtgggaaatatggccgggcgctctagctcatgcctgtaatcccagcacattgggaggctgaggcaggagaatggcatgaacccgggaggtggagcttgcagtgagcagagatcacgccactgcactccagcctgggcaacagagcgagactccgtctcaaaaaaaaaaaaaaatgcaaagattagctgggccaggtgttcacctgtagtcccagctattc

SEQ ID NO: 459985 - DNA, 1682 bp, Homo sapiens
tttgggcatctgcagagggcgaggaactggtcacggcgccgggtgggcttgcagctgtgacgcttatgtggacacctcagtgtcgctggtggttcacctcggcttcccagtttatttattgacgtcaacaaataaatgttgaataaggaagaagagttagaattgcttgaagccctctggagttttagcactagtcccgcccactcccttctacttccaggtcgggggggggcgggtccaatagaaaggcggaagccagtgtcccaggcgttctcacgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcaggtccctgtggggggactctccaggaagattccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccaggtggatttttgtttctagttctgcacaaacttcactacttagacagtctgagtctttttctgtctatccatctgtttatttctatacctttcaatacatgttattgttgcagatatttggcttgagaaatataatcagaaaacataaaaaaaaaatgggtggaattaatcatatctctggtatagatttttcatgacagtgttgttagatgtacttatatacagaggcgacagcttgcagaggacgacatagtaaggataggcagaaagaattgtcttcctttattttttcagaagcccaaaccaaagtgggaaatatggccgggcgctctagctcatgcctgtaatcccagcacattgggaggctgaggcaggagaatggcatgaacccgggaggtggagcttgcagtgagcagagatcacgccactgcactccagcctgggcaacagagcgagactccgtctcaaaaaaaaaaaaaaatgcaaagattagctgggccaggtgttcacctgtagtcccagctattc

SEQ ID NO: 459986 - DNA, 1853 bp, Homo sapiens
tttgggcatctgcagagggcgaggaactggtcacggcgccgggtgggcttgcagctgtgacgcttatgtggacacctcagtgtcgctggtggttcacctcggcttcccagtttatttattgacgtcaacaaataaatgttgaataaggaagaagagttagaattgcttgaagccctctggagttttagcactagtcccgcccactcccttctacttccaggtcgggggggggcgggtccaatagaaaggcggaagccagtgtcccaggcgttctcacgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcaggtccctgtggggggactctccaggaagaagggtaatttcctgcctccttaaattggctgctactgtcagttattttgctcccaaccccagagcttcacttgctccttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgttgtgaaatagggagtgtttcccttcttaatcataaaaaggcagaacattgacctgaattgcctgaattgactcctctgcagcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccaggtggatttttgtttctagttctgcacaaacttcactacttagacagtctgagtctttttctgtctatccatctgtttatttctatacctttcaatacatgttattgttgcagatatttggcttgagaaatataatcagaaaacataaaaaaaaaatgggtggaattaatcatatctctggtatagatttttcatgacagtgttgttagatgtacttatatacagaggcgacagcttgcagaggacgacatagtaaggataggcagaaagaattgtcttcctttattttttcagaagcccaaaccaaagtgggaaatatggccgggcgctctagctcatgcctgtaatcccagcacattgggaggctgaggcaggagaatggcatgaacccgggaggtggagcttgcagtgagcagagatcacgccactgcactccagcctgggcaacagagcgagactccgtctcaaaaaaaaaaaaaaatgcaaagattagctgggccaggtgttcacctgtagtcccagctattc

SEQ ID NO: 459987 - DNA, 1918 bp, Homo sapiens
tttgggcatctgcagagggcgaggaactggtcacggcgccgggtgggcttgcagctgtgacgcttatgtggacacctcagtgtcgctggtggttcacctcggcttcccagtttatttattgacgtcaacaaataaatgttgaataaggaagaagagttagaattgcttgaagccctctggagttttagcactagtcccgcccactcccttctacttccaggtcgggggggggcgggtccaatagaaaggcggaagccagtgtcccaggcgttctcacgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcaggtccctgtggggggactctccaggaagaagggtaatttcctgcctccttaaattggctgctactgtcagttattttgctcccaaccccagagcttcacttgctccttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccagttccaggatccatgtgcaggatatgcaggtttgttacatagggaaacgtgtgcctcggtggtttgctgcacctatcaacacatcacctcggtattaagtccagcatgtattagctatttttcctcatgttctcccaccccccgccacagcccctgttaaattaatttcttattctccttaatattccatacacattcagattccttctcccctacaaaaatatttgctattttgtccttgctatttctcatacttagatcattcatacactatatttattttttcattaaactattttaaaacctttggagtaaagcatttaagtatttatttaataaacccttcagacctcatgctaaagaaaacacctaagtgaacattttaaattttaataggtgcttatctatagtatcctcatttctcttaaaaaaaaaaaaaaaaaaaaaaaaaaagaccatcctggctaacacggtgaaactccgtctctactaaaaatacaaaaaaaaaaaattagctgggcttggtagcgtgtgcctgtagtcccagctactcgggaggctgaggcaggagaatggcgtgaactcaggaggtggagcttgcagtgagccgagatcacgccactgcactccagcctgggtgacagagagagactccatctcaaaaaaaagaaaaga

SEQ ID NO: 459988 - DNA, 818 bp, Homo sapiens
gacgagtctttcttccagctctaccctgaaagtcctccaggcaccggtcttttttttctgccttttgtttccctcccggcgagtcggcgcgacagtgaatttccgtttcccgcggtgtccaagcggacctgaggagttgcagctgtgagcaggttagagttacttgttattggtaaatagccactatggagactaaggaccagaagaaacaaagaaagaaaaacagtggacccaaagatgaaaagaaaaagaagcggcatctgcaggatctccagctaggagacgaagaagatgcccagaagagaaatcccaaagcttttgcagttcagtctgctgtgtggatggctcgatcctttcacaggactcaggatttgaagacaaaaaagcatcgtattccagtggttgatcgaactccactagagcccccaccaatagtggtagtggtgacggggcctccaaagttggaaagagcactttgatataatgcctcattcagaacttcattggcagaagttgactgagatcagaggccctgtgatgatcgtgtcaggtcaagggctcagaggtttgcagggccctcctgggaagatggggcccccaggaaacacagggacttctggaattccaggacctaggggccaaaaaggagatcgtggggacaattcagttgctgaggctaagctggccaacttagagagaaagctatagagcctgagatcagaactggaccacacgaagaagcagacaggatctccgtatgttgtccaggctggtctttaactcctgacctcaagtgatcctccccaatcagcctccca

SEQ ID NO: 459989 - DNA, 3431 bp, Homo sapiens
tgtttttcaatcaagctgtcagattttatgcagcccgatattctaaaaaaaaaactcactaattcagtgattaccaatttattggccacagattcccaggaccagaagaaacaaagaaagaaaaacagtggacccaaagatgaaaagaaaaagaagcggcatctgcaggatctccagctaggagacgaagaagatgcccagaagagaaatcccaaagcttttgcagttcagtctgctgtgtggatggctcgatcctttcacaggacattttgtaagcacatgaaaccagggaattgcagaaaggaagaagaaggaaaccatggctcctttggcactttagaaagaaatccgagcaatccaggggccaaagctcacacaggcaatgagttctcttcacctttgtctggaccactgtacccagggctcatggataatcctcaagccctgtgggctgtcaagtaggacgtgcctaactgctaagacttgtgctaacaggagctctgggacctcagggagaatgggctcgcgttcatcttgcacctgcctttgttttagcactgatctaactctcacattttttacccaccagtctccctagtagcctgaaagtcattcagagccaggggttgtgatggtcccctctgtgtccactgtccccagcacagggtccagcacaccacagtgggtagcaaatgctatttaaatgagatgggatgaaattcccttccttcactttcttcacctcaaggtaaggaccatgttcctgtttccatcattccctgtccttctcctgtctgtggtgacagcttcctgctccaaaacaaaagcctgtgcagatacccagaagacctgctccatgattacctgtggcatccccgtcaccaatggcaccccaggcagagatgggcgagatagacccaagggggaaaagggagagccaggtctgggacaggtttctgtggcttcctaaatctccacctccggcaggtgttcaagcaaatctgtgcttgagcctgccacacgagggttaaagcacagacttggggaggctcccctttcatcaggacccatgctacactcagaacaacccctgtaaaatgccattgcctccaaaacaaagctgttcgtggactctctgggatcccatatttccacacaggaactgggggtgtgtggttgtcccttcagaggggtgtcctgcctggttggggagctggccttggtgcaggccctccactaggttgcaggagagtctttcttctttgggtcagatcactggctcattggctgtgccgggggtgaacaggaatggagcattgagcttttggggaaaaaaaaaagagtgacagccactgggtcatcttccctttgtcttgcaacaggtcaagggctcagaggtttgcagggccctcctgggaagatggggcccccaggaaacacagggacttctggaattccaggacctaggggccaaaaaggagatcgtggggacaattcagttgctgaggctaagctggccaacttagagagaaagctatagagcctgagatcagaactggaccacacgaagaagctgtaagccttctccttggggaaaatgtctgggaagaagcttttcgtgaccaatggtgagcggatgcctttctccaaagtgaaggctctgtgtgctgggctccaggccacagtggctgcccccaagaatgccgaggagaataaggccatccaggatgtggccaaagacactgccttcctgggcatcacagatgaggcaactgaaggccagttcatgtacttgacgggcgggaggctgacctacagcaactggaagaaggatgagccaaatgaccacggctcaggggaggactgcgttattctcctgaacaacgggctctggaatggcatctcctgcacctcctccttcattgccatctgtgagtttcctgcctgaagaggcacgttcctcagccccctccttgcctccctgctgaactctctgctgctttggaagagaattcaatgttggttttcttctgccctgtgttgagtccttccttcatgtggatgggaggaaaatgaaggggatatatttgattgtggggtgagaacagaagaagaggctggctgtcaggcacaagggttctggttcagcacatggcaaaggacaccaccatcccactaggagcacagcgctgggtcggagtctaccctggaaagggccacatctgaccctctcatttcatggtgaagacactgaagcccaccagaaggaaccagtggggccacacctgggtcagagtaggctgtagatcccagccactgagagatcttattccttttctccatgagttgccactactgaatgcctaaactccttccatggtgagcccagacctctctaggacacaggtattgtttctagttgttcatgagctgcgccagacaacctctcactacctgactgtaacacttggcaatatcctacgtgggcaacagttgttagtcctaggaatcctctcatcctgcccatgtagctgtggccaccctttagtcactagggtgaccttaaggccaaagaacagcttttcctcctgcatcattttaggatgctgactcgatattgaggtgtgtcagctgcgtgtgaggaggcaaattgtcatgcagagtgtacccttctccgcaggcctcgtgagtctcatgagtctcagccccaacccctactccagtcccccacctggccagcagcccctcctttccctgtaacaccctcttcccattatagttcagtgggcccattatcagtacagacaagcggaaaattaccccaaaggtgagcttcataccctacgggttaaattatgcgggcccagctggccaacaaatgccatccactttcggagcaggcttctgatgccattgggacccacagttctgctcatgaccatggctgtttttcagctatctcagggtgggtggctctgagatgacatagagcctgtgcagcaaactaagggaagggaatggattccagacctgccgtatgccattcacacaatgagatgggaaaatatttcataaaaaggctaagggccactttaactctgtgaaaagctttagttaatcttggttttctattttacttctctttgtatctgaactaccaggaaaatcaccacatggttggtgtcactgacatcttttgaacacaggtgtcatttaaatcattatgtgcaataatatgtcaaatcaactaaatatgcatgatctttggcctatatatttacagcctaaatgtatgggctttagggtcaaaatgaccttgctaatgacccagctgtaacactgacacccccttttgtccctgcacaggttcatccctctctgtgccttggttttcatatttggaaaatgacgaggaggatttaactagatta

SEQ ID NO: 459990 - DNA, 1424 bp, Homo sapiens
agtgggataaggatatgaatagacaattctcaaaagaagatataaaagtggccaacaaacataagaaaaaatgctcaacatcactaattatcagggaaatactccttaaagaactaaaagtagaactaccatttgatctggcaatcccactactgggtataccccagaggaaaaggagtcattatatgaaaaagacacttgcacatgcatgtttagagcaatactatttgcaatttccaaaatatggaaccagcctaaatgcctatcaatcatctttgagtttagcacagccttatccaaaacagggaagcaaacactgcccatcaaaaagacagcagagcaagtacctaaatctcttcaattctgtgaagagtgagagaagtaaagaagtttggaagaagttgattccaactcttatggatgactttgagggattcaagatctcagtggaggaggtaattgtagacatggcagaaatagcaaaggaaccagagtttgaattggagcctaaagatgtgactgaattgctctagtctcatgatcacacttgaaggaatgagaagttgcttcttatggatctgcaaagaaagtgtttcttgggatggaatctactcctgatgaagattctgtgagcattgttgaaatgacaacaaagaatttaggctattacacaagttagttaataaagcagcagcagcatttgagaggattgaccccaattttcaaagaagttctactgtggataaaatgctataaaacagcatcgcatgctacagagaaatctttcatgaaagaaagaatccattgatggcaacaagttcattgttgtctcattctaagaacttgccacaactaccccaaccttcagcaactaccaccctggtcactcagcagccctctatattgaggcgagaccctccaccagcaaaaagaatatgactcgttgaagacacagatgattgttagcaatatttagcagcaaagtattttttatttaagacaggaactagatctagtgaaacaaaaacacttgggggatctctgaataggctcctgaactgtttatacatgcatatcactaaatcccagtcgaagcttagatgtaagaagcagttcattgttgctccctaacctgttccagcactatggggaagtcagaagtccttgttggctaccataagtatcatcaaagaaattcttcaccactgatcacttattatacctgaatgcatgttaagaatagctgagaaacctgtgcttctcaaaaggaggtaggtggaccattttcatcagattcacctgaagggcttattaagaagtacagattcctgtatgccatactactcaatcaggatctctgacgggagccctggcgtctgcatttttaataggctttccaaggatatttatatcttctaatgctt

SEQ ID NO: 459991 - DNA, 1807 bp, Homo sapiens
gcctattcccgcggtttggtccggccattggcgggcggtttgaatgacggaagtgacggcggctcggcgatggctctcccgcaggcgcagaaacggctgctgggcagctgatgggcaggagcttaccaggctggcttgctctgagctgcggttactgtgtccaggccccgggttctcagaactgtcatacataaagtacacagaaatgaagagaaaagtcgtgaatactcacaagctgagattgagtcctaatgaggaagccttcattttgaaggaagattatgaaagaaggcgaaaactaagattgctacaggttcgagaacaagaaagagatatcgccttacagataagagaagacataaaacagaggagaaatcaacaatttacacgtttggcagaggagctaagggcagaatgggaagaatcacaaactcagaaaatacagaacttggaaaaactgtatttggcaagtttaagaagtatgggagagggacatcgacaggccaaagaaaatgaacctgatttggatgctttggcacagcgggcagcagaaaggaaaagaaaagcagatttgaggcataaagaagccttgaaagtacagaaaaatcaaaaagaaatattactgaaacaaaaaacctgcctgtggaatcagactagaggatttcttgagcctatgacttacatatttttaaccctgttgtactataatattatcactgagagattaattgatgacatctcttgtttcttaaggcatataaaagctcgaaaggaagcactgcttgtggaaaaagagagatcagccaaaattacaagtctgccacctcctcctccaactctttttgagaacatcgaagtaaaaagaatttctgcagtcaaaaccaatagttctacctaccatcatcttcacacttttgtgaatagagagacagacacaaaacgggtgattgacttattgtttcttcatgccctcgctttattatttctgtgtgcattgaattgaattatatcttagttatatgtatggtgttcccagatttcaaaatttggacaattgataataataatcaaaaccttttaaatgctttgaattttcatgtcaggcatatgatggtttaatatgaattaaagaaactagttggctatttaaatggttattttaaaatagcagattttaaagctttttttatcataaaatattacatgctatttgtggaaaatttggaactgtacatataagtgtaaactattgggaaaacaccaattctgtcaccaaagtggaatatagttaatgttttaataaattcattataacctttatttaaatataaacatatacacacacttttcaaaacatgatttttagtggccacttaatatttcatggtagcatttatttaaccattattttattttttgcttctttttatgaaagtattcccacaaactaaagctttgtgtactgaatgaagatatgatttctctgaatattttcagaaatgggtttattactgaacacatttttattcgaatattttcttttatttgctgctttactgtatcacttaggaaaagtctgtccttaaactttggatttaaaatgtgatgaccaatgtgcttggctttcaagataaaattacctctgaattttcatctgcactcaacttatatcacatgcacaataattttagcatcttccctggaggagtacgatatgatctttacagcagtagctctcaaactgctaaaattaaagtgtgatgagaatctaaacttattttatttggaggaggtgcttattgaaaat

SEQ ID NO: 459992 - DNA, 1512 bp, Homo sapiens
cggtgttctttctggagccgacagtcctccaggcccaggcccggcctctgcgggaggcgacggcagggtggggtcacccgggatggcgggcaggggtcgaggtgggcgcggcggcttgcgggtgtcggcgccgggcccggcctcagggagcgggaagcggtcgatggacaagtcggtgccgtcggcgaagaccctcggggccggagtctcgcggcgtgggatccggtgctcactgaggacctgcggggcgcgtcggtcacccccacaccccagccccggccgccccaccggggacccgcaccgacctcgcccttggggctcaggagcagcgtcgcgcagccgcggatggagaggaggggaacgggctcccggctcgaggacgcgcgcagcggcttcttggcgctgcgggtcgcctcgccccagacctggaggggcgtggagcggcgggtgaggggcggccgggccgggccgtcggggccgggctcccgggccggggcgcaccgtgacgtggtgccgcggggccagcagcgtgcccggcgggaagcggtacaggcgctccgggaagccgcgcaccagctgcttcagcaccatgccgctcaggtcggccgtgctctcctgcgacgggttgaagatgcggacgaacttctcccggcagctcacagccacgatcttcaggcctgtcgggctgggaagagaggagacgctgtgaggagatgcggccggtccacccgcacagctgcgcgccccgcccggaaaccagctccagtccggcgccggaggcttgggtcactcgccccttacctctgcaggagttccgggctccagtggtccgggtctgtgcagggctggggcgacaggaccggctcgccgtgcctggcatgcggcccacccacgaggagcgggccagctgcaggaggcaggacttctgcaagttctgcagctcggcctccatctcctggagcgtgcgggtggtctgcagcagccgctcctccaggtgctccttctcctgctccgagagggcctgtgggccctacccccagcactcacctgaggcccgacctccaagcaggcctgggagggaagggctgtataccgttgccatggataccagcacccagaaggggtggggctgtttgttaccaggagcctccagggagaccccagaccaggcccctagagacagggtcttgctccgctgtccaggctggaatgcttcggtgtgatgacagcgcacgttaacctcgaattcctgggctcaggtgatcctcccacttccgcctcctgacttgctgaaactacaggcacccgcctccaccgccaggcccagcccacagctcctttgacctcagtgacaggcactcacctacctgacccccaaactgaagcctcacttttcccagccgtgtccacaccctctgggctaccccattaccatgacaagtattccctctgctccaggagaaaagccaggtcccagacctgacccattaaaacccaatcattccagctttc

SEQ ID NO: 459993 - DNA, 1719 bp, Homo sapiens
cggtgttctttctggagccgacagtcctccaggcccaggcccggcctctgcgggaggcgacggcagggtggggtcacccgggatggcgggcaggggtcgaggtgggcgcggcggcttgcgggtgtcggcgccgggcccggcctcagggagcgggaagcggtcgatggacaagtcggtgccgtcggcgaagaccctcggggccggagtctcgcggcgtgggatccggtgctcactgaggacctgcggggcgcgtcggtcacccccacaccccagccccggccgccccaccggggacccgcaccgacctcgcccttggggctcaggagcagcgtcgcgcagccgcggatggagaggaggggaacgggctcccggctcgaggacgcgcgcagcggcttcttggcgctgcgggtcgcctcgccccagacctggaggggcgtggagcggcgggtgaggggcggccgggccgggccgtcggggccgggctcccgggccggggcgcaccgtgacgtggtgccgcggggccagcagcgtgcccggcgggaagcggtacaggcgctccgggaagccgcgcaccagctgcttcagcaccatgccgctcaggtcggccgtgctctcctgcgacgggttgaagatgcggacgaacttctcccggcagctcacagccacgatcttcaggcctgtcgggctgggaagagaggagacgctgtgaggagatgcggccggtccacccgcacagctgcgcgccccgcccggaaaccagctccagtccggcgccggaggcttgggtcactcgccccttacctctgcaggagttccgggctccagtggtccgggtctgtgcagggctggggcgacaggaccggctcgccgtgcctggcatgcggcccacccacgaggagcgggccagctgcaggaggcaggacttctgcaagttctgcagctcggcctccatctcctggagcgtgcgggtggtctgcagcagccgctcctccaggtgctccttctcctgctccgagagggcctgtgggccctacccccagcactcacctgaggcccgacctccaagcaggcctgggagggaagggctgtataccgttgccatggataccagcacccagaaggggtggggctgtttgttaccaggagcctccagggagaccccagaccaggcccctaggtgagttctgggccagcccagcctggaggaggtgtgagaggctgagccactgctcagcttagcggggggaccacttagtgaccaacaccctgagggaggccccagcatcccctacctagcctggcagcagcagcgggataaataggggggcactgctgcctgtgagccagcccagcatagccatgggtgtgtgggggaagcagacagagacagggtcttgctccgctgtccaggctggaatgcttcggtgtgatgacagcgcacgttaacctcgaattcctgggctcaggtgatcctcccacttccgcctcctgacttgctgaaactacaggcacccgcctccaccgccaggcccagcccacagctcctttgacctcagtgacaggcactcacctacctgacccccaaactgaagcctcacttttcccagccgtgtccacaccctctgggctaccccattaccatgacaagtattccctctgctccaggagaaaagccaggtcccagacctgacccattaaaacccaatcattccagctttc

SEQ ID NO: 459994 - DNA, 2941 bp, Homo sapiens
ggaagaactcacaccatggtggttgagggccagatgtcagaggccatggaccagccagctgggggtcctggaaacccaaggccaggagagggtgatgatggcagcatggagccaggcacctgccaggagcttctgcaccgactgcgggagctggaggcagagaactcggcacttgcccaggccaacgaaaaccagcgggagacttatgagcgctgtctggacgaggttgccaaccatgtggtacaggcgttgctgaaccagaaggacctgcgagaggagtgcatcaagctgaagaagagagtgtttgacctggaacggcagaaccagatgctgagtgccctgtttcagcagaaactccagctcacgacaggctcgctccctcagcgctggatgccctatccccgttcttcggaagaaggcccagattctggagagcccatcaacggcgagctgtgtggcccgcctcagcctgaaccctcaccctgggcgccctgcctgctgctaggccctggcaacctgggaggcctgctgcactgggagcgcctcttggggggtctgggaggggaagaggacactgggcggccctggggtcctagcaggggacctcctcaggcccagggcaccagctctggcccaaactgtgccccaggcagcagctcctcctcctcttctgatgaggcagaatcgtacccctatgggagcccccaagagaagagtttggacaaggcaggctcggagtctccccatcccggccgcaggaccccaggcaactcatccaagaagcccagccaggggtcaggacggcgacctggggatcctggcagcacacctctgcgggacagactggcggccctggggaagctgaagacacgcgagggggccctgggctcagagaagaatggggtgccagccaggcctggcaccgaaaagacccggggacctgggaagtcaggggagagtgctggagacatggtgccctccatccacaggccactggagcagctagaagccaagggggggatacggggggcagtggccttgggcacaaacagcctgaagcagcaggaacctggacttatgggggatcccggggcccgagtctactcctctcactccatgggggcccgggtggacctggagcctgtctcaccaaggagctgcctcaccaaagtggagctggccaagagccggctggcaggggccctgtgcccccaggtaccccgtacccctgccaaagtgccaacctcagccccaagcctgggcaagcccaataagagccctcacagcagccccaccaagctcccttccaagtcaccaaccaaggtggtgcctcgacctggggctccgctagtcaccaaggagtcccccaagcctgacaaagggaagggccctccctgggcagactgtggtagtaccacggcccagtccacacccctagtacctggccccactgacccaagtcagggccctgagggtggctcacactcagccatcgaggagaaggtgatgaagggcattgaggagaacgtgctgcggctccagggccaggagcgagcccctggcgccgaggtcaagcaccgcaacaccagcagcatcgccagctggttcggccttaagaagagcaagctgccagcgctgaaccgccgcacagaggccaccaagaacaaggagggggctggcgggggctccccgctccggagggaagtcaagatggaagcccggaagctggaggccgagagcctcaacatctccaagctgatggccaaggcggaagacctgcgtcgggcactggaagaggagaaggcctacctaagcagccgggcccgccaacgcctggtggcccagccccagggcccaacacggggctggggcagggtggatggcaaggagctgccatccaagagctggcgggagcccaagcctgagtacggggatttccagccggtgtcttctgaccccaagagcccctggccagcctgtggccccggaatggcctggtggccctcttcagggctgcggaaaacctcctggaaaggtgggcactggagctacacaggaacaaatccttccctgccctcagggtactcgccccacctacaccccttccccaagcccagggcagaccaagccaccgcggctggatcccccacctgggtacccccagctcggcccccaccccttaccaaagtcccccgccgcgcccacacactggagcgggaggtgccaggcatagaggagctgctggtgagtgggcggcaccccagcatgccagccttccctgcactgctacccgctgctccgggccaccggggccatgagacctgtcctgatgatccctgtgaagacccaggccccacccctcctgtccagctggccaagaactggaccttccccaatactagggcagccggcagctcctcggaccctctcatgtgcccaccccgacaactggaggggctgcccaggacccccatggtgagaattgcagcagaggaaagggaaaggactcgggagcaggagggagtgatgtggggagaccagtttctccagtaaggtacggcctgtgtgtcgcacagtctcagtgctgcaccctctgggaggaggacccctgggatgccctgtgagcggccctccccactgccctccttgcacttctctcgtggggaaaggtttctgtccctccccagaaccttgtaggactgttctcagttgtacctccagcctgtttcctctgaagtataccccaccttgggccccctctggagcagccccccatcaggtgcacagacgcccctcagagctcagtgcctctgaggctgggccgaaaggtggagaggagcttcctcccgagctgcccctcctttcccaggccctgcccgtggaccggaagcgaacgcaggagcccagccgcccgtcccctacgccccagggcccacctttc

SEQ ID NO: 459995 - DNA, 776 bp, Homo sapiens
cggagcagcctagagcagcatctttggcctctaagggggtgggtccttggtgaggccctaccttcaggccaggatgggtgtgaaggctggggtctgggctgccagtcccgtgaaccagagtgctcagccagaactgagcagacattgggacgaccagctgcagagaggagctaccaactccagggcctcatctcttctgagagatgcagatgttgggatgcccagctgcagaatggaggtgcccactccaggacatcctctgagttgttctgtcactcaatatagcttctctttgctcaccctcaacttgtctgtatacctcattattcctggagaagagagaagaaaaaaagagctgtggctctatgggaacccagacctgggagctcccgaggccagagctgtgactcccgctattggaccctatggttcctggagtctgcaagcttccaggcatgagccaccacacccggcgactcattcttatacaactacctttgtcagcattcttgccattggactgtctagcccttgatgctgttatatcatggcttgttgatacagaagatgctacatgaactcaagtggaactctgactgccttgagagcaacccaccatccattgctgctgcatcaaggtattaaaaagagagacagaaggaagaggtgagagaagcacaagtttaacagtgtgagggcattttgcttattaataagacatttcattaaaatattagctacttttgttagctagcaactcttaattttgcctaaag

SEQ ID NO: 459996 - DNA, 1075 bp, Homo sapiens
ctcctcaggtgcttctcatctgtagacctggttgaggaccctgctctgtgaatgcttctcggatgctcaccttcatccccatggtgacaacggctgaaataggcacaggcaaagattttatgatgaagatgccaaaatcaattgcaacaaaagcaaaaattgacaaatgggatctaattaaactaaagagcttctgcacagcaaaagaaactatcatcagagtaaacagacaacctatagaaagggagaaaatttttgcaatctatccttctgacaaagaatatgggcaaaagaaacagagattttaccaaagagatgtacaaaaggcaaataaaaacattaaaagacagtcaacattattacccatttgggaaatggaaattaaaactccaatgagatatcaatgcatatctatcagaataactaaaacggtaacaccaaatgttgggcaactgaagaaactacaggccttggcctcttggctggctctccaaagctgtatagctcagaatatgtttggtctagactgtggatttaaaaaaaatccacaacacattctaaagaagtactagaaatagcagtgcctcaaagtgagggcttctagaatttctgatatatattccttggaatagacttcttattttgagggtcataaagaattgagagactagccatggttgcacacactccacattaggtctgagctcatcagtcttgatggttctctctcctgaactctcgtgaaggcaatatctacttgtagttgatggagtatcaggcaaaacaaagtgctgtcttagatttatgaactcctttatcactcaagggaactggaaaaatagactttgatgcagtcctgcaccagaataaatggcaccacgaaagaatgagaagccaccttatgattggatatgaaattatctctaagatatatgattcaggaaaagcagaaggtacagaacgacagtatggaagatactatttgtgtaaataaagtgaacaaaatagaacaaacataaatattttgtaactgtgatggttaattttagatgtcaacttgtctgggttaaggggt

SEQ ID NO: 459997 - DNA, 1145 bp, Homo sapiens
ttgtgcttcaatagatgtacaactaataatggatggagaagtaaatgaagcacaggaaggacaggatgcaaaacctcaagctcgagcaaggaatattctggagctgagctccctgcataaggctaggacccctgaaagacagatgcacctattcatgaaaatgggaacaaaggccctcaacagattgaatgatgcccacctgccctggggagggccatctgctttacttggtccaccagttcaaatgctaatctcttctggaaacatcctcacagacacacccagaaataatgtttcctcagatatctgggcatcctgttgcctagtcaagttgatacataaaattaatcatcacagcaagattgtagacataagttcaaataccgtaagcccttggtttactcatctggaaaaggggaataataatacagggctgttagagtttatgtcatcccaggcaaaagcagttattaaaactactgatgattatttgcagtctcagtttggccccaacagactcgtgcattcagcagcagtatcagaagggtcaggacttcaagattgctccacacatcaaacagcatcagatcacagccatgatgaaatatcagacctagatagctacaaatcaaacagtaaaaacaattcttgttctatatcagcatccaagagaaacagacctgtcagtgctccagtgggtcaactgagggttgcagagttctcttctttaaaatttcagtcagcccggaattggcagaaattgtctcaaagacacaaacttcaaccaagagtgattaaagtaacagcttacaaaaatggatctagaacagtctttgccagagttactgtaccaaccatcaccttgctgctggaggagtgcacagaaaagctgaatctgaacatggccgcaagacgagtgttcttggcagacggcaaggaagccctcgaacctgaagatataccccatgaagccgatgtttatgtttcaacgggagagccctttttaaatccattcaaaaaaattaaaggtaaaaaagatctaaaaaataccctacccccacacatactgaattgcttaaggggtgcaattaaaaaatgattttcatcctgtcttttttgcatggtttaacaaaactaatgtttac

SEQ ID NO: 459998 - DNA, 1394 bp, Homo sapiens
gagtcacgagagaattttgaagatatgttattattagacttctgttttaacagcattttgaggcaggagtacacatttaggaaaggtctcagtggcagccccttgcctcacattcagagttttttatttaatctatgtacggtcagcactgctagtaaagcagccaccccagttgtgcctggcccacagttgccagaggatctgatgcttgtgtctggggccatgtgggtggatgttaaacagcccatatggtatgatgttcatttcctgtattccaagcaaacagcaggtggactgccttcctactgccttttaacaggcaaatcagctagaaaatctagaatgtggtgggcaatgcaagatcacaggaaaacagctgatgtcatagaagtagagaatagaacagtgattaccaaagactggggagaggaaggcagatgggagaatggagaaagattggtcaacagacgctgactgtgatttttctcactaatgacaaaaggaataacctctagtgagaatgaaatgatgaagggtctttgaaattctctactctctgaacacagtgaatgtgaatgaaagatctcaggaagagttttcaaaaagcttattgctcaatcaccagcctttgcgaggagttgtggattgactgctgtctgcaataaagtcaccagaaactgccatagctctcaaggcaagcacatgctgataatgacaagctgctgagactcaaagctatgttttagccccaaccccagcacagactcaccacgaagctctttgatttccagacggaactttcatgaggacacaccacacttaactaaacccttgacctaacagacctatagtgaagatgaaaccccaaaggtagccaagggatttggtattttagtcatgttctttcatgccttagtacctttaaggtaagctcacacagaggtggccatgaaatggttaaatagcaaaatccctgacttctgtagtcagtgagaaacatccgagagtgtgtcatatggtcaaaagcctctttgcgaaaaggaaaacatttcaagtcatagattcattcttttatttctactcattcattcattttcttcaataaacatttaggaagctcctactgtttgccaataactcaacagagctctggagaaacagatgaattcaatgtggccttttgactagggacgatcgcccaccacacttctgataacagacaagcccttcttcagcactacagggttagccaaccacagtattccatccccctggcctcagtcagaacctttgctccagaaattttcctctggaactatcaggaaggacttccagttacccctggggacgccattttggaaacctagtactgtcatggccaaattatctatctc

SEQ ID NO: 459999 - DNA, 2828 bp, Homo sapiens
tccgggcacctgggccgtcgagctgaggcgcgccttccgagcctgctttttagggcggatggcagccatgctgaagtgcgtgatgagcggcagtcagtatttgggaaagcagttcaagctctatcacgaattagtgacgagttctggctagacccatctaaaaaaggtcttgctctaagatgtgtgaattcttctcggtcagcatatggatgtgtcctgttctctcctgtgttttttcagcattatcaatggtcagctttagtgaaaatgagtgaaaatgaacttgacacaacactgcatttaaaatgcaaattgggaatgaagtcaattttgcccatctttagatgtctgaattcccttgaaagaaatatagagaagtgcagaatattcaccagatctgataaatgcaaagtagttattcaattcttctacagacatgcaacgtggatggaactagaggtcactatgttaagtgaaataagccaggcatggaaagtcaagtattgcatgttctcacaatgtggacgctaaaaagttgatctcatggaggtagagagtagaatggtagataccagaggctggtaatggtgtgtgggtattaaaagaactcataatatatgttttcaagaaagtcagcctttgcaagttatttttgacaagaatgtttgtactaatacgctaatgattcaaccaagattgcttgctgatgccattgttctttttacatcaagtcaagaggaagttactcttgctgttactccactgaatttttgcctcaagagttctaatgaggaatcaatggatttgagcaatgctgtacacagtgagatgtttgttggctcagatgagtttgacttctttcaaattggaatggacactgagataacattttgtttcaaagaattgaagggaatactgacattttcagaagctacacatgctcctatatccatttattttgatttccctgggaagtcagatctgattgaaaaaaaggctggcaaaaatgtaactggccaggccctggaatgtatttcaaaaaaagcagcaccaagaaggctttatcctaaggagactctcacaaacatatctgcattggaaaactgtggcagccctgcaatgaaaagagtggatggagatgtcagtgaagtatcagaaagcagtgtcagcaacacagaggaagtgccagggtctctgtgtctcagaaagttttcttgcatgttctttggagcagtttcttctgaccagcaagaacacttcaaccaccctttcgacagtctggcaagagcaagtgacagtgaagaggacatgaataatggcagtttctctatattctaatgcttaatgatggctgagctgggccccagcccagtgactggctcatttgcccctcaagcacgagtttgcatgtttagtgtctaaaagaggttgtccaggacttccttttaatggaggatgggcttttaaaccacatcatcttgtacaacaaccatatctagaaatagctgtttgtcaagtgtatgtaacttgctttaaatccattatgctacttgtgaggcagaagagttttctgtgaaggaaaaaagcccattagagttcttcaattcaatgcacgttcaccctagagcttttaacatctttgctagttttataaaggtatttaaactttattcaacagccatttagagtgccatcaagatggcttgaaatggaattttgtgatttgtagtcaggtatcttttgtatttgattgcaaacatttggattttagttttctcatgtaataccatggccttttttgtgcattgttttttatattttaagactttaagtagaataaaccctggaaaaaagatcaagagtaaaaatatatagtcactttcacttggcttttttagacggagtctcactttgtcactcaggctcaagtgcagtggtgcaatctctgctcactgcaacatctgcctcccaggtccaagcgattctcctgcctcagcctcccgtgcagctgggattgcaggtgcgtgccaccatgcctggctaatttctggtattttgtagagacagggtttcgccatgttggccagggtggtcttgaactcctggcctcaagtgatctgcccacctcggcctcccaaagtgctgggattacagacttgagccactgcgcccaacctggagtgtttttacatattgtaaaattttatttcctaacctcaaattgttctgattttcagatgtgattttttattttgcagtgtgctgcaggaaagaatttaatggaagtgatgccaaatatttctgtattatctgacatagaacagtatcctccactgccaagacagcctgagtttggagtggaataaggtggaagacaaatgtctctgttctttggccctttaagagttagctttttacctgcacaaatggactaaaaaatctggcacaaaacattgttatgtaatgtcttatgatgtgtgcctctccctcccccaaacctgtttacagtcaattataacctgacaaacgagacttttgtaacatattattgttacatctttctgaaaccttcaaaccgtaaggaagtgttaactggcaagcagttgtactttagactttgtgagaaattcataaaggtggctgagtggatttgcatgctttagaactgtgaatagagttctaactgaaaccagaattaatttggctcttgtagcttagtaatgagtcatagctacccacaataacctaataaaaactcaagttcatcccaagatgttccttagtgaatgaaaatgggccttaaccaagctttttgtggtaactggcaa

SEQ ID NO: 460000 - DNA, 2672 bp, Homo sapiens
tccgggcacctgggccgtcgagctgaggcgcgccttccgagcctgctttttagggcggatggcagccatgctgaagtgcgtgatgagcggcagtcagtatttgggaaagcagttcaagctctatcacgaattagtgacgagttctggctagacccatctaaaaaaggtcttgctctaagatgtgtgaattcttctcggtcagcatatggatgtgtcctgttctctcctgtgttttttcagcattatcaatggtcagctttagtgaaaatgagtgaaaatgaacttgacacaacactgcatttaaaatgcaaattgggaatgaagtcaattttgcccatctttagatgtctgaattcccttgaaagaaatatagagaagtgcagaatattcaccagatctgataaatgcaaagtagttattcaattcttctacagacatggtattaaaagaactcataatatatgttttcaagaaagtcagcctttgcaagttatttttgacaagaatgtttgtactaatacgctaatgattcaaccaagattgcttgctgatgccattgttctttttacatcaagtcaagaggaagttactcttgctgttactccactgaatttttgcctcaagagttctaatgaggaatcaatggatttgagcaatgctgtacacagtgagatgtttgttggctcagatgagtttgacttctttcaaattggaatggacactgagataacattttgtttcaaagaattgaagggaatactgacattttcagaagctacacatgctcctatatccatttattttgatttccctgggaagtcagatctgattgaaaaaaaggctggcaaaaatgtaactggccaggccctggaatgtatttcaaaaaaagcagcaccaagaaggctttatcctaaggagactctcacaaacatatctgcattggaaaactgtggcagccctgcaatgaaaagagtggatggagatgtcagtgaagtatcagaaagcagtgtcagcaacacagaggaagtgccagggtctctgtgtctcagaaagttttcttgcatgttctttggagcagtttcttctgaccagcaagaacacttcaaccaccctttcgacagtctggcaagagcaagtgacagtgaagaggacatgaataatggcagtttctctatattctaatgcttaatgatggctgagctgggccccagcccagtgactggctcatttgcccctcaagcacgagtttgcatgtttagtgtctaaaagaggttgtccaggacttccttttaatggaggatgggcttttaaaccacatcatcttgtacaacaaccatatctagaaatagctgtttgtcaagtgtatgtaacttgctttaaatccattatgctacttgtgaggcagaagagttttctgtgaaggaaaaaagcccattagagttcttcaattcaatgcacgttcaccctagagcttttaacatctttgctagttttataaaggtatttaaactttattcaacagccatttagagtgccatcaagatggcttgaaatggaattttgtgatttgtagtcaggtatcttttgtatttgattgcaaacatttggattttagttttctcatgtaataccatggccttttttgtgcattgttttttatattttaagactttaagtagaataaaccctggaaaaaagatcaagagtaaaaatatatagtcactttcacttggcttttttagacggagtctcactttgtcactcaggctcaagtgcagtggtgcaatctctgctcactgcaacatctgcctcccaggtccaagcgattctcctgcctcagcctcccgtgcagctgggattgcaggtgcgtgccaccatgcctggctaatttctggtattttgtagagacagggtttcgccatgttggccagggtggtcttgaactcctggcctcaagtgatctgcccacctcggcctcccaaagtgctgggattacagacttgagccactgcgcccaacctggagtgtttttacatattgtaaaattttatttcctaacctcaaattgttctgattttcagatgtgattttttattttgcagtgtgctgcaggaaagaatttaatggaagtgatgccaaatatttctgtattatctgacatagaacagtatcctccactgccaagacagcctgagtttggagtggaataaggtggaagacaaatgtctctgttctttggccctttaagagttagctttttacctgcacaaatggactaaaaaatctggcacaaaacattgttatgtaatgtcttatgatgtgtgcctctccctcccccaaacctgtttacagtcaattataacctgacaaacgagacttttgtaacatattattgttacatctttctgaaaccttcaaaccgtaaggaagtgttaactggcaagcagttgtactttagactttgtgagaaattcataaaggtggctgagtggatttgcatgctttagaactgtgaatagagttctaactgaaaccagaattaatttggctcttgtagcttagtaatgagtcatagctacccacaataacctaataaaaactcaagttcatcccaagatgttccttagtgaatgaaaatgggccttaaccaagctttttgtggtaactggcaa

SEQ ID NO: 460001 - DNA, 771 bp, Homo sapiens
ttccccagctttacaatgggattcggaacctcccaaagtcagtccgatgccccctcccgcaacccggtgtgtttgtgtatccccgcggtgcaggccgactgcgcggtgctcttcgtggcaggcggctgggcggaggccggcatcttcaagaacccgcagacccacgagctcgcgctgctggccaactggcgggacgtcacgcagctcatcgtgatcttcaacgaaattgactccaccgagcccgcctacagcggctcgcgcctccaggtgatcaccaaggaagtaagcgcctgcatcaagaagatcggctacaactggctgcctggccttcagtccatctcgagctggcacggcgacagcatgctggagcccagcactgacgcgagtgtggcgcgggtcggcagggacagccggggtggaggcgagcggaccacaccccggactcacctcccctcgacatcccgaagatgccctggttcaagtgctggaaggagaactgatgccaaagcctgcattttgttaccttctttggaatcattgggaatatcccaagtttgaagtctgatttgtttctattgctctggtttgggacacatccatggaagcctagaagaggagaggattatccttttaaatttagccattttccaaccttttttttaaatttgctttgttttgttttctttcagcaaatgtgttaaatgcctaccatgtgttaggaatttttacattatgtcatttcaataaattatggttactagtaaatggcaa

SEQ ID NO: 460002 - DNA, 1802 bp, Homo sapiens
gctagagcatggatcctactgtttgaaccaatgaggataagatgagaaaatccttcaatcagcagttagctgatgccatagctgttatcaaaggaatgtaccaggcccacctatggctgcccattgaccaatcagcatgagcttcctcccctctgaagcccataaaaaccctagactcagccagactctggcagaagtggggatgacctgcctgcagagaggagttattcgctgtggggtcttctctcagctaagagctgaacagatatcaggatgacctgcctgcagaaaggagctacccactgtgggtcttctcttagctgggagctgagcagatgctgggatgacctgcttgcagaaaggagctacccacttcagatctcctgcaagctgtactgttgctcaataaagcacctctttgccttactcaccctccagttgtctgcatatctcattcttcctgcgtgtgggacgagaacttgggacccaccaaatggtgggactaaaaaagctgacttggtggagcagcttaattggccagtactagcccatcatccatctccaggaaatataagagagatcttgaatttggaaatggacaaagctggtcaagaggaccattttggggaaagcaggcaacatggagtgctgacctgtaaatgggagagagaaagagagtatttctcctttgagccaagcaagagtggagttttagacctcttggagagcttgacaagcattcctgggtctgaggaatgtgaggactggtatgggacttgccagaaaaatttcacagaagagcaggaggggtgatggggcagaagcctgctgacaaggaccatctggagaggtgacaggatgccagcagaagggcaggtcctaggacagaagccagttaaagttgttactaagttaaaaaaataaagccatggtgtcttcctgaaagtcctaaaaggtgagaactatgagactagaaactagatttgcaggggcagtgtgggaaaatcacactgctttctgctatctcccacagagtccagctcattccataaacactagtgaaacatcagaaacattccaggagatgaagaaaaatgaattcattgtatttggaccttacaaccattttttgaaaagccaaaggttcatccatcttgtcccaaatagcaagatatccttctttttatggctgaaaaatattctattgtattaatatatacattgtacatactaccattgtaaatattccattgtgtgtgtgtgtatgtgagagagagagtgtgtgtgtgtgtgtgtgcgcgtatgtaacgttttcttcattcatctgttgatggatatttaggttgtttctatatcttggctattgtgaataatgctgtaatgaacataggaatgcaaatatctttaagatcatgattttatttcctttgaatatatacccagaagtaggatagctggatcatatggcagttctagttttaattttctgaagaacctccatactattttccataatggctgtaccactttacattcccatcaacagtgcacaagggttgccttttctccataccgttgccaatacttgttatctcttatctttttgaaaatactcattctaatagctcattcttatcataatgaggtaatatctcattgtagttttgatttgcatcttcctgatgattggcgatgtttcatgtaactgttggccatttgtatatcatctttggaaaaatgtttatttaggccttggcccattttttaatcttttctttttaaaaaaattttacagaaggatg

SEQ ID NO: 460003 - DNA, 1813 bp, Homo sapiens
gcatgacaggatcctagaaattgaaaagcattatcaacagaatgaggataagatgagaaaatccttcaatcagcagttagctgatgccatagctgttatcaaaggaatgtaccaggcccacctatggctgcccattgaccaatcagcatgagcttcctcccctctgaagcccataaaaaccctagactcagccagactctggcagaagtggggatgacctgcctgcagagaggagttattcgctgtggggtcttctctcagctaagagctgaacagatatcaggatgacctgcctgcagaaaggagctacccactgtgggtcttctcttagctgggagctgagcagatgctgggatgacctgcttgcagaaaggagctacccacttcagatctcctgcaagctgtactgttgctcaataaagcacctctttgccttactcaccctccagttgtctgcatatctcattcttcctgcgtgtgggacgagaacttgggacccaccaaatggtgggactaaaaaagctgacttggtggagcagcttaattggccagtactagcccatcatccatctccaggaaatataagagagatcttgaatttggaaatggacaaagctggtcaagaggaccattttggggaaagcaggcaacatggagtgctgacctgtaaatgggagagagaaagagagtatttctcctttgagccaagcaagagtggagttttagacctcttggagagcttgacaagcattcctgggtctgaggaatgtgaggactggtatgggacttgccagaaaaatttcacagaagagcaggaggggtgatggggcagaagcctgctgacaaggaccatctggagaggtgacaggatgccagcagaagggcaggtcctaggacagaagccagttaaagttgttactaagttaaaaaaataaagccatggtgtcttcctgaaagtcctaaaaggtgagaactatgagactagaaactagatttgcaggggcagtgtgggaaaatcacactgctttctgctatctcccacagagtccagctcattccataaacactagtgaaacatcagaaacattccaggagatgaagaaaaatgaattcattgtatttggaccttacaaccattttttgaaaagccaaaggttcatccatcttgtcccaaatagcaagatatccttctttttatggctgaaaaatattctattgtattaatatatacattgtacatactaccattgtaaatattccattgtgtgtgtgtgtatgtgagagagagagtgtgtgtgtgtgtgtgtgcgcgtatgtaacgttttcttcattcatctgttgatggatatttaggttgtttctatatcttggctattgtgaataatgctgtaatgaacataggaatgcaaatatctttaagatcatgattttatttcctttgaatatatacccagaagtaggatagctggatcatatggcagttctagttttaattttctgaagaacctccatactattttccataatggctgtaccactttacattcccatcaacagtgcacaagggttgccttttctccataccgttgccaatacttgttatctcttatctttttgaaaatactcattctaatagctcattcttatcataatgaggtaatatctcattgtagttttgatttgcatcttcctgatgattggcgatgtttcatgtaactgttggccatttgtatatcatctttggaaaaatgtttatttaggccttggcccattttttaatcttttctttttaaaaaaattttacagaaggatg

SEQ ID NO: 460004 - DNA, 5684 bp, Homo sapiens
cttcttcttaaacaattattttttaaactttaattttgaaataattatagattcacaggatgttgcaaaaataatatggtgtatgtttcatgtggagaactctggatcaatcctgacctgtccattgctcagcaaaagaaacaaatattcctgaggaacctagaatcagacattgccaaaattcaaatcttctgcagcacacataaaatagaagaagtccaaagtgacattgtatctggaagcaagcttgctgtgcataaacctgtagcaatttttggagaagagaagcaagttacagaaccggaagaaaagcaaatgcaagaagatcctctaacaacggaaaatgcttccagtgaaattcttacggtcagctctgctagcacaggaattgtccctgaagattttggtaatttaataatgcttgtagttacatcaaattatgacaagcaccttggtgatcagtctgtcccagagaactttatttacagctgttcaccaaagcatagtaaattgcacaagcattgtcatcagcagttcgaatacagagatgggcagattataagccatgctgctcctcagctagtcttgggggttcaaggtcccaatctccgatcaggcatggaggtggttttggtggagaagaaatctgatggtagtcatcagcgctggatacaccaggaagacagcaggacctttcaccttgtgagtaaccctgaccttgtgctggcagtgtctatgaccaagactagaaatgaagtttgtggctatccagttattgttcagaaatataagccgtacaacaatggagctgccaatcaaaagtggcattacatgaaaaatataaaagcacttgtggcctttcatagcactgccttggataaggaaattacatcagcaaattatgctggtgtctgtacatcatctgtgattaaagaagaaaacattgatcaaccaggatactgttatctctcacctgatggaaagagaaaaactatgctctgcttggcttgtggacaatccatgagaacagagaaaggactgaaacaattgcttccaggggttccattcctctgtatttcaggcaccaagactcagaagcccttcttacaagggcccttcaaggtcatcagtgtggctgaggttgatttgtcgtgtgacaaggctgaaaaaactctaagttactaccaagcacgtctattgtctttacggatgaagacctgcacgcaagctgcatctcacagtggcatggcagccacacaccagaaggcagtgaaaataattgcatacaaaaatggggatgggtatcgtaatgggaagttaattgtggctggaacattccccatgcttcttacagaatgcacggaacaacttgggcttgccagagcagcctccaaagtatataccaaagatggaaccccaatctttaccttgcgtgatttggttttatgggctctagatgaatcctttctccagagagactctgagaaacaaaagcaagatgcagctcctgttggaaaagaacagataattgttgaaagtatggaagaaaatccaagaatgaaagtgaaaaacagattatttgcaaaatctgtgacatccgatagtttggatggtatagacaagtctttgcttaccctcatcctcagaaatcctattgccatctgggtgtcttgtggtgaaccatttctacctccaaatgctttgcagaaagcagaaaaattagagaaacagaactggctaaaaaaggacagaattttggctgatctagataccatgagacacaaaatgagacagttaaaagggcggcgagtagcggcatgtcagccagccaccatggttcctaccaagagccctgtgcagcccgtggtggttgaaggaggctggaccgaacagactcaacaggaaattaaactcatggaacttataagacatacagaggcacacctttctgaaatccaagaaatggaatccaaaataaattttccaattgcaaccaaacgtatagcagtcaagccgagcaacctgtataagcagcccaacacaaaacgagtgtggatttatctaaatggaggcagacctgaagatggcacttatgcctggggcaaaactatttcagaggtcagcttactttatctgaagacatggatctttatttggagcaggaaagttttcttctattttttgataactgcttaaggttaatgtattctagattcctctccagtaacaccaataatgtataggtttaatatctgatgtcttgacattataaatgtttgacttttctctctcatacactttgtctcttttcctttttctgtatcctgtgagatcttctccacctagtctgccctaataatgatttgaatttctgtaatattgagtcttttttctttcttaccttctctcctcttgtcattcagctctctcttcatcctcacttgaaaccctatttcttctctcactagcagctatacaactttggttattatatttaacctctttgttctccatttttctcatcaacaaaaggtggatactaattatttccacagaacaaaattagattgttcttgagaacttttagaaaaatacccagtccctagaaatgtgtcaatatgttttaatcagtattactgttatcagcagcctcagcatctctcctgtatctgagcaatactcctttcctttaagctgtggttgtctcgtttctgtgtgtatctgtgagtatatttacacacagaagtcatattttttgaatttaggggtaacacaacacagatacttttgaaaatgtactcctgctgtaaatctttttcaaaatcttcaccttgagtacaatgtaccctttttttatgttgtagaatattttcattagctttacattgttgctattgttgatttttctatttatatttccttgtacaaggagagatcttttgataacagacagaataggttagttctctttggtgaccctagacatctacttgggagctgtcagaatcctccctcaatggtaggttgaaggattggtttgtatgcagagtatttaatcaaattgcttctgactggatggtatttggcaggagtagggctgcatttaaccaacatggcacatgtatacatatgtaacaaacctgcacattgtgcacatgtaccctagaacttaaagtatgataaaaaaatatataaaaatagataacattaaaaaaagactactctcctgttggtcctctctgactatcctattctatagaggggaatatatttttggataatttgaattattattaaattcaatccactcatcccttactcaaaatactgggtgaaaagctgcgctttttgaactgcatcgccccatcactcttcttgtcttggctcatattcctgatgcatttgccagatgcaaggtgtcatcacatgcccagccctgacccctgccattctgccttgttgtgagttgtagcatctaaacagatctataaacagaagtattgatggtgatttggagggctgatgtggacttggcacctgcattttgggggaacaggcttttggccctctaataggtgaaagccatacaggcagctgctgcaagactgctcctctcgtctcaaaatgacccacccagctagagcactgtacacccccagtggagagccaattcagtcctgggacgacatagagcgagatatggtcatctgtgtgtctatgggacatggtttcaaaaccccaaaagagttaaaacaactgatggagatcagagcaaattatgccagaatccgaaggcagcagggccctcaagccacagacattgtggtgtcaccatccacgaagctgctgtctctggcacatctccacaattaactcctatcagaaccatcggattttctgctgtatttttctggaaagaaaactttctttacccacttataaacagaagactgtgacaagaaggccaattatttccatcgctgaagactctaaatttggcaaatcttctaaataacaatcctgcatagtttattaaaaaaaattagtcgtaaaatttatccttcaaaaatctgcattttaaataaaccctgacagtgatttctcaagactgtaaagatattagtctgagaatgcaactctaacagactgctctgggcatcttttctctttgccttggccaggcctctcagaattgagtgagcgtgtgactccatttgcacagtgggacagatgagtacaactgaaataaaaagtggaggcctctgcaaaaaataaaaaataaaaaataaatttatccttcaaaataactcagttttttcaatgggcctattttgaagaatgaacattgaaaaatgagacaatatatccataaattcatagtatgacataccataatcgagagcattgttagccatagacattttgtatgccagtgaaatctgtatacattctctaaatttttccagtttatcgtgtggcttattggaaaaaaaaaaagcatatacactgactgcatgttttgtctccccaactaaatgataagtgcctagagggcaggaacacccttggttttatttacttgggacagagctctacccacaagggctcactgataaaactcatcagtcccaccccacagcaacatgatggggacatgaggttcagttcttctactcttggcctgagccgcaaaccaaaattacaacagtacaatgggaatagaggatctgctttatagaatttcctttcagtcagctgctcagaaactacaatcctcagagtgaaattaaatggagttatactgggatagtcctctctgcttttcagaggaaagaaacacttctcgaaattgtgcaaatgaaagaaatgtcatggtataaactagacatcttatatccttaaaatatatctttgatgattatacatattggtttcaaatcccaagtttgaagaaacatccaaaagttatgtgaaattacttatagatgaattgacaacatttgagacttcgacaggcaatcatgaagcagttctcaagttgatttggtttatatagctctttaagaatcttttggaaagccataatctcacaaaatacagatatgcaattttttttttttgagatggagtctcactctgttgcccagtctggagttcagtggcgcgatctcagctcactacaagctccccttcccaggttcaagcaattctcctgtctcagcctcctgagtagctgggactacaggcgcctgccaccacacccagctaacttttgtatttttagtagagatggggtttcaccttgttggtcaagctggtctcaaactcctgacctcaggtgatccactcgcctctgcctcccaaagtgctgggattacaggcgtaagccaccacacccagcccaaaaaatgtttgtgcacagaactgtggatgtttgtcacagaactttccaaataaagaagttctgataaaagagaagatatttctcatttccataatctttaaggtgtgggggatacgtaatctggacttctcaaatggatgatttctaaatacgcgtcagatgaagtgattctaactttctctgtagtaatatcttattttgttttattcaaaaacaataaaccatgtagatttattagcatgtgtgggtgtgatttttgcatctaggaatcttaagtggg

SEQ ID NO: 460005 - DNA, 4811 bp, Homo sapiens
tctgcttggcttgtggacaatcagagcatagtttttctctttccatcaggtgagagataacagtatcctggttgatcaatgttttcttctttaatcacagctgatggaaagagaaaaactatgctctgcttggcttgtggacaatccatgagaacagagaaaggactgaaacaattgcttccaggggttccattcctctgtatttcaggcaccaagactcagaagcccttcttacaagggcccttcaaggtcatcagtgtggctgaggttgatttgtcgtgtgacaaggctgaaaaaactctaagttactaccaagcacgtctattgtctttacggatgaagacctgcacgcaagctgcatctcacagtggcatggcagccacacaccagaaggcagtgaaaataattgcatacaaaaatggggatgggtatcgtaatgggaagttaattgtggctggaacattccccatgcttcttacagaatgcacggaacaacttgggcttgccagagcagcctccaaagtatataccaaagatggaaccccaatctttaccttgcgtgatttggttttatgggctctagatgaatcctttctccagagagactctgagaaacaaaagcaagatgcagctcctgttggaaaagaacagataattgttgaaagtatggaagaaaatccaagaatgaaagtgaaaaacagattatttgcaaaatctgtgacatccgatagtttggatggtatagacaagtctttgcttaccctcatcctcagaaatcctattgccatctgggtgtcttgtggtgaaccatttctacctccaaatgctttgcagaaagcagaaaaattagagaaacagaactggctaaaaaaggacagaattttggctgatctagataccatgagacacaaaatgagacagttaaaagggcggcgagtagcggcatgtcagccagccaccatggttcctaccaagagccctgtgcagcccgtggtggttgaaggaggctggaccgaacagactcaacaggaaattaaactcatggaacttataagacatacagaggcacacctttctgaaatccaagaaatggaatccaaaataaattttccaattgcaaccaaacgtatagcagtcaagccgagcaacctgtataagcagcccaacacaaaacgagtgtggatttatctaaatggaggcagacctgaagatggcacttatgcctggggcaaaactatttcagaggtcagcttactttatctgaagacatggatctttatttggagcaggaaagttttcttctattttttgataactgcttaaggttaatgtattctagattcctctccagtaacaccaataatgtataggtttaatatctgatgtcttgacattataaatgtttgacttttctctctcatacactttgtctcttttcctttttctgtatcctgtgagatcttctccacctagtctgccctaataatgatttgaatttctgtaatattgagtcttttttctttcttaccttctctcctcttgtcattcagctctctcttcatcctcacttgaaaccctatttcttctctcactagcagctatacaactttggttattatatttaacctctttgttctccatttttctcatcaacaaaaggtggatactaattatttccacagaacaaaattagattgttcttgagaacttttagaaaaatacccagtccctagaaatgtgtcaatatgttttaatcagtattactgttatcagcagcctcagcatctctcctgtatctgagcaatactcctttcctttaagctgtggttgtctcgtttctgtgtgtatctgtgagtatatttacacacagaagtcatattttttgaatttaggggtaacacaacacagatacttttgaaaatgtactcctgctgtaaatctttttcaaaatcttcaccttgagtacaatgtaccctttttttatgttgtagaatattttcattagctttacattgttgctattgttgatttttctatttatatttccttgtacaaggagagatcttttgataacagacagaataggttagttctctttggtgaccctagacatctacttgggagctgtcagaatcctccctcaatggtaggttgaaggattggtttgtatgcagagtatttaatcaaattgcttctgactggatggtatttggcaggagtagggctgcatttaaccaacatggcacatgtatacatatgtaacaaacctgcacattgtgcacatgtaccctagaacttaaagtatgataaaaaaatatataaaaatagataacattaaaaaaagactactctcctgttggtcctctctgactatcctattctatagaggggaatatatttttggataatttgaattattattaaattcaatccactcatcccttactcaaaatactgggtgaaaagctgcgctttttgaactgcatcgccccatcactcttcttgtcttggctcatattcctgatgcatttgccagatgcaaggtgtcatcacatgcccagccctgacccctgccattctgccttgttgtgagttgtagcatctaaacagatctataaacagaagtattgatggtgatttggagggctgatgtggacttggcacctgcattttgggggaacaggcttttggccctctaataggtgaaagccatacaggcagctgctgcaagactgctcctctcgtctcaaaatgacccacccagctagagcactgtacacccccagtggagagccaattcagtcctgggacgacatagagcgagatatggtcatctgtgtgtctatgggacatggtttcaaaaccccaaaagagttaaaacaactgatggagatcagagcaaattatgccagaatccgaaggcagcagggccctcaagccacagacattgtggtgtcaccatccacgaagctgctgtctctggcacatctccacaattaactcctatcagaaccatcggattttctgctgtatttttctggaaagaaaactttctttacccacttataaacagaagactgtgacaagaaggccaattatttccatcgctgaagactctaaatttggcaaatcttctaaataacaatcctgcatagtttattaaaaaaaattagtcgtaaaatttatccttcaaaaatctgcattttaaataaaccctgacagtgatttctcaagactgtaaagatattagtctgagaatgcaactctaacagactgctctgggcatcttttctctttgccttggccaggcctctcagaattgagtgagcgtgtgactccatttgcacagtgggacagatgagtacaactgaaataaaaagtggaggcctctgcaaaaaataaaaaataaaaaataaatttatccttcaaaataactcagttttttcaatgggcctattttgaagaatgaacattgaaaaatgagacaatatatccataaattcatagtatgacataccataatcgagagcattgttagccatagacattttgtatgccagtgaaatctgtatacattctctaaatttttccagtttatcgtgtggcttattggaaaaaaaaaaagcatatacactgactgcatgttttgtctccccaactaaatgataagtgcctagagggcaggaacacccttggttttatttacttgggacagagctctacccacaagggctcactgataaaactcatcagtcccaccccacagcaacatgatggggacatgaggttcagttcttctactcttggcctgagccgcaaaccaaaattacaacagtacaatgggaatagaggatctgctttatagaatttcctttcagtcagctgctcagaaactacaatcctcagagtgaaattaaatggagttatactgggatagtcctctctgcttttcagaggaaagaaacacttctcgaaattgtgcaaatgaaagaaatgtcatggtataaactagacatcttatatccttaaaatatatctttgatgattatacatattggtttcaaatcccaagtttgaagaaacatccaaaagttatgtgaaattacttatagatgaattgacaacatttgagacttcgacaggcaatcatgaagcagttctcaagttgatttggtttatatagctctttaagaatcttttggaaagccataatctcacaaaatacagatatgcaattttttttttttgagatggagtctcactctgttgcccagtctggagttcagtggcgcgatctcagctcactacaagctccccttcccaggttcaagcaattctcctgtctcagcctcctgagtagctgggactacaggcgcctgccaccacacccagctaacttttgtatttttagtagagatggggtttcaccttgttggtcaagctggtctcaaactcctgacctcaggtgatccactcgcctctgcctcccaaagtgctgggattacaggcgtaagccaccacacccagcccaaaaaatgtttgtgcacagaactgtggatgtttgtcacagaactttccaaataaagaagttctgataaaagagaagatatttctcatttccataatctttaaggtgtgggggatacgtaatctggacttctcaaatggatgatttctaaatacgcgtcagatgaagtgattctaactttctctgtagtaatatcttattttgttttattcaaaaacaataaaccatgtagatttattagcatgtgtgggtgtgatttttgcatctaggaatcttaagtggg

SEQ ID NO: 460006 - DNA, 4069 bp, Homo sapiens
tcagatgcagatgaaggaaacacaacctaaagagctagaaaaaatggtcatccaaactccaatgacattatctcccaggtggaagagtgtattgaaagatgtacagcggtcatatgaaggaaaagagtttcagaggaatctgaagacattagagaaccttcctgatgaaaaggagcccatatcaatcacacctcccccctccctacaatactccctgcctggagctcttcctatttctggccagcctctcactaaatgcattcatctcacacctcagcaggcccaggaagtggggatcacactcactcctcagcaggcccaggctcaggggatcacgctcacccttcagcaggcccaggaactagggatccctctcacccctcagcaggcccaggccctggagatccttttcacccctcagcaggcgcaggccctggggatccctctcacccctcagcagacccaggttcaagggatcactctcacccctcagcaggaccaggccccggggatctctctcaccactcagcaggctcataaactagggatccctcttacccctcagcaggcccaggccctggggatccctctcacccctcagcaggctcaggaattggggatccctctcacccctcagcaggcccaggccctgagggtctctctcacccctcagcaggctcaggaattggggatccctctcacccctcagcaggcccaggccctggggatcactctaacccttcagcaggcccagcaattggggatccctctcacccctcagcaggcgcaggctctcggaatcactctcacccctaagcaggttcaggaactggggatccctcttactcctcagcaggcccaggccctggggatcactctcacccctaagcaggctcaggaattggggatccctctcaaccctcagcaggcccagaccctggggatccctctcacccctaagcaggcacaggctctggggatccctttcacccctcagcaggcgcaggccctggggatccctctcacccctcagcaggcgcagactcaggagatcactctcacccctcagcaggcccaggccttggggatgcctctcaccactcagcaggctcaggaactggggatccctctcacccctcagcacgctcaggccttggggatgcctctcaccactcagcaggctcaggaactggggatccctctcacccctcagcaggctcaggccttggggatgcctctcaccactcagcaggctcaggaactggggatccctctcacccctcagcaggctcaggaattggggatccctttcacccctcagcaggcacaggctcaggagatcactctcacccctcagcaggcccaggccctggggatgcctctcaccgctcagcaggctcaggagctggggatcactctcacccctcagcaggctcaggaattggggatccctctcacccctcagcaggcccaggccctggggatccctctcatccctccgcaggctcaggaattggggatccctctcacccctcagcaggcccaggccctggggatccttctcatccctccgcaggctcaggaattggggatccctctcacccctcagcaggcccaggccctggggatccctctgatccctccgcaggctcaggaattggggatccctctcacccctcagcaggtccaggccctggggatccctctcatccctccgcaggctcaggaattggagatccctctcacccctcagcaggcccaggccctggggatccctctcacccctcagcaggcgcaggaactggggatccctctcacccctcagcaggcgcaggaactggggatccctctcacccctcagcaggcgcaggctcaggggatccctctcacccctcagcaggcccaggctctggggatctctctcacccctcagcaggcgcaggctcaggggatcactctcacccctcagcaggcccaggcactgggagtccccatcaccccagtaaatgcctgggtgtcagctgtcactcttacctctgagcaaacccacgctttggagtcccctatgaacttagaacaggctcaagaacagttattgaagttaggggttcctctcaccttagataaagcccataccttgggatcgcccctcacccttaagcaagtccagtggtcccatagaccatttcagaaatcgaaggcttctctccccactgggcaatccatcatatcaagattgtctccaagtcttaggctgtccctggcatcatcagctcctactgctgagaagtcctctatattcggggtctcttctactcctttgcagatatcaagggttcccctcaaccaaggcccctttgcccctgggaagcccctagaaatggggattctttctgagcctgggaagcttggggcaccacagactcttcgttcctctggacagaccctggtatacggaggtcaatccacttctgcgcagttcccggcaccacaggcccctccctcccctgggcagctcccaatatctcgggcccctcccactccagggcagccctttatagctggagttccacccacttctggacagattccaagtctctgggctcctctttctcctgggcagcccttagttcctgaagcctcttccatccctggggacctcctggaatctggacccttaaccttctctgagcagctccaggaattccagcctcctgccactgctgagcaatctccctatctgcaggctccttctacccctgggcagcatctggcaacatggacccttcctgggcgagcttcttcattatggatccctcccacctctagacatcctcccacactatggccgtccccagcccctggaaagccccagaaaagttggtccccttctgttgctaagaaaagattggcaattatttcttctctgaaatctaaatcagtattgatccatcctagtgctccagatttcaaggtagctcaagttcctttcaccactaagaagttccaaatgtcggaggtctctgacacttccgaagaaacccagatacttcgagacacttttgctatagaatcatttagaacatttcagtcccatttcaccaaatataggacaccagtataccaaaccccttacactgatgaaagggcccttctcactctcatgaagccaacaacatcaccatcttctctcactactctactcagaacatcacagatttcacctttggaatggtaccagaaatcccgattccctcctatagacaagccctggatactgagttcagtttcagataccaagaaacccaaagtaatggtgcccccttcctctcctcaagaacttgaagaaaagaggtattttgttgatgtggaggctcagaagaagaacctgatactattaaatcaggctataaaaacttgtggactcccttcacagctacacacaatggctaggactctcataattgagatacttcatatggacacagttcagttgggatacttattccgcaagtacattgcctataggctgatccagcatgccaggtagatataattatttacgtctagttttctggtttagttctgattgcaaatattttctgtcattgtcccagaagtatattcatatttgtcaggccatatgttctaaaggactgccttatataaggtctatgggaaggaagcttgtttaagatagcaaaaggagatatattttttggaaaataagaaatgacatataacgtgatccatttcatccatatatatctccagcggagatgccaagtatattttgtggatcatggttggtctccaaaacatcaatttcaaaagtttccagttattctgaatttctttcatcatttttggttcaccagaaatgtatgatttttaaaatgggagatggcataaaaaaagaatgagaccaggcatagtgtctcatgcctgtaatcccagcactttgggaggctgaggcaggtggataacttgaggccaggagttcaagaccagcctggccaacatggcgaaatcccatctctgcaaaaaattcaaaaattagacaggcatg

SEQ ID NO: 460007 - DNA, 994 bp, Homo sapiens
  misc_feature (1)..(1): n is a, c, g, or t
  misc_feature (7)..(8): n is a, c, g, or t
  misc_feature (12)..(13): n is a, c, g, or t
ncccagnncttnnagtgcccactctagggctccctccacagccatcatcacccctccgggccctccaggccagcgtgtctctgtcatcaccaaccatctgttgatttggaggtgaagttcatcttaacaatatatttcatttaaccaaatatgcccaaaatattatcatttcaacatgttacccatataaaaattattggagagatgcattcctatttttctcatactaagttttcaaaagctgggaaactgagacacagaggagtggatgacccgagatacacactcaggactgtggctcctacaacagtgcccctcgccctgttagagctggtgaaacgttcactagcaagagtggtacctgccctgcactcagaaccttgctccagggagaggccccagtgctcaaaagtcttggcaaagaatgtgcactcagcttcagcagaacttgaagctcaccatttttggatgacattctgtgaacgaagtgttctctatgagatactaagagcaatatagggtaatcactggtgacagaaacatctgctcatgcaggttcatgtcaaagtccagggttgaaggagaacccctcatcccaggtgtggcagaattgatgccctataacttctgagtgtaggtcataaaaggcaatgtggctcccccagctctctccctctgtcaagatgcttttccttggaatccagctgccatgttgtgagaaagcccagggcaccgcagagaccacatgtgggtgttccagccaacagccccagctaggtccccatggagagcccacaccaaccaccagatatgagggttcagactccagcccacagtcttcaagtcttccagctgcagtcccagacatcatgaaaccattctgctgtgacctgtcagaatttctgaccccagaaactgttggagataataaataattactgttgttttaatcctctaaattttggggtgatttgttatgcagcaatcgataact

SEQ ID NO: 460008 - DNA, 567 bp, Homo sapiens
aggtgaccctggaaaccgcatgttgatggtagcttagcagccatcagcctgggcccctgaatgaccgcatggagcagagtctttctgccgactggaattaccactccacattcctgtgagagagaaacaagtgttttcctcatgagattcttgagttttggatgtttctgtgccaacacagctaaccctggcccaacatacaaggttatgtgtttcagctgcgagtttttcaaattgttgcaaatcttcaaacatttttccaacaaatttactgaaaaaaatccacatataagtggcacccccaccagtttaaacctgtgttgttcaagagtcagctatttttatgaggtgttttcaaaagtttatggaaaatgaatcttatgaataaaactatgcatggatttcaaatcttttgcaccaaaataaactcatactaacttgttataaaatgtctgagttttatacagtttagtttgagacactaagaaagataagacatcagtttggaaagggtcatcagagcaacgtgaattatgcaaaactgaagcaaaaacaaacaccaaattt

SEQ ID NO: 460009 - DNA, 2671 bp, Homo sapiens
ctccagggtcagatggactcgggctgactcgggctccaccaattctgagtgtgggaatcggggacccttctaccctcgctgagcctcagtctcctcatctgtaaaatggggataagggcgcctgcctcctgggacatgctggggagtcagcttagccccgggacccatgggcactcactcagctcgctgccccttggggtcttcagtgggaagcccagacctgctgtcctgaggctatatctgggtgaggagcccgggagcggccgtgcatgcctgagctcccattggcgtaaatggggacacagacaggcgccccgtccacctgtcctgtccctgctaagtgtcggcctcctcgctgagtggggccccatcagtggcttttcagatgagtcagggatgctccaggcagagctgctgtcactccaggtggagcccttgtctgcggggagctgcccctcctcgggtgcctggagagggcacgtatgtgcggggtggtcagtgtggctcaggcctccacactacctgcccctgcttccctcctgctgaggccgggtggactctgggggaagggacccgtgctcatgggttcacggacacagagcaggatgtggggccagaacatgaaatccctgcacagacccctcggttcttcccacagatcctgtttttcatgcccaaatcacctggacacacttctgttgccccggctggttcccaaagtggccctgatccccccatccagggcactatccttaccacgtgcctcttccccctggccagcccccatccctgccccagcccacagctgccctgcccaggggacttcagtcccagatccacagcggctcttgggagtctcgctgggaaggcatgggtgggtcactcccatttcccaccattccactggagccttcctggttgattctgaggtccagacccctgtctcctcatctagatggggacaccgaggcttctgggaggtagacagtgctgggggaaccatcaggagatcagcagccaggcctggactcatgtgttctgggacagactggggccctcctgcctggcctctggggcctctcagtccaagtctgcagccacctgtggtctggagggccacaaagctcatggtttgcaatcccagccatttcttttctaaatcagtaaatcctgacctctgtggacaccgccatcactgccaaaatcaggtcaaaggcagctcccttgtgcacagagcaggtccacttctgctgctgacaggtgggagtcccgatgccctggggtcctatcagccacacccctgtcttcaccgcagggctgtgtgtgcacccctcactttgctgatgaccagaggctccccggacacggaagccagatatcaccatgctcatccctagagcagccgtgcggggcatggagcagcagagctcagagcttatgcagggctgatgcggggaagctggtctccccatgctgcagtccccatgggggaaggagctcacctgaagggggtgctctcattggctgggagcctccactgactccacagcactctcctgacttgtgccagatgcctttgaaacagtcactgggctgaaaagtgaccagagcatggggtcgagctgtgaagatgagttggccctggttgtggacggtgagggagggagcagcgctggcctgggctctggcagccctgctgagtccatctccctgaggatgagccgggctgggccggggctggcactccgtgatgtggaacggggtgtgttgggggagcctttgctgggaaggactcctgctgagaggagccgtgtgtcgtggaggctgtggttccgaatctctcagtgggtgtgattctctgcttattcgaattaactaaactgtaaatcatgcctgccacatcccattcccattggtttccgtggattcgctgctcatttcttgttagaaagtgctgtgggcatcaggagtagctcaataagcaaaatgaagcaggcccacaccctactgtgttctgggggagatgagatgattttcctgaaatattctttctcttcctggccccgttctccaggtgtggaatatcctgctccaatcaaagccatgtcacctgcgttgtccagtgaaacatcagtggacaggcgctgcccgggctccagggagctcctcactgaggctcactccctgtgcctctgccatcagcacagggggacatgcctggctgcctgtgggaccagggaggacgcgcggtgcgggagcagagccagccacactgccgctgctgcactgttcatctgagtggcgcaaggttatgtgtttcagctgcgagtttttcaaattgttgcaaatcttcaaacatttttccaacaaatttactgaaaaaaatccacatataagtggcacccccaccagtttaaacctgtgttgttcaagagtcagctatttttatgaggtgttttcaaaagtttatggaaaatgaatcttatgaataaaactatgcatggatttcaaatcttttgcaccaaaataaactcatactaacttgttataaaatgtctgagttttatacagtttagtttgagacactaagaaagataagacatcagtttggaaagggtcatcagagcaacgtgaattatgcaaaactgaagcaaaaacaaacaccaaattt

SEQ ID NO: 460010 - DNA, 877 bp, Homo sapiens
tgcaaacaacccaaagccccaacaatggaagcacagctaaggagtctttgcctggaaaacacaactgaaagaaaacacagcagaaatgtcatctgtgaatgggctgatctgagtgggaaggctataggcgctgacccacgaatgcaactctcagccgagctgtccctgccggatttcaaacagctgaagaagggctgggagaacatcaaggcttggactaaaacaattatggcccatgaaaggagagagaaggtgaaagggagcgtcagccccctcctgagtaaccaagtcctagggaaggagatcaccagcatgctgctggagcagctctacttcctgcagagcactccttccacccctccccccggaggaggagcccaaataccacgccacggcccaagaatcatttgctgtttcaaatagagaactgtgcgatgatgagaaagagttcatacgttttccaacacgtgagaggacctctcaacctgaaccctcgtgttcagctgtcagaataacagccaataaaaactacatgagcaaaatctctcaggaaggtgctttaaaaaagatgcatgaggactgaacatgatcaacaaatgtccatcttacaattgcaactgatacaaatgaatgaggtgcattgtggccaaaatccagcagacagagcgagagtgtgagatggcagaggaggaacacaggataaaaatgaagttctcaataaagagaagatgtattgggaaaaaaaactacaaacttttaccaaggaatggcctgcttcctcatttaaccggccctttcccaattcaccctaagactttgggggtggctctcttgtaattaattgtgttggcaaagaatgtctggaacatggacttgc

SEQ ID NO: 460011 - DNA, 3686 bp, Homo sapiens
ctgttactaggttagaaatttgggtgacctgcagagaaacgcctcctgattttgtcttacaatggaacttaaaaagtcgcctgacggtggatggggctgggtgattgtgtttgtctccttccttactcagtttttgtgttacggatccccactagctgttggagtcctgtacatagaatggctggatgcctttggtgaaggaaaaggaaaaacagcctgggttggatccctggcaagtggagttggcttgcttgcaagttcaaaggtgtggaatcactggttcatgtcacaggccgtgggtgtgataaagagcttgatgtctggtttgatgagaggaggtgaggggaaagaggcctctgaagttgtgtctccagtgtgtgaaatggaaggttcaagcgttggccttttcatatatgctgctctgcagaggatgctggttgagttctatggactggatggatgcttgctgattgtgggtgctttagctttaaatatattagcctgtggcagtctgatgagacccctccaatcttctgattgtcctttgcctaaaaaaatagctccagaagatctaccagataaatactccatttacaatgaaaaaggaaagaatctggaagaaaacataaacattcttgacaagagctacagtagtgaggaaaaatgcaggatcacgttagccaatggtgactggaaacaagacagcctacttcataaaaaccccacagtgacacacacaaaagagcctgaaacgtacaaaaagaaagttgcagaacagacatatttttgcaaacagcttgccaagaggaagtggcagttatataaaaactactgtggtgaaactgtggctctttttaaaaacaaagtattttcagcccttttcattgctatcttactctttgacatcggagggtttccaccttcattacttatggaagatgtagcaagaagttcaaacgtgaaagaagaagagtttattatgccacttatttccattataggcattatgacagcagttggtaaactgcttttagggatactggctgacttcaagtggattaataccttgtatctttatgttgctaccttaatcatcatgggcctagccttgtgtgcaattccatttgccaaaagctatgtcacattggcgttgctttctgggatcctagggtttcttactggtaattggtccatctttccatatgtgaccacgaagactgtgggaattgaaaaattagcccatgcctatgggatattaatgttctttgctggacttggaaatagcctaggaccacccatcgttggttggttttatgactggacccagacctatgatattgcattttattttagtggcttctgcgtcctgctgggaggttttattctgctgctggcagccttgccctcttgggatacatgcaacaagcaactccccaagccagctccaacaactttcttgtacaaagttgcctctaatgtttagaagaatattggaagacactatttttgctattttataccatatagcaacgatattttaacagattctcaagcaaattttctagagtcaagactattttctcatagcaaaatttcacaatgactgactctgaatgaattatttttttttatatatcctattttttatgtagtgtatgcgtagcctctatctcgtatttttttctatttctcctccccacaccatcaatgggactattctgttttgctgttattcactagttcttaacattgtaaaaagtttgaccagcctcagaaggctttctctgtgtaaagaagtataatttctctgccgactccatttaatccactgcaaggcacctagagagactgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaaacgtgagtgtgtgtgtgtgtgtgtgtgtgtgctatgcatgctctaagtctgcatgggatatgggaatggaaaagggcaataagaaattaatacccttatgcagttgcatttaaccttaagaaaaatgtccttgggataaactccaatgtttaatacattgattttttttctaaagaaatgggttttaaactttggtatgcatcagaattccctatagatctttttgaaaatataggtacctgggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgcatcagtttggttgctttttctcctcttagttctccacccaattatagtgacatgtcacttgaatgtaaaactataaattacctggcataattcagactctggaacatggttattggacaaaagcatattcaaaatgcttagctacttttaccattgccttccaaaaagctagtttatcagctttacctcttgtggt

SEQ ID NO: 460012 - DNA, 1011 bp, Homo sapiens
tgaatatggtggagaatgtattataactctctgaagatatgcgtggaacaccagtgccagccctgcctccatgaaccagcccccagagtcccaggctccagtcctagcccaatcacaggctggcccctgcaaactcaggctcgaggcccatccccagtgccagggaagcctctgtggattcaggctcctcccaatgaacccaggctccaagcccacccacccactgacctaggcaccaggccagcccatcaacaactctgccagtcagttcacacagaatctatagaccgactgagtggtgaagggctttccctgccaaagttaatcagtaaagtttggagaaggtgcctatgtcttccaatgtgtagataccaacacaaggccacaaggatcaagaataatcgggttggtaatgattttcagcggggctgtataaatgtaagtcacaacttcggtagtagagagggtgtatcagttctaaggaaggagaaagcaatgggattggaggacggtgagaataccaacagagacattcctcgctcagtgagcctcgaagggatattgctgccatcacatggatatgatctcactgagaatgaaactaacgtagaagaaagcaaagataagagaggggagagcaagcgcacaagagtttgaactaggtttcctgatgcttgtctgcaaaagattattcactgatatcgagagagatgttacttgttgaagtaaagagtgaagatttgttctacatcctattctcttacctcctgtgctgcactgaaggaaggagcagagctgaaaatgaacttgataaaatacacaagattaaaattattatacaaaaataaaatagatttgagaaccagagcaatgtccaatgcttgtgatgaatcttagataaataatggctgctagacaaataaaaaggacaatattctgaaagaaaaatgtcattttattccttctatgtgtacaccgacatcgctttgcatcacagcctttttcatctaa

SEQ ID NO: 460013 - DNA, 1789 bp, Homo sapiens
tgatacatttcataagattattttatggctttaagaggagttggaaatgggaatgcaggagtggggaatgggaatgcagcagagggagatggaatgcagcagagaaaaatgggtttgcagcagagagagatggaatgcaggaatgggaaatgggaatacagcagagagagggaatgcaggagtggaaaatgggattgcagcaaagggagatggaattcagcagtgggaaatgggaatgctggaatggtaaatgggattgcagcagagggaaatgggaatgcagcagagggagatggaatgcaggcatgggaaatggaaatgcaggaaaatgggaagatgaagcagagggagatggaatgcagcagtgggaaatgggaatgctggaatggtaaatgggattgcagcagagggaaatgggaatgcagcagagggagatggaatgcaggagtgggagatgggaatgcagcagagggagatggaatgcaagagtgggaaatgggaatgcagcagagggagatggaatgcagcagagggagatggaatgcaggagtgggagatgggaatgcagcagagggaaatggaatgcagcagagggagatggaatgcagcagagggagatggaatgcagcagagggagatggaatgcagcagagggagatggaatgcaggagtgggagatgggaatgcagcagagggagatggaatgcagcagagggagatggaatgcagcagagggagatggaatgcagcagagggagatggaatgcagcagagggaaatggaatgcagcagagggagatggaatgcaggagtgggagatgggaatgcaggagtgggaaatggaatgcagcaaaggggaaggagaatgcattagagagacatgggaatcccacaggggaaaatgggactgcagaagaggaaaacagtcatgcagctgtagaaaatgcagcagaggggaaggccacaggatcagtgggcagcctggcatcatgattaagtggagataccatcacagaacacctgagacttagagctacacacaacaggctgtgcggtgatgtgctgggcaacagaacatcgatttcgacgtcaaaagaccttcatagtgcttccgaattctgacttaccttagctgtctttccttttgtgaagcaccaaccactgaagttcattttggaatcatggccacccagaagaggaaaggggtgatcatgtgtctcaaagaagagataactttgagggagaggatgaaaactgcaaagacccttgggattaaatgaaatctgctgattctactcttttttcatgaatttctgtatgatatttagcaattagaatgtttgactggcaatggccaggtagatttcaccattatgtaacaaagagaataaaaaagaaaggaaaggagaaaacaataattggcctaggagatgggagttttgttcttggtcttagttgtctccctaggagaagcagctcttttccatccaaaggtgaacagaagactctgcagagcataatgttgctatggcttgttttactgaagtaaagacactgtaaatctcaaaaatactccaacttccctgattcttttggaagttattgggcatctgcattttcccaggagacttctctccacattgtcgcagtgttgaaactctgagataagaattccttgcccatcttctaacttccacccagatatctggcttctgtcaataggccttacccaaacagggttatgtatatgtatgtatgtatgtatgtgtgtgtatatatatatatatat

SEQ ID NO: 460014 - DNA, 1303 bp, Homo sapiens
tgatacatttcataagattattttatggctttaagaggagttggaaatgggaatgcaggagtggggaatgggaatgcagcagagggagatggaatgcagcagagaaaaatgggtttgcagcagagagagatggaatgcaggaatgggaaatgggaatacagcagagagagggaatgcaggagtggaaaatgggattgcagcaaagggagatggaattcagcagtgggaaatgggaatgctggaatggtaaatgggattgcagcagagggaaatgggaatgcagcagagggagatggaatgcaggcatgggaaatggaaatgcaggaaaatgggaagatgaagcagagggagatggaatgcagcagtgggaaatgggaatgctggaatggtaaatgggattgcagcagagggaaatgggaatgcagcagagggagatggaatgcaggagtgggagatgggaatgcagcagagggagatggaatgcaagagtgggaaatgggaatgcagcagagggagatggaatgcagcagagggagatggaatgcaggagtgggagatgggaatgcagcagagggaaatggaatgcagcagagggagatggaatgcagcagagggagatggaatgcagcagagggagatggaatgcagcagagggagatggaatgcaggagtgggagatgggaatgcagcagagggagatggaatgcagcagagggagatggaatgcagcagagggagatggaatgcagcagagggagatggaatgcagcagagggaaatggaatgcagcagagggagatggaatgcaggagtgggagatgggaatgcaggagtgggaaatggaatgcagcaaaggggaaggagaatgcattagagagacatgggaatcccacaggggaaaatgggactgcagaagaggaaaacagtcatgcagctgtagaaaatgcagcagaggggaaggccacaggatcagtgggcagcctggcatcatgattaagtggagataccatcacagaacacctgagacttagagctacacacaacaggctgtgcggtgatgtgctgggcaacagaacatcgatttcgacgtcaaaagaccttcatagtgcttccgaattctgacttaccttaggcaagtgcctgaaccaatgggttcctcagtttctcctttctgttggaattgggtaatgttgatattcaccaacctgctctgcagcataaaagtctaatggcaaacaaagtttgttatgtacattgaactcctggcctaaaagggactgtgatggaaacacagttggtccat

SEQ ID NO: 460015 - DNA, 499 bp, Homo sapiens
ctctgtgaggagggtgtgaagtcctccatgggaggaagagatgccagcaaaggagtaactccagttagcctccattgtctccaagccggcttttgtcctcatccacaacgcctccacacaagctctgaacacctgtccatgtaaaaatatcaagaaatgctgaggcccatgtcccagaacaacagtcctttaggtggatcacacattctccactacaccaagctctactcacaggttggagacacgctttttgcagaatatgtgaaggaacattttggaacccattgaggactatgtggaaaaaccaaatatccctagaaaaaaacaagttggaaagactcgttttgtagaatctgtgaagggaaaatcaaacccctttgaggcctatggggaaaaaccaaatatctccagataaaaactagaaagaagctatctgtgaaactgctttgtgatgtgtggattcatctcacagaattaaacctttcttttgattcaacag

SEQ ID NO: 460016 - DNA, 881 bp, Homo sapiens
ttctgagaggagaaaaaccaccctgtgttgggaggtatgaggaatttcaggttgactactgatcctagttcccatctcccctcatttcctaactccatttttgccatccccagcaacgctgaagtagagttaagggagagtgtagaagaaaagaaaagagaggaaacaggagggcagagcaaggacacaggccctggagcagtcaccgttcttctcccttcttttcaccctcatgttaacaatagcaaacaggatgacagtgtaaaacctgcctcagctctcccttttaagaagactcagccagctttccttctccttgtttccctctcttgctttttctttgaacactctctcatccctgtggctggtgtagtttccaaactccagacagatactaatattagggatttggaaataagatcaaaattctccagaataccctaaatcataaattgtgattaaaatacttcccatattcctcatgtactagttcattaggaagatcaaaaaattgttcaataggtaaaaatatcaagaaatgctgaggcccatgtcccagaacaacagtcctttaggtggatcacacattctccactacaccaagctctactcacaggttggagacacgctttttgcagaatatgtgaaggaacattttggaacccattgaggactatgtggaaaaaccaaatatccctagaaaaaaacaagttggaaagactcgttttgtagaatctgtgaagggaaaatcaaacccctttgaggcctatggggaaaaaccaaatatctccagataaaaactagaaagaagctatctgtgaaactgctttgtgatgtgtggattcatctcacagaattaaacctttcttttgattcaacag

SEQ ID NO: 460017 - DNA, 648 bp, Homo sapiens
gcagtgcctcttttaattaccccccgccccaggaatttattttgagccacgctgtgaccccgaaggtctggatcatgctatgctgctggttggctacagctatgaaggagcagactcagataacaataaatattggctggtgaagaacagctagggtaaaaactggggcatggatggctacataaagatggccaaagaccggaggaacaactgtggaattgccacagcagccagctaccccactgtgtgagctgatggatggtgatgaggaagaacttgactgaggatggcacatccaaaggaggaatttatcttcaatctaccagcccctgctgtgtggaatgcgcacttcaatcattgaagatccaagtgtgattggaattctgatattttcacactggtaaatgttacctgtattttaattactgctataaacatgtttgtattattgattcacttactttgtattttcattttaaaaggatatatacaattttacctgtttaaataaactgtaatttcaaatatactggtggggcttctttctgttttgatgcactgacttttttgtgtagttgtattagtctgttttcacactgctgataaagacatacccaagactgggcaatttataaaagagatttaatc

SEQ ID NO: 460018 - DNA, 654 bp, Homo sapiens
catagcgtgactgactctcttaatctccaccgctacaggaatttattttgagccacgctgtgaccccgaaggtctggatcatgctatgctgctggttggctacagctatgaaggagcagactcagataacaataaatattggctggtgaagaacagctagggtaaaaactggggcatggatggctacataaagatggccaaagaccggaggaacaactgtggaattgccacagcagccagctaccccactgtgtgagctgatggatggtgatgaggaagaacttgactgaggatggcacatccaaaggaggaatttatcttcaatctaccagcccctgctgtgtggaatgcgcacttcaatcattgaagatccaagtgtgattggaattctgatattttcacactggtaaatgttacctgtattttaattactgctataaacatgtttgtattattgattcacttactttgtattttcattttaaaaggatatatacaattttacctgtttaaataaactgtaatttcaaatatactggtggggcttctttctgttttgatgcactgacttttttgtgtagttgtattagtctgttttcacactgctgataaagacatacccaagactgggcaatttataaaagagatttaatc

SEQ ID NO: 460019 - DNA, 1168 bp, Homo sapiens
catagcgtgactgactctcttaatctccaccgctacaggaatttattttgagccacgctgtgaccccgaaggtctggatcatgctatgctgctggttggctacagctatgaaggagcagactcagataacaataaatattggctggtgaagaacaggtataaattgccagaaagacttatagttgaaactcaaaagggaatccttttttgcaatcagtatttacataccacaagcccttaatcacatttctgaaatcccagaagtctttttcccccttaggcagaacacagaatattaatgattgattgtaacgtcaagatactgtcacaagcatgctggggatattaatatggtatttgtcccattgcatgtctaaattctgaacattttcttaattctgaagtatatcggctggaaagacatcctatcctttttctgtttctgattttgcagttctgtgaaaggtcacagttttgggtctgggattgaagggatatgcaggttttgactcaagaatttacaagggatgaacaggaacatcagcatctcctgattctttatgttaagcctgtggcttctggcacactgtggcttctggcacactgtttaagttaataacccaatgtgctttatccttcctctgaaatggaaaacctgctctcctttcagctagggtaaaaactggggcatggatggctacataaagatggccaaagaccggaggaacaactgtggaattgccacagcagccagctaccccactgtgtgagctgatggatggtgatgaggaagaacttgactgaggatggcacatccaaaggaggaatttatcttcaatctaccagcccctgctgtgtggaatgcgcacttcaatcattgaagatccaagtgtgattggaattctgatattttcacactggtaaatgttacctgtattttaattactgctataaacatgtttgtattattgattcacttactttgtattttcattttaaaaggatatatacaattttacctgtttaaataaactgtaatttcaaatatactggtggggcttctttctgttttgatgcactgacttttttgtgtagttgtattagtctgttttcacactgctgataaagacatacccaagactgggcaatttataaaagagatttaatc

SEQ ID NO: 460020 - DNA, 998 bp, Homo sapiens
acatgactcctgtgaaggatcagtgcaactggtgctctggaagggcagatgttctggaaaacaggcaaacttatctcactgaatgagcagaatctggtagactgctctgggcctcaaggcaatgagggctgcaatggtggcttcatggataatcccttccggtatgttcaggagaacggaggcctggactctgaggcatcctatccatatgaaggaaaggttaaaacctgtaggtacaatcccaagtattctgctgctaatgacactggctttgtggacatcccttcacaggagaaggacctggcgaaggcagtggcaactgtggggcccatctctgttgctgctggtgcaagccatgtctccttccagttctataaaaaaggaatttattttgagccacgctgtgaccccgaaggtctggatcatgctatgctgctggttggctacagctatgaaggagcagactcagataacaataaatattggctggtgaagaacagctagggtaaaaactggggcatggatggctacataaagatggccaaagaccggaggaacaactgtggaattgccacagcagccagctaccccactgtgtgagctgatggatggtgatgaggaagaacttgactgaggatggcacatccaaaggaggaatttatcttcaatctaccagcccctgctgtgtggaatgcgcacttcaatcattgaagatccaagtgtgattggaattctgatattttcacactggtaaatgttacctgtattttaattactgctataaacatgtttgtattattgattcacttactttgtattttcattttaaaaggatatatacaattttacctgtttaaataaactgtaatttcaaatatactggtggggcttctttctgttttgatgcactgacttttttgtgtagttgtattagtctgttttcacactgctgataaagacatacccaagactgggcaatttataaaagagatttaatc

SEQ ID NO: 460021 - DNA, 1351 bp, Homo sapiens
agctgcccacatgcttctctacctacatccacaggaagaccagacacatcaccctgtgggccctagttcatggatgcttcccatacttccctgacaaactcaagaggcctatcaggtctcttgcagcagccaaacataggcaccttagactccagcctgccgaaggcccaggcccctgtgaccttgcacccggcccactccctgacctgcctccttaatgcgttatcttgtctgttgaagctgctgtttctcctcagtggtcccatttacaattccagactggaagatttcttcttctattgttcctcaatgaagcagtctttttcctcactgccttcccttgctggtcaattaacctcatctaacccaatatcagagaggagccagctggtggggggaagagcttggccccctggagaactagagaaagtaagaggatgtggtgcaaaagtgccctttcctccagcaccccacgggatcagacacagacacgagtcctcttcctcgctcgtcctccctaaaagtggaaatagaaatagaaaagactttgaagatttggcagacattatagaagagagttccttagccaatggagaagttcctgatgcccacacctgctggtctcaccgctagggcctgggcatcacaggcagggggaatggggaggggacggtagcgtcagcctacacccacacgcagtttcctgataaaaggtcctttggaaactttgattctcttctcaccaagttgaacggagatgtgttcccatagtaagagtgaggcccctgcatttgctgccctcggttttcccaactaacaccagggcctcccccctgtaccccattcatatgcctcagaagctgacaatgactgttgggcttttccaatgaataccagaacaccatttcctgcagcctgaaaagaagacagtataattgtttggcagcaagaggccaagcaggaaactagagatatggtgacggtagtggtcccagggaggagctttaacctgagcaccacccacagaaggcagaccaccctcccagccgcagtgcaaatgaatgttggcccccacccaggtccccaagtgctttcccagtcacgccccagctgccaggtttttttctccaggcctactacagatgggttaccctgactccacccccaacaccctccaatgattagaaccactgactcctccctcccatgcctgcctccatggcaggcccctgcagaaaccaaacatagtcaccttagactctggcatactgagaccagggcttgatcctggcccccttgcctccctggcaatttatcatttaataaaaatattgttaaaaaatattcatgc

SEQ ID NO: 460022 - DNA, 3205 bp, Homo sapiens
cccgcagccccggggccgcgccgcagagtcgggcttcctggatacatagaggcttgtgccaggcggggtgggaagactggattttgcagtggaagcagcatctcttccgtctgggacctggctgagggcgtccccaccctggggggagcagaggaccagccctgacctagccgggcccagcctcgtcctgcccggcctgagcgccccgcccagcagccggctctggcccaccggggtccgggagcgcgggcgccatggacaagatcttggaggcggtggtgacgtcgtcatacccggtcagcgtgaagcaggggctggttcggcgcgtgctggaggcggcgcggcagccgctggagcgtgagcagtgcctggcgctgctggcgctgggcgcgcgcctctacgtgggcggcgcggaggagctgccgcgccgcgtgggctgccagctgctgcacgtggccggccgccaccaccccgacgtcttcgccgagttcttcagcgcgcgtcgcgtgctgcgcctgctgcagggtggcgccggccccccgggcccccgcgcgctcgcctgcgtgcagctgggtctgcagctgctgcccgaggggcctgcggccgacgaggtgttcgcgctgctgcggcgcgaggtgctgcgcaccgtgtgcgagcgcccgggccccgcggcctgcgcgcaggtggcacggctgctggctcgccacccgcgctgtgtgcccgacggaccccaccgcctgctcttctgccagcagctggtgcgttgcctcggccgcttccgctgcccagccgaaggcgaggagggcgccgtggagttcctagagcaggcccagcagctgtggcgcgcacagcccgccgccatcctgccctgcctcaaagagctgttcgcagtcatctcctgcgcagaggaggagccaccatctagcgccctggccagcatggtccagcacctcccattggagctcatggatggtgttgtccggaacctcagcaatgatgacagtgtgacagactcgcagatgctgactgccattagcagggccttcctggattccttgcctttagtgggtaagagtgtgggctctcgagggttgttgtgaggattaaattgggtaaaacaagataatacacgaaacatgtctagaactgtgctgtgggagacgccgttatcattgttatgactttgctgtcatggttttgtctttttctagcacagtctgctgagtctaggctgttttcctcagcactgactgcatggcagctgtgtgctcagcccgcacaggcaggctgtgttgtggggtccagaggggctgatacatgtaaagttgatggaatatcctgctcaatggtgaatacgacctaagtgttagctgctgttatctcctttaatccatacaagaaccctctgagggaggtattatccccattttacagaggaagaaactgaggcccagagcggggaagtggcttgctctgggtcacacagcaaggacttgctggagccaaagcttctggcccaggggcagtgcccttccaggcagaagcagctgaaagccttgttctggcattgcagcccagtgtggaggggcgagacttggggtgctgagagggcctggctcccttcttggtgggctgggagcctcagtgtctggcaggtggctgtgctgggcttgtgcatttcccagccatgtctggttcagcccacagaccccggggctgccctttgcaggtgtgagtcaatgtgggaacccaggacattacggatagcccctgggctgccctcaccccagcattttgggtgtcccttgtccctgtgtcactgtcactcccctcaccaggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaagatatcttttccaactattctgcttgcctttgaatgttatttatggagtctggggtggttgtcataaagtgtaaactattggtttagtaaaatgtatcaatctttttctttgttgtctatgtttttaatattattaagaagccttgttttttctaagaccataaagatatgctcagatattttcttcccaagttttagctttgcatgtttaatccattcgaatttttgtttttgtgttgagtgtgaggaatattacacgtgaaaactggccgaacatcatttattattaaagtccatcttttccctactagtatttaatgcctcctttaatacacatcacgttctcacaaatgccatggtctatttctgaaatctactttgttccacagttctctttaccaattactatacccatatcatacaatctaataaccatagtgttgaattgttctttaatatctgatagggtgtatcatctactttttttcaaagctaatacatgttagcaattattattattactattcgtacacctttagacttccttatgattttaaaatcaccttgtcaagttatttgaaaaatctcattagggtattgattagaatttcattaaatttatagactcctatggaaagaactgatatatttaaaatgctgagtcttctgatctatgaacatggtatatatttatgcatttattcaaatttccttttatatccctcaataaaccattagcattttctctacaaaattcttgaacattttcactagtatgtctctagatatttatagtttttgttactgttgcaaatatctttatattctattacttttctaattggttaattagaatgctgctcttgtagtcagcaattttgctacactttcctattagttccaatagttttccacttgattctgttgggtttccccatatccttggcaacctttgcctgttgtctgttgccattgcc

SEQ ID NO: 460023 - DNA, 821 bp, Homo sapiens
cctcaccaatgtgggtgggcctcattcaatccattgcagacttgaatagaactaaaaggaagaggaagggcaaatttgttggctgcttgagctgggatattcatctttctcctgatcttggacatcagaactcctgattctcaagcctttgggtttggactggaggcaccagctttcctgggcctccagcttgcagatggcatatcatggaacttctcagcctccaaattcataactctaatacaccagtacaatggaaagattcctaaattcaaaagccagaaggctgggttcctgttcccaccctgccttttaccttctgtgtgttcctgatgaagacacttcatgctccactatttacttacctctgaaacgaagggctgacccagatcagttgttctctgacctgcttggagggactcagaggctgtggagcaacagatttgggaatgaggaatcgttccctggaagagtcagagcgctcgtagacacattctgctggattgcacgagctcctcccctgggaaatccactaagactagaggaaagaattgcttggaggattcagaggctgaagagtggacagacggctttaattgagaaaaagaagcagaaaattgaggaagatgtgaggcatcaatgccagcagacgacatgtgacaggtgctagccacatggatcacactaaatttctgtcatttatatagataaaaaagaatttccaaagagctcctccataattcagcattaaccagctttaaatcatcacctttctttaccttttcaaagcacttttatctagctagctttcactttcagag

SEQ ID NO: 460024 - DNA, 875 bp, Homo sapiens
cctcaccaatgtgggtgggcctcattcaatccattgcagacttgaatagaactaaaaggaagaggaagggcaaatttgttggctgcttgagctgggatattcatctttctcctgatcttggacatcagaactcctgattctcaagcctttgggtttggactggaggcaccagctttcctgggcctccagcttgcagatggcatatcatggaacttctcagcctccaaattcataactctaatacaccagtacaatggaaagattcctaaattcaaaagccagaaggctgggttcctgttcccaccctgccttttaccttctgtgtgttcctgatgaagacacttcatgctccactatttacttacctctgaaacgaagggctgacccagatcagttgttctctgacctgcttggagggactcagaggctgtggagatactcaagtaatgcccaggtctcaggaatgtataatctcttgcttatctctagcaacagatttgggaatgaggaatcgttccctggaagagtcagagcgctcgtagacacattctgctggattgcacgagctcctcccctgggaaatccactaagactagaggaaagaattgcttggaggattcagaggctgaagagtggacagacggctttaattgagaaaaagaagcagaaaattgaggaagatgtgaggcatcaatgccagcagacgacatgtgacaggtgctagccacatggatcacactaaatttctgtcatttatatagataaaaaagaatttccaaagagctcctccataattcagcattaaccagctttaaatcatcacctttctttaccttttcaaagcacttttatctagctagctttcactttcagag

SEQ ID NO: 460025 - DNA, 573 bp, Homo sapiens
gagagaatctggctaagtgtctagcaggatgattgattaacaagatgttttgttttcatcatctcagagaagctgtattgaggtataattgatatgccaaataactggacacattcaacttgtgcaatttgatgagtttggagatacacatacatctgtgaaaccatcaccaaaatcaagaacaactttctctgatctctgtggacatgcttaaaatggctgactcacacagcaagactatttaactgtgcctaaaatcaacccacattcagatgctaactgtaatcctattccctgatccatcaggaaaaagagtctgattgacataacttgtcaagtgttcgccccagcttctatcaactatggggaaggaagggccagaagaggtgtaaccatcatggctaccaggtttcgaaatatttacattacatactgcatttattaaaatacaaattaaatctgcaataaaaaactaattgaccattcaatgggattccgtctatgggtaatattttctgcagaaaatgttaacctctcccttaatggtaatggttaagctaagttggtgcttga

SEQ ID NO: 460026 - DNA, 530 bp, Homo sapiens
atttttcatctgcagcccaatgcaaagagctgtattgaggtataattgatatgccaaataactggacacattcaacttgtgcaatttgatgagtttggagatacacatacatctgtgaaaccatcaccaaaatcaagaacaactttctctgatctctgtggacatgcttaaaatggctgactcacacagcaagactatttaactgtgcctaaaatcaacccacattcagatgctaactgtaatcctattccctgatccatcaggaaaaagagtctgattgacataacttgtcaagtgttcgccccagcttctatcaactatggggaaggaagggccagaagaggtgtaaccatcatggctaccaggtttcgaaatatttacattacatactgcatttattaaaatacaaattaaatctgcaataaaaaactaattgaccattcaatgggattccgtctatgggtaatattttctgcagaaaatgttaacctctcccttaatggtaatggttaagctaagttggtgcttga

SEQ ID NO: 460027 - DNA, 558 bp, Homo sapiens
ttactttctctttcagtaatgacatggatctggagagattctcttaggagagaatctggctaagtgtctagcaggatgattgattaacaagatgttttgttttcatcatctcagagataagtacaactattctgtcatctaatctgctaactcctacattatcaatacggtagtaataaattatgaataaacataaaatatacagagatagaaactgcaaatttatttcagagagcacagttaagggactgattttattatttacactgaattataagcacaattatttcctccaactataaccacagaaagcactttaaattaggatgcttgggctgaacagcccagaaaatctactagccagaaattgagatgagcctgtggatagagttttaggtcatgcttccagttcacattccagcagagataaatgtgaggcctgggcagcatttaggttttgaggtttttcactctttgttttttcctttgacttttagcagtagctagccatgatgaatgactatcaattacaattagggttgccagataaaatatagg

SEQ ID NO: 460028 - DNA, 877 bp, Homo sapiens
tgctgcctcagacatcatcttttcttcactctgtctaaagcatgaatgtccttagatgttcattcaaaattagtgccagggagtgctatttggcaaggccacttagaatatatctgaaaatcatactccttgtaacacagtatgaaacatactccttgtatctcagtctgaaaatgatactccttgttacaagtcagcagagacatgaaggacaggagaggcaatggagtctccaaggctctagccacacccagcatacactgagggagacaaaacaaaaacaaaaacaaacaaaaaaacacacaaagaaacgattttctttgtattacccacagacaagtctgcaccagagaataaaagggcattccttagggttgctgaggattttctttgattgtattctgctaatgtgtgtgcaaggcagatataacacatttgtggaaggctctagagacattttctacaaattttaccctggtttcagaacaactttctctgatctctgtggacatgcttaaaatggctgactcacacagcaagactatttaactgtgcctaaaatcaacccacattcagatgctaactgtaatcctattccctgatccatcaggaaaaagagtctgattgacataacttgtcaagtgttcgccccagcttctatcaactatggggaaggaagggccagaagaggtgtaaccatcatggctaccaggtttcgaaatatttacattacatactgcatttattaaaatacaaattaaatctgcaataaaaaactaattgaccattcaatgggattccgtctatgggtaatattttctgcagaaaatgttaacctctcccttaatggtaatggttaagctaagttggtgcttga

SEQ ID NO: 460029 - DNA, 1600 bp, Homo sapiens
gtcgcctagcaacgaggcacaacaagggactgggggttcgtctgctgggtttgcggagcagctagctactcggcgggatctcccggcaggatgggtaaaaagataaagaaggaagtagagcctcctcctaaggatgtgtttgacccattaatgattgaaagcaaaaaagcagcaactgtggtgttaatgcttaattctccagaagaggaaattttggctaaagcatgtgaagccatttataaatttgctttaaaaggtgaggaaaataaaacaaccctccttgaacttggagctgtggaacctttaactaagctactcacccatgaagacaaaattgtaagaagaaatgctactatgatatttggaatcctggcttctaataatgatgttaaaaaattgttaagggagttagatgtcatgaattctgtcattgcccagctcgctccagaagaagaagtagttatccatgagtttgctagtctttgtctagcaaacatgtctgcagagtacaccagtaaagtgcaaatatttgaacatgggggattagagccactcatcagactactgagtagccctgacccggatgtaaagaagaactctatggaatgcatttacaacttggtgcaggattttcagtgtcgagctaaacttcaagaactaaatgcaatacctcctatcttagatctcttgaagtcagaatatccagtgattcagttgttggctctcaaaaccttaggtgttattgcaaatgataaggagtctcgaacaatgctaagagacaatcaaggattggaccatcttattaagatcctagaaactaaggaattgaatgaccttcatatagaagcacttgcagtgatagccaattgccttgaagacatggatactatggtgcagattcagcagacagggggtcttaaaaagctcctgtcatttgcagaaaactctacaattcctgatattcagaagaatgcagcaaaagccattactaaagcagcttatgatcctgaaaatagaaaactttttcatgaacaagaggttgaaaagtgccttgtagcccttttgggttctgaaaatgatggaactaaaattgctgcttcccaagctatttcagcaatgtgtgagaattcaggcagcaaagattttttcaataatcaggggattccacagttaattcagttgctaaaaagtgacaatgaagaggtacgggaagcagcagctctagccctggcaaacctaaccacttgcaaccctgctaatgcaaaagttccattttctaacaatgcaaggaactgcgtcttcatactgacccctagtggccgattaggaggacgttgggggaggggcaaaaaaggtaatggaaggatggttctgtagtttaatgaaacgtacgttaatttaatttggaacactctccagtgtatctaagataatatttccaaaacatttttaaaagattccgatctgaaaatcatttcaacatgctgcttttagagataatattctactgctaaacgtgtgtttaacagatgcttgtgtttgactttgtcccctattaaggtgtagtcatttacaaatgttttgacgcattcattgtacc

SEQ ID NO: 460030 - DNA, 1421 bp, Homo sapiens
atattgcatctttttccaggatgggtaaaaagataaagaaggaagtagagcctcctcctaaggatgtgtttgacccattaatgattgaaagcaaaaaagcagcaactgtggtgttaatgcttaattctccagaagaggaaattttggctaaagcatgtgaagccatttataaatttgctttaaaaggtgaggaaaataaaacaaccctccttgaacttggagctgtggaacctttaactaagctactcacccatgaagacaaaattgtaagaagaaatgctactatgatatttggaatcctggcttctaataatgatgttaaaaaattgttaagggagttagatgtcatgaattctgtcattgcccagctcgctccagaagaagaagtagttatccatgagtttgctagtctttgtctagcaaacatgtctgcagagtacaccagtaaagtgcaaatatttgaacatgggggattagagccactcatcagactactgagtagccctgacccggatgtaaagaagaactctatggaatgcatttacaacttggtgcaggtgttattgcaaatgataaggagtctcgaacaatgctaagagacaatcaaggattggaccatcttattaagatcctagaaactaaggaattgaatgaccttcatatagaagcacttgcagtgatagccaattgccttgaagacatggatactatggtgcagattcagcagacagggggtcttaaaaagctcctgtcatttgcagaaaactctacaattcctgatattcagaagaatgcagcaaaagccattactaaagcagcttatgatcctgaaaatagaaaactttttcatgaacaagaggttgaaaagtgccttgtagcccttttgggttctgaaaatgatggaactaaaattgctgcttcccaagctatttcagcaatgtgtgagaattcaggcagcaaagattttttcaataatcaggggattccacagttaattcagttgctaaaaagtgacaatgaagaggtacgggaagcagcagctctagccctggcaaacctaaccacttgcaaccctgctaatgcaaaagttccattttctaacaatgcaaggaactgcgtcttcatactgacccctagtggccgattaggaggacgttgggggaggggcaaaaaaggtaatggaaggatggttctgtagtttaatgaaacgtacgttaatttaatttggaacactctccagtgtatctaagataatatttccaaaacatttttaaaagattccgatctgaaaatcatttcaacatgctgcttttagagataatattctactgctaaacgtgtgtttaacagatgcttgtgtttgactttgtcccctattaaggtgtagtcatttacaaatgttttgacgcattcattgtacc

SEQ ID NO: 460031 - DNA, 1193 bp, Homo sapiens
ggtctcatgcaccatgacagccacccatggtgagatgagggtgcaaatagggacacagcagctggacttggagcagcaggacctgcagcagctggactgggagcagcagggcttgcagcagctggaccgggaacagcaggacttgcagcagctggaccgggaacatcaggacttgcagcagctggaccgggagcagcagggcttgcagcagctggactgggagcagaaatttgtcttggaaattcccactctgctcttccccggcagtatcagcagtcgcttagatctgtggccactggagaacaggcagcgagcggccctggaggatccagggtcccaatggtggttgagaagctggttcttagtgatcactgagcaacattggcctggccttgtggggtcagaccttgcatctcagtcagccgagggagaagaagaagatggtccacacccaagtgcagggaacaccatggcagttggctgggtgcccgcgtccaggcaaggccacctcctgcatcaaggaaacatgcatttccggagtgaggaggctgaaggcagggcccagtggagagctgagccatggaaggagcagcagggcttgcagcagctagactggcagcacacggggacacagcagctggactggcagcagcagggattgcagcagctggactggcagcaggatccacagcctgaggagcaacaacagggcttacagcaattgcactgggagcagccacaagaaccacagccccccttggagcccccacaggaaccacagccacctttggagcccccacaggagccacagccccccttggagcccccacaagagccacagtcccccttggagcccccacaggagccacagctggagcaggaacaggctggcacacagcagcacacgggcttgcagcagcagacgggcacacagcagctggagccacagcccccacagccagagccatagcccccacagccggagccacaacccccacagccggagccacagcctccggagcagccacagcagcccatgattctggtagattgagggtggatcaggtagaggagcaggtgagagggaggtgcaggtgtggagctccctgagcccgggctctttatatacctgtccagatgtcaggcaggacacagggtccctttcttgtgactgtttacattatttttccaga

SEQ ID NO: 460032 - DNA, 1988 bp, Homo sapiens
cacagaagagcatgactgttagcgatcatattggaaatatggcccaaagtgacttcctttacccagagaacccaaaaaggcgggaagaagtaaatcgtcttcaccagcagcttcttgattgcttatctgacagcttcgatgtcaccaataagctgactgaggttctaaatatgcacttggggtgcaggctggcctccattgagatgaaaagagatgggaccatcaaagaaaactgtgacctcatcatccaagccattatgaaaatccaaaaggaattgcagaaggttgatgaagcactaaaagataagctagagccaaccctctatagaaaacttcaggatattaaggaaaaggaaacagacaaaattgcaatagtgcaaaaggttatttcggtcatcctgggagaagctacatctgcagccagtgcagtcgctgttaaacttgtgggctcaaatgtcacaactggcataattaacaagttggtcactgtgttagctcaaattggtgcttctctccttggtagtattggagttgctgttcttggccttggcatagatatgattgtccgtgccatcctgggagcagtggaaaaaacacagcttcaagcagccatcaaaagttatgagaagcatctggtggagttcaaatcagcctcagaaaaatataatcatgccattactgaggtcatcaatacagtgaaacaccaaatgaaatgaacagccgttttatttgccactgaagtgtttttctgcttccttttcagtaacagtgtttgcttctttgattaggttcattttctataggcttccaatatggacttaaataagataaacaatttggagagggaaactggagatgccaagactagatgactagatgagttttgagtcaacaatgcctggatcagctgatgctagaccctgtgaggtaaaaaaattttctccctggatgttttcacaccctgctctaccagatcaacattggggtaaatgctatcgtagagtagcaagtataggggttacttttctcttttctaatttcagtaaaattcttaaatttcacattgaatgcagagactttcatttctaccaccagcttcaaacatcatttagttataaggggacatactcagtaacttctgcctagacacaaactctaggccttcgaatgagacagaaatactaccatatttttgaccatcagagtaaatctggttttctgtaaactagaagagactgaaaaatggtttgtaacaatgtgcttcaattaggacaggaagctgatctgtaaacgtctactgattacacaatgtaaaccggatggatttgaaaatggtaaaaatcaaaactaaaaacatcaaggtcctgtttcagtcactgcaatcaaccctgaccaactgtgataattaaatatcgctcaagtgaatgttcaaacactgaaacatttagaagacaagaaagcaaaacacagctacacatattgcatttaggatgcagaatagaaggtcactactcaaagcatttgtcatttaaaagaaagtcataatttattataagctttcagaaaaaagaatataatttcattttcaacactagcaaaaaggaggcagctgcctttgctacatgacgcattaggtgggccatttcactaattacctgattttagaaaacgccaaaggctatggaagcctattaatggttccgctgaatctctgcagatgtgtttgttttctaaatcctttgccaaccaataattcccatgaggactcttttagtctatactgacaaaattattaatatgctgttgatgccagactgtgtttgttatagttgattctcccatccaagtacaagaaatgtattgaaataaaaactgctcagcatatcttaaaaatagtagctacatataaaattttagctacatgaaagactttaatatttccaacatacactgttttctctttctcttcttgcattgtttttcaaaac

SEQ ID NO: 460033 - DNA, 1607 bp, Homo sapiens
cggccgcccgagtcggcggcgctgggcggcctgggccccgggctgtgctgctgggtgtcagtgttctcctgcctcagcctcgcctgctcctacgtgggcagcctctacgtctggaagagcgaactgcccagggaccatcccgcggtcatcaagcgacgcttcaccagcgtcctggtggtgtccagtctctcacccctgtgcgtgctgctctggagggaactcacaggcatccaggtgcgaaggaggcggggcaaagggcaacggcggtgagagctcaggggtctttaggggaggaagcaaaactgatgccccctttcctgtggctcagccaggcacatccctgctcaccctgatgggcttcaggctggagggcattttcccagcggcgctgctgcccctgttgctgaccatggtgagtgctcctgctgtattttttcttctggtctttgttatcagcctgatgggcagtgccgtggactcttgtttttggtttttggttgatgggagacaggacttttgagatggccccagggtcctccgccccccgctcctgggcccgctgcctcacagacatgcgttggctgcggaaccaagtgatcgccccgctgacagaggagctggtgttccgggcctgtatgctgcccatgttagcaccgtgcatgggcctgggccctgctgtgttcacctgcccgctcttttttggagttgcccattttcaccatattattgagcagctgcgtttccgccagagcagcgtggggaacatcttcttgtctgctgcgttccagttctcctacacagctgtcttcggtgcctacactgctttcctcttcatccgcacaggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaactctcaccggctccccagccctccccaccaaggggtactgcaggggaagggctggctggggtccccgagatctcaggaatttttgtaggggattgaagccagagctagttgcgtcccagggaccaagagaaagaagcagatatccaaagggtgcagccccttttgaaaggggtgtttacgagcagctctcctctgcctctgaaaagctgctcggggttttttatttataaaacctctccccaccccccaccccccaacttcctgggttttctcattgtctttttgcatcagtactttgtattgggatattaaagagatttaacttggaggaacccagaacacaggctgcagccctgagggcagcagggactttgccaagcaacacagtgactccagggtccttctcggcacctgcaagtgttctgcctgctctccatcatttttggaagggctctcgtttccctgcctgtgctcttttaaaattagattcctgaaagagtatt

SEQ ID NO: 460034 - DNA, 1509 bp, Homo sapiens
cggccgcccgagtcggcggcgctgggcggcctgggccccgggctgtgctgctgggtgtcagtgttctcctgcctcagcctcgcctgctcctacgtgggcagcctctacgtctggaagagcgaactgcccagggaccatcccgcggtcatcaagcgacgcttcaccagcgtcctggtggtgtccagtctctcacccctgtgcgtgctgctctggagggaactcacaggcatccaggcacatccctgctcaccctgatgggcttcaggctggagggcattttcccagcggcgctgctgcccctgttgctgaccatggtgagtgctcctgctgtattttttcttctggtctttgttatcagcctgatgggcagtgccgtggactcttgtttttggtttttggttgatgggagacaggacttttgagatggccccagggtcctccgccccccgctcctgggcccgctgcctcacagacatgcgttggctgcggaaccaagtgatcgccccgctgacagaggagctggtgttccgggcctgtatgctgcccatgttagcaccgtgcatgggcctgggccctgctgtgttcacctgcccgctcttttttggagttgcccattttcaccatattattgagcagctgcgtttccgccagagcagcgtggggaacatcttcttgtctgctgcgttccagttctcctacacagctgtcttcggtgcctacactgctttcctcttcatccgcacaggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaactctcaccggctccccagccctccccaccaaggggtactgcaggggaagggctggctggggtccccgagatctcaggaatttttgtaggggattgaagccagagctagttgcgtcccagggaccaagagaaagaagcagatatccaaagggtgcagccccttttgaaaggggtgtttacgagcagctctcctctgcctctgaaaagctgctcggggttttttatttataaaacctctccccaccccccaccccccaacttcctgggttttctcattgtctttttgcatcagtactttgtattgggatattaaagagatttaacttggaggaacccagaacacaggctgcagccctgagggcagcagggactttgccaagcaacacagtgactccagggtccttctcggcacctgcaagtgttctgcctgctctccatcatttttggaagggctctcgtttccctgcctgtgctcttttaaaattagattcctgaaagagtatt

SEQ ID NO: 460035 - DNA, 3777 bp, Homo sapiens
ctcctcgccgcgcggttggggagcgccggggcagggaggcgggcaccaggcgcgggtccctccgggcaggggaggtaggcctgggcctgacgccggccacgcagcggcgggagagtgagcactcgggcggcggcgtcctggagacccgcgagagatggaagcggcggcgacgccggcggctgccggggcggcgaggcgcgaggagctagatatggatgtaatgaggcccttgataaatgagcagaattttgatgggacatcagatgaagaacatgagcaagagcttctgcctgttcagaagcattaccaacttgatgatcaagagggcatttcatttgtacaaactcttatgcaccttcttaaaggaaatattggaactggccttttaggacttccattggcaataaaaaatgcaggcatagtgcttggaccaatcagccttgtgtttataggaattatttctgttcactgtatgcacatattggtacgttgcagtcactttctatgtctgaggtttaaaaagtcaacattaggttatagtgacactgtgagctttgctatggaagtgagtccttggagttgtcttcagaagcaagcagcatgggggcggagtgtggttgacttttttctggtgataacacagctgggattctgtagtgtttatattgtcttcttagctgaaaatgtgaaacaagttcatgaaggattcctggagagtaaagtgtttatttcaaatagtaccaattcatcaaacccttgtgagagaagaagtgttgacctaaggatatatatgctttgctttcttccatttataattcttttggtcttcattcgtgaactaaagaatctatttgtactttcattccttgccaacgtttccatggctgtcagtcttgtgataatttaccagtatgttgtcaggaacatgccagatccccacaaccttccaatagtggctggttggaagaaatacccactcttttttggtactgctgtatttgcttttgaaggcataggagtggtccttccactggaaaaccaaatgaaagaatcaaagcgtttccctcaagcgttgaatattggcatggggattgttacaactttgtatgtaacattagctactttaggatatatgtgtttccatgatgaaatcaaaggcagcataactttaaatcttccccaagatgtatggttatatcaatcagtgaaaattctatattcctttggcatttttgtgacatattcaattcagttctatgttccagcagagatcattatccctgggatcacatccaaatttcatactaaatggaagcaaatctgtgaatttgggataagatccttcttggttagtattacttgtgccggagcaattcttattcctcgtttagacattgtgatttccttcgttggagctgtgagcagcagcacattggccctaatcctgccacctttggttgaaattcttacattttcgaaggaacattataatatatggatggtcctgaaaaatatttctatagcattcactggagttgttggcttcttattaggtacatatataactgttgaagaaattatttatcctactcccaaagttgtagctggcactccacagagtccttttctaaatttgaattcaacatgcttaacatctggtttgaaatagtaaaagcagaatcatgagtcttctatttttgtcccatttctgaaaattatcaagataactagtaaaatacattgctatatacataaaaatggtaacaaactctgttttctttggcacgatattaatattttggaagtaatcataactctttaccagtagtggtaaacctatgaaaaatccttgcttttaagtgttagcaatagttcaaaaaattaagttctgaaaattgaaaaaattaaaatgtaaaaaaattaaagaataaaaatacttctattattcttttatctcagtaagaaataccttaaccaagttatctctcttttatgctactcttttgccactcacttgagaacagaataggatttcaacaataagagaataaaataagaacatgtataacaaaaagctctctccagatcatccctgtgaatgccaaagtaaactttatgtacagtgtaaaaaaaaaaaatctcagttatgtttttattagccaaattctaatgattggctcctggaagtatagaaaactcccattaacataatataagcatcagaaaattgcaaacactagaattaattttacactctaatggtagttgatcttcatagtcaagaggcactgttcaagatcatgacttagtgtttcaatgaaatttgaaaagggactttaaaacttatccagtgcaactcccttgtttttcgtcagaggaaaaggaggcctagaaaggttaagtaacttggtcgagaccactcagccttgagatcaagaaaacctaatcttctgactcccaggccaggatgttttatttctcacatcatgtccaagaaaaagaataaattatgttcagcttaattttagtgttgaatctatttgattatattttaatactttgaaaatgaatgtgtgatttttaatagtatatgtgacctgagcagaaaatcagggaactccaagaagcctacactgtggccatataaacctcagcaagagaaagaagctatgttcttttaaaacagaatagagaccgcttgctggtgaaactcctggctagtaagatgtgtgtctagctatactatttgtggcttgagcttttttaattattaccttcctttcctgagttttgtaggcaccacattcctgaatggcagaaaatagacacctcagaaaacggaggatttgtggactctttccagccctgtggcttttcttatcacagccttttatttattatgagcagaataaaagaatcagctaggtgtggtggtctgtgcttataatcccagctactctggaggataagttgggaggatcacttgagaggccaggagcttgagaccagcctgggcagcatagtgagacctcgactctataaaacataaaaatttaaaaaaaaattagcctgatgtggcgtgtacctgtagtcccagctactgaggaggctgaagcaggaggatccctcgagcacaaaagtttcaggctgtgaaagatgctgttttgaaaagaacactaaaaatatttcattagcgttttcttgataacaaataggaaaatatatgtttacaccctgaataaattcagctgtgggtggatttttgtttttcaaaatgattttgttagtttgaatgaaacctaaatataacattcaagtcaattcttttaacatttttctttataacagaatatgaaaaacgctgtcttaaagtgttgtaacttttctgaattttcaataaaatattttgcttgcagttgccttttagataacatttttctaaggttaaatgacattgataagtgtcataagctaaaaatggcactagtataatattctcataataacattttaagcagtctttgtggttaattctgttatgctggaagttgatattgtatacttctaagttttaagagcagaagttgattaaaaatgaaaggacacactcaaaactgtgacctgaacttcctgcagcatgaatgcaggatgagccatctgcagatgctgcattcatgatttactgcttttgtaaggtcaagaatatatatcaatcattttgtttgcattacaaaattaatgctttaggaaagcattatgccaatcctgtagtaaaag

SEQ ID NO: 460036 - DNA, 1118 bp, Homo sapiens
ggatgagctgagctgcccacgtatgagtctggaccgtgcacatagtgtgaatggggtcagtggcttgtactctactgaagccctgggcttgggtgaggtcactgggggaccttagagagaagagaggaaacaggcctgagcactttcaaggtctaacggcagggagagaagagagatccctcagcaagagggaaggagagcctctccccagggacgtctgggtgctagaggtgcacagggtgctagaggtgcacagattagaaaggacagaagaggctgaaacagaatatgtctcaggactgacggaaagcatccaggagatgggagagagtcataaaatagaactgaggaaagaatgctgtgctcttactgaggaactagggaagatgggctccggagccctgcaggaagaggtgctcccaccatgcatgcacgtctactgactctttaaccctctgtgtacttcatcgttatctactgaaaaaaaaaaagtactgatgtctttatccttggagaggagaggtgtaatcgagatggagaagatgagacaaatggagcacatagaagccacacaaccttcctaaagtcacgcagctggaggccgcacagccagatggctccagaggacatgtccttaatcatgatgttgctatttagcagaaacatcgctgcagaaagtcagaccacagatggggactggtggaaaccaaacatatgactacatcagtctacaaaagcatcatggtattcccacataattcagaagcatgccaggccattcagaatctacagaccagagcaatcatgcaagataatggaagataatgacaaaacaatataatgacaagataatggaagatagtgacaaaaatattctgagcatcattgatttagtcaccctttatttcataaacatcttagaattttcttcccacctttgtttattatttggtgtgattttgtgttttttcttcctaatcttttattaatttattttaagtgacaagtaaatattgtatatatttatggtatacaaaatgtatttgtattttgatatatgcatacattgtggaatggctaaattaagctatttaacatatgcattatctcacatactt

SEQ ID NO: 460037 - DNA, 2065 bp, Homo sapiens
  misc_feature (1115)..(1115): n is a, c, g, or t
gcctagctctgggaccttgaatggtgctttaacagagcgtctgctcccagcgccaagccctcagtgcagagggggagactcaggcggccctcagacacaattcgccaaggtcgcacagcaagtcaggactgaagctaagaagtgctggagacagcagttgctttagccacaggctgtgtagaccacctgaggatgacctgggggtctgttttgtgcaccttggaacccatcggatccctccaatgacacatttgtccagagcaagacaagatcacactttgacagccctctgtcaagatccttgctccaaatctccagactagcagccaggagtctccatgctgttctgaagaagcagattcctcacccacccttcaactccttcccaggaggtaatcctcctccaaatctctggaaaagatacacctcctcttctctgataaaggctggggggtgatgcccctcccccagtttcccaataaagctatgcaagacaggagcaagggatctcacggcctgtttttgctacaaaaaccctttttcggaaaaaataataaagaaaggaatcagccaatccctcctcgatgccatcacctcttctcggtgatttttcggggaaggagtgggtgggttgctatggcaacagatgcgagctcgtctcagtaaagaagggaccttgatatttttttctctctctcattctctcagttgtgtgtgtcgagagacggggaagcacggaggaggaacgcgccggtgcgtcgcgacgggagcgcaggtgtcgagcacccgagctggagtccgcagccgccggtcatgtaccgctccaccaaggcgctccaaggcgcgccgtgaccagatcaacgccgagatccggaacctcaaggagctgctgccgctggccgaagcggacaaggtccggctgtcctacctgcacatcatgagcctcgcctgcatctacactcgcaagggcgtcttcttcgctggtggtgagcatgctggggctaccgcagatccgagctgccaggcgccggagaccctggagctgagggaacccgctggggctggatctcctgtcgccttcggggcgctgcccatggtgctgacggctgcgggcnctcctctggcgggccccacggggcttctctcagctcaagagcttgaggacatcgtagcggcactacccggctttctgcttgtgttcacagccgaggggaaattgctctacctgtctgagagtgtgagcgagcatctgggccactccatggtggacctggttgcccagggtgacagcatctacgacatcattgacccagctgaccacctcactgtgcgccagcaactcaccctgccctctgccctggacactgatcgcctcttccgctgccgcttcaacacctccaagtccctcaggcgccagagtgcaggcaacaaactcgtgcttattcgaggccgattccatgctcacccacctggagcctactgggcaggaaatcccgtgttcacagctttctgtgcccctctggagccgagaccccgcccaggtcctggccctggcccttgccctgcctcgctcttcctggccatgttccagagccgccatgctaaagacctggctctactggacatctccgagagtggctgagagtggagatattcaggcagagatggtggtgaggctacaggccaagactggaggctgggcatggatttactgcctgttatactcagaaggtccagagggacccattactgccaataactacccaatcaggtaagccacaagccaggggactagggggcagctgaggtcgtcatggaggagacacaaatcagggaactgctctggatatggacgtcggacccttaccagctgcctcttctctcctctccagtgacatggaagcctggagcctccgccagcagttgaactctgaagacacccaggcagcttatgtcctgggcactccgaccatgctgccctcattccctgaaaacattctttcccaggaagagtgctccagcactaacccactcttcaccgcagcactgggggctcccagaagca

SEQ ID NO: 460038 - DNA, 1796 bp, Homo sapiens
acacttcctgatttcaaaatctacaagttactacaaaactgaaatattttgtcatcaaaaagcatgacacctacagcagaaaaacagttagaaaagcctttggaaaatggcagtgaattgcaagaaggagatagtcttacagttccgacaaaacttagccaatatgaaaggcaaggtgaaataaaaacatcattgcatgggaaaccaaagactgacattgctgcttttgaaaatggagtgaatgatgtccagccagtgaagaagcctcattttaaaggtgtgaagaaaagaaaatggatttatgatgaaccacagaactttcctaactctggaatgcagagagcagtacaggccccaagaccccaaaataaaatgagttatcaccgcaataataaaaatcgaaatgcggagaatgcatcctatatccacgttcaaagagatgctgtcaggactgtcgcgttgaatgcaccttcccgcagcaggcccacgcatgggtcctacaataaagtccatgctaacagggaacccaaacccaacctcagtccagacaaatatacgtcaacatcatataatgattcagcctggcgaaaacgaattcctttttcaaaaacatattcaaaaagtgaaaagatatatccagagccaagaagaaatgggagcaagtaaacctggaggttgagagagagaaaaatgagaaaaaattgccagacatcatctgatttacaatcaaaaatgaaaattcaaagaatgagatactcaagtactccatgttatgtagtggatagccaaagatgataaaaatgcaaattctgaaaataagatgcaggaagtacattgtgctctttcaaaactgataaaaatgcaaattaccaacagctgccagtgtatttatgtaggtctggaattcattccgtgcattactccaaacattttaataaaatttaaaagtttgacaattaaaatcattctttaattgtaaaccaagttagattacacagattgagaagtaaaattgtgcctttaatttctgttttgcaatattccttatggaagaaacctcacttcttatttctttacctggattttaagctgggccctcagcaatgataacatataaaatgtaaatacattgaatgaagtttcagcattacagtttggtgatgaatatgttagaggaattccaatagaaatacactttaatgcatggtagaaagagacaaagattggcctattattcagggcagttgttgaacaatgttttaattggcagctacaaaatcggtctgctgaggtttgctagattcaaactgaaaaataaacattttcctaccatgaaaataaaaattatatgattatattggagaaaaggacatgtttaagaaaaaagtgtattaataacatggtgttccaaatgtcttagtgatattttaaggcattagtaactccagaagcataaatatttacaagtgaaagagagacatcatttgaaaactaattttgatttctttctgccctttttagaattgtgttttgaatagtacttttaaatttaatttttaaaattttcatcaaagtgaaccacccgcagtgactgaaacaaaaacttaaaaatttattctttaaattgaaaaacatgtttgaaagcaatataagtaattaatatttaaaatgatgtaacatttaaaatgatgtctttgtaagtgtagtatttatacttctgagtttattaaagcttagaaattcactaagactttgggatatctcatatttatatttgcatgaattttgtggttatc

SEQ ID NO: 460039 - DNA, 1094 bp, Homo sapiens
  misc_feature (2)..(2): n is a, c, g, or t
  misc_feature (6)..(6): n is a, c, g, or t
  misc_feature (10)..(13): n is a, c, g, or t
  misc_feature (15)..(15): n is a, c, g, or t
  misc_feature (17)..(18): n is a, c, g, or t
anagtnggcnnnntnanngtctaaggggaccattacctaaaatgcattcactaaatgatggatttactaagagatttgctaagtgacatgaaatacctcggttatccaaaattcacctctaaacccaaaaggagagcttatagaatcaaacagttgcctcaataccttcattatcctttattcttctactctggccctgattttgtcctgtctgactggtattttccaaagcacacatccaagctgccctggcgaaatgccctaggatactgcctaacttcccacatctgtcctggtgctcatcatcatctgctccaaccaaaggtcaaatgcatcaatctttcccagcaggatgtggacagatctgcatctgtaaaggatgctagaggagccatccaaagagtcccaccaatttctgtctgcgttcaccctcttaactggaacctgctacacaagggcatctcacaggtgacctcacgccccactaaaatctcattacttagatgttaactgctttccaaggactggctttctatttgaactgttttcacatcccaaggaaaaataagcaaataagactggctcagggaaacacagcaagtaagtgaaaaatccttgaattaaacaatttaagaagacattgagtgtgggaacttagaagagtgggtaaagtaaaaagaagaaagaaaacctcaaatacaaaatcaatgtaaacagacatcttgctcaggtggcttaccctgttgttacttatctagtatttaaatgtccaagtgtctgtttctttggagaaaaaactttatagaaagtacctccttcatagcgctgtttataagaaaatgcgcatctgacaggaagtctattttttgaggactgtgatctgcagagaaaacacttagaaggacacaatcaaagtcaaaagcctatacattttgtggataagtgatccaaacctaagacagttacaaagaaaatggctctcagctatttacagccagacttcaggccttctgtggatttctttggcattacctcactaagttaatatatcatcacttgacatttaataataaatacctgatgaaattatgcat

SEQ ID NO: 460040 - DNA, 773 bp, Homo sapiens
gtaaaacagtgaagttctcacggacgacctcattgaattcccgatctggttcactctgcaaatgagggatacaagcttgtttatttctgattggctgatgcaagtcacagtctatttcttaagtccatatgatgaaatgggtacaggtagcagttgtgttgctggtgggctggttcaggttcttgactttgctgcacaaaagaagtcttactttgagagtgagtccaacgtaaaagtaagcaagagaggttactgcaaagtgaatgtacactctgacagccgatcagagtgggctgctcaaagatattgtccgtgtgatcagcacagtcagaaagatgtggggtttccaggacaggaggtcacatgtgccatgtcttctctcagtcctgatgtccctgctgattcctctggggcatggcgagtgacgaggacaccctctaacatactttctctattgcacatggggccacaagcccagcagagggagccacgtgatggaggtgtccacctgctgaccccacagccaccacctcctccctcagactcacccgaggatttgtgggccttgctccttaccgggagtcgccttctggccttttcttcctcgtggtgaatcctcttgccaataaaatgtgccaacatcacttcctttaatgttctgatagccacttccctgtggtacaaatggattcctggtagttcttgctgccccctcatgtcctgccctaacataatgagggtatgttgcactagttgtattgtgttttgttggc

SEQ ID NO: 460041 - DNA, 178 bp, Homo sapiens
aaatgatggctggtcccattccggggggaggtgtaacaatgcagtgggaacctcaaagtgtgtctcggccgtgcctttcacattccaaacaatgcaaaagcttgaagaaaacctcagcagttgaaaccgtgatgcagttcagcaaagaagtagctcctgtccccgtaaaacagtgaag

SEQ ID NO: 460042 - DNA, 2494 bp, Homo sapiens
cacccatctattacttcactgttctgtagatcacaagtccaacttggcatggctgctgcatactttgctcaggatgtccgaggcaaaaggcaaggtataggctggttcaagttcctgtctgaaggctctgggggaatacccaattccaaatccattcaggttgtttgcatgatctggttcctctcagttaaagaactggttccccgctcttcttctgcgtctattaatgtggaggttacattgtgctgtgatgcgttttttatgtctgtttactcccacaagaatagagcttttcaaaagagaagattgtctctgtcctatttgcagtttagtcctcagtgcctagggtgcctggcacatggcaggttctccatcttcccatctgacggcttaaaagtgtggcacttcctacctcactctctctctctctcctgctgcattgtgaagaaactgcttgcttccctctcaccctctgcagtttcctgaggcctccccagccatgcggaacgctgtagaccaagacctggaattaacacatcagaagattctatgaggaaacccatttaaaaataggatgcatttttttcttttctgcacagggagaaagtttaagctctcctcactatgagttttcaagtataaaagactttttcttccacgattttgagaacaactgaggactcttgtgaccaggacaacagggaagcttgcagcaagatagctccaggttggattcatgcttcgcaccccaagggctgccagccagagaggaggagaagcaatcactcctgcagtttctgaacactacacagacgccaggtagcttcttcaggagaacagccctctgaggaggcaggaagaggaggcttatctttcagcagccggagctgctgagatctctgggcagattaagctctctctaatggatgggctccagcctggcacattcagtggagagggatccactcatccatcatcaacataatatggtcctccctgcacttcacagtgtcctcttgctattgaaaaggcttttttgccttctcaagtttctttgtcaacagtctacaggaagaagctcaggccgccaccggcagaggtgaatgcaagctcacgttttatttctgactgcttaatcattgcctcgatcactgctcaagctctgcctttgtttccaaaggttacctgtgggaaaacttctttttctatgctgaaattaatagggaggcaaagatgagtccactgataagcagagccttaaaactcacatagagaaacaactttgctggagtgtgtgtgagtgaaccactaaggaatcagatagtgtgatggcagttatcattgcaggttaagacatttctacaaatatttcgacatctccatatactcactcctttcccccctgagtggagagactcagctaccaagagaggaagctcaaaaaaaacagaagcttcaaacaaacaaccaaccaaaaaaaaaaaaaaactgtgggttcatcagaggtggtagggaagacaaaaacatgggaggagcagctgggcacggtggctcaagcctgtaatcccagcactttgcgaggctgaggtgggtggatcacctgaggtcaggagttcgagaccagcctggccaacatggtgaaaccccatctctactaaaaatacaaaaaattagccgggcgttgtggtacgcacctgtaatcccagctactccggaggctgaggcagcagaatcgcttgaacccaggaggcagaggttgcaacgagccaagatcgcaccattgcactccagcctgggcaacaagagcgaaactccatctaaaaaaaacaaacaagcaaacaaacaaaaaacacgggaggagcaataaaaaggaatccatgctttgatttttttttttagtgagaggaagggaaggctgctgcctctcacttctccctgttttgttgttcttttaagtagcatgtgtcactctgtatatatcctgtccatgtgttttcttttattattatttgtccacttgcctagaatgaaaactccatgggagcatggctatagtgtcttgttcactcctgcctctccagggcctgaaacagaagtaggtagacagagcctgaaacaaaagtaggcagtccataaactttgctgaaggaatgagtgaatgaatgaagaccccaaggatggacctcaggaaggtgagcctgggcaaaggttttcagtcctagtccatcatgaccacatagctggaatacacttatttcactttgtcacatgaattagagattcatttggggaaacaagcaactgttagagttgcagacatctctgaggggtaaatggctgttcaaatcttgcatcttaccctgatcctcactctatctgctttccaaaaacatggagctaagatcccagcactgagaagatgggcattcctagcagggggcatttaggtgtagacagcctcagtgactcctgggtttaggatcagtgagataat

SEQ ID NO: 460043 - DNA, 2472 bp, Homo sapiens
cacccatctattacttcactgttctgtagatcacaagtccaacttggcatggctgctgcatactttgctcaggatgtccgaggcaaaaggcaaggtataggctggttcaagttcctgtctgaaggctctgggggaatacccaattccaaatccattcaggttgtttgcatgatctggttcctctcagttaaagaactggttccccgctcttcttctgcgtctattaatgtggaggttacattgtgctgtgatgcgttttttatgtctgtttactcccacaagaatagagcttttcaaaagagaagattgtctctgtcctatttgcagtttagtcctcagtgcctagggtgcctggcacatggcaggttctccatcttcccatctgacggcttaaaagtgtggcacttcctacctcactctctctctctctcctgctgcattgtgaagaaactgcttgcttccctctcaccctctgcagtttcctgaggcctccccagccatgcggaacggccagatgcagtgcctcatgcctgtaatcccagcactttgggaggctaaggagggaggattgcttgagggagaaagtttaagctctcctcactatgagttttcaagtataaaagactttttcttccacgattttgagaacaactgaggactcttgtgaccaggacaacagggaagcttgcagcaagatagctccaggttggattcatgcttcgcaccccaagggctgccagccagagaggaggagaagcaatcactcctgcagtttctgaacactacacagacgccaggtagcttcttcaggagaacagccctctgaggaggcaggaagaggaggcttatctttcagcagccggagctgctgagatctctgggcagattaagctctctctaatggatgggctccagcctggcacattcagtggagagggatccactcatccatcatcaacataatatggtcctccctgcacttcacagtgtcctcttgctattgaaaaggcttttttgccttctcaagtttctttgtcaacagtctacaggaagaagctcaggccgccaccggcagaggtgaatgcaagctcacgttttatttctgactgcttaatcattgcctcgatcactgctcaagctctgcctttgtttccaaaggttacctgtgggaaaacttctttttctatgctgaaattaatagggaggcaaagatgagtccactgataagcagagccttaaaactcacatagagaaacaactttgctggagtgtgtgtgagtgaaccactaaggaatcagatagtgtgatggcagttatcattgcaggttaagacatttctacaaatatttcgacatctccatatactcactcctttcccccctgagtggagagactcagctaccaagagaggaagctcaaaaaaaacagaagcttcaaacaaacaaccaaccaaaaaaaaaaaaaaactgtgggttcatcagaggtggtagggaagacaaaaacatgggaggagcagctgggcacggtggctcaagcctgtaatcccagcactttgcgaggctgaggtgggtggatcacctgaggtcaggagttcgagaccagcctggccaacatggtgaaaccccatctctactaaaaatacaaaaaattagccgggcgttgtggtacgcacctgtaatcccagctactccggaggctgaggcagcagaatcgcttgaacccaggaggcagaggttgcaacgagccaagatcgcaccattgcactccagcctgggcaacaagagcgaaactccatctaaaaaaaacaaacaagcaaacaaacaaaaaacacgggaggagcaataaaaaggaatccatgctttgatttttttttttagtgagaggaagggaaggctgctgcctctcacttctccctgttttgttgttcttttaagtagcatgtgtcactctgtatatatcctgtccatgtgttttcttttattattatttgtccacttgcctagaatgaaaactccatgggagcatggctatagtgtcttgttcactcctgcctctccagggcctgaaacagaagtaggtagacagagcctgaaacaaaagtaggcagtccataaactttgctgaaggaatgagtgaatgaatgaagaccccaaggatggacctcaggaaggtgagcctgggcaaaggttttcagtcctagtccatcatgaccacatagctggaatacacttatttcactttgtcacatgaattagagattcatttggggaaacaagcaactgttagagttgcagacatctctgaggggtaaatggctgttcaaatcttgcatcttaccctgatcctcactctatctgctttccaaaaacatggagctaagatcccagcactgagaagatgggcattcctagcagggggcatttaggtgtagacagcctcagtgactcctgggtttaggatcagtgagataat

SEQ ID NO: 460044 - DNA, 2690 bp, Homo sapiens
cacccatctattacttcactgttctgtagatcacaagtccaacttggcatggctgctgcatactttgctcaggatgtccgaggcaaaaggcaaggtataggctggttcaagttcctgtctgaaggctctgggggaatacccaattccaaatccattcaggttgtttgcatgatctggttcctctcagttaaagaactggttccccgctcttcttctgcgtctattaatgtggaggttacattgtgctgtgatgcgttttttatgtctgtttactcccacaagaatagagcttttcaaaagagaagattgtctctgtcctatttgcagtttagtcctcagtgcctagggtgcctggcacatggcaggttctccatcttcccatctgacggcttaaaagtgtggcacttcctacctcactctctctctctctcctgctgcattgtgaagaaactgcttgcttccctctcaccctctgcagtttcctgaggcctccccagccatgcggaacggccagatgcagtgcctcatgcctgtaatcccagcactttgggaggctaaggagggaggattgcttgagcctgcttccatatcgtaaactgccttggaaccaattaccactaccagggagacaaactattgcttagaggatgctgacaggagcagcatgccaaaattggaagaatgttgtctctcagctggtgccacgaataggtcttcagcaggctgttccattccaccattctgtctggcccactgcttcttacaagattaagatagcagatcccatgggtgtagggagaaagtttaagctctcctcactatgagttttcaagtataaaagactttttcttccacgattttgagaacaactgaggactcttgtgaccaggacaacagggaagcttgcagcaagatagctccaggttggattcatgcttcgcaccccaagggctgccagccagagaggaggagaagcaatcactcctgcagtttctgaacactacacagacgccaggtagcttcttcaggagaacagccctctgaggaggcaggaagaggaggcttatctttcagcagccggagctgctgagatctctgggcagattaagctctctctaatggatgggctccagcctggcacattcagtggagagggatccactcatccatcatcaacataatatggtcctccctgcacttcacagtgtcctcttgctattgaaaaggcttttttgccttctcaagtttctttgtcaacagtctacaggaagaagctcaggccgccaccggcagaggtgaatgcaagctcacgttttatttctgactgcttaatcattgcctcgatcactgctcaagctctgcctttgtttccaaaggttacctgtgggaaaacttctttttctatgctgaaattaatagggaggcaaagatgagtccactgataagcagagccttaaaactcacatagagaaacaactttgctggagtgtgtgtgagtgaaccactaaggaatcagatagtgtgatggcagttatcattgcaggttaagacatttctacaaatatttcgacatctccatatactcactcctttcccccctgagtggagagactcagctaccaagagaggaagctcaaaaaaaacagaagcttcaaacaaacaaccaaccaaaaaaaaaaaaaaactgtgggttcatcagaggtggtagggaagacaaaaacatgggaggagcagctgggcacggtggctcaagcctgtaatcccagcactttgcgaggctgaggtgggtggatcacctgaggtcaggagttcgagaccagcctggccaacatggtgaaaccccatctctactaaaaatacaaaaaattagccgggcgttgtggtacgcacctgtaatcccagctactccggaggctgaggcagcagaatcgcttgaacccaggaggcagaggttgcaacgagccaagatcgcaccattgcactccagcctgggcaacaagagcgaaactccatctaaaaaaaacaaacaagcaaacaaacaaaaaacacgggaggagcaataaaaaggaatccatgctttgatttttttttttagtgagaggaagggaaggctgctgcctctcacttctccctgttttgttgttcttttaagtagcatgtgtcactctgtatatatcctgtccatgtgttttcttttattattatttgtccacttgcctagaatgaaaactccatgggagcatggctatagtgtcttgttcactcctgcctctccagggcctgaaacagaagtaggtagacagagcctgaaacaaaagtaggcagtccataaactttgctgaaggaatgagtgaatgaatgaagaccccaaggatggacctcaggaaggtgagcctgggcaaaggttttcagtcctagtccatcatgaccacatagctggaatacacttatttcactttgtcacatgaattagagattcatttggggaaacaagcaactgttagagttgcagacatctctgaggggtaaatggctgttcaaatcttgcatcttaccctgatcctcactctatctgctttccaaaaacatggagctaagatcccagcactgagaagatgggcattcctagcagggggcatttaggtgtagacagcctcagtgactcctgggtttaggatcagtgagataat

SEQ ID NO: 460045 - DNA, 1921 bp, Homo sapiens
cacccatctattacttcactgttctgtagatcacaagtccaacttggcatggctgctgcatactttgctcaggatgtccgaggcaaaaggcaaggtataggctggttcaagttcctgtctgaaggctctgggggaatacccaattccaaatccattcaggttgtttgcatgatctggttcctctcagttaaagaactggttccccgctcttcttctgcgtctattaatgtggaggttacattgtgctgtgatgcgttttttatgtctgtttactcccacaagaatagagcttttcaaaagagaagattgtctctgtcctatttgcagtttagtcctcagtgcctagggtgcctggcacatggcaggttctccatcttcccatctgacggcttaaaagtgtggcacttcctacctcactctctctctctctcctgctgcattgtgaagaaactgcttgcttccctctcaccctctgcagtttcctgaggcctccccagccatgcggaacgggtcttgctctgtcacccaggctggagtgcagtgacacaatgctggctcaacctcctgggctcaagagatccttccacctcggcctcctgagtagctgggatcacagaaccttccactggccactctcagcgaaaggcagctgattcagcacctggagaagaccggcaacagggctgagtttccttgcactgcagaggaggggagaggcaaggagtggacatgagcacggaggatccagggcactcccttgatggtgatgccctcgaagggctgccccgtgcccattgtacagaatgtggattccaccccacgccatgagagctctcgcgcaggcccagaccactttataagccatatttcccaccaattcctgtttctggatctgtcaggttatttcatatttctaggcccttagctttgcttcctcttccctgaacgccctttgcccacatcatcccagctctccttctcctcctgccttctgtcttctcttcctctcatttcttgtcacccaggctggagtccagtggcgtgatcacggctcactacagccttgaactcccgggctcaggtgatcctcccacctgagcctcccgagtagctgggactacagatgcacaccaccatgccagctaatttttaaaactgtttttagggatggggtcatcttcctgtgttgcccaggcttgtctcaaactcctgggctcaagtgatcctctcacctcagccttccaaagtgctgggattacaggcatgagccacaacatccagccccttttctcttttcttacccttctttcctattttcttttccattttctttccctcccttcttctttctttcctaactattaaggagtagattgaattcaaggtctttatgtgtgtcagtttttgttttccaacaaatatttcttaaaaaccaaccattgaaacgtaatggtaaccactggcccctgtctccacctccacacctaagaagccccaaatccagatgtgtccattaaaatcagtccagatcttctttaccaagtgccaatgccagcctgcacagtgcagaaagtgaatagacagtgaatgtgttcgtctaattggggtttacagtaaacaccaataaaactgtagacaactgaaaaccccaaatctaccctatccggcactcacaccagaaccacactcaagtcaataccggaggacacagattagcccgaggagcacacgcaggaccgtcggaggctcaaagcctggccgacatagcgaacgaacacgggctcaactcacaaccccagacattacttgcatgagcgtcgaacatgagggccagataaacgccacggaagtaccccgccaaataaagcagagccagcaaaatacaaacccgaaagaaacgccaggtataaaccggattaag

SEQ ID NO: 460046 - DNA, 1718 bp, Homo sapiens
tcttctcttcctctcatttctttgtcacccaggctggagtccagtggcgtgatcacggctcactacagccgtggaactcccggctcaggtgatcctcccacctgagcctcccgagtagctgggactacagatgcacaccaccattgccagctaatttttaaaactgtttttagggatggggtcatcttcctgtgttgcccaggcttgtctcatcttcctgtgttgcccaggcttgtctcaaactcctgggctcaagtgatcctctcacctcagcactttgggaggctaaggagggaggattgcttgagcctgcttccatatcgtaaactgccttggaaccaattaccactaccagggagacaaactattgcttagaggatgctgacaggagcagcatgccaaaattggaagaaaaccttccactggccactctcagcgaaaggcagctgattcagcacctggagaagaccggcaacagggctgagtttccttgcactgcagaggaggggagaggcaaggagtggacatgagcacggaggatccagggcactcccttgatggtgatgccctcgaagggctgccccgtgcccattgtacagaatgtggattccaccccacgccatgagagctctcgcgcaggcccagaccactttataagccatatttcccaccaattcctgtttctggatctgtcaggttatttcatatttctaggcccttagctttgcttcctcttccctgaacgccctttgcccacatcatcccagctctccttctcctcctgccttctgtcttctcttcctctcatttcttgtcacccaggctggagtccagtggcgtgatcacggctcactacagccttgaactcccgggctcaggtgatcctcccacctgagcctcccgagtagctgggactacagatgcacaccaccatgccagctaatttttaaaactgtttttagggatggggtcatcttcctgtgttgcccaggcttgtctcaaactcctgggctcaagtgatcctctcacctcagccttccaaagtgctgggattacaggcatgagccacaacatccagccccttttctcttttcttacccttctttcctattttcttttccattttctttccctcccttcttctttctttcctaactattaaggagtagattgaattcaaggtctttatgtgtgtcagtttttgttttccaacaaatatttcttaaaaaccaaccattgaaacgtaatggtaaccactggcccctgtctccacctccacacctaagaagccccaaatccagatgtgtccattaaaatcagtccagatcttctttaccaagtgccaatgccagcctgcacagtgcagaaagtgaatagacagtgaatgtgttcgtctaattggggtttacagtaaacaccaataaaactgtagacaactgaaaaccccaaatctaccctatccggcactcacaccagaaccacactcaagtcaataccggaggacacagattagcccgaggagcacacgcaggaccgtcggaggctcaaagcctggccgacatagcgaacgaacacgggctcaactcacaaccccagacattacttgcatgagcgtcgaacatgagggccagataaacgccacggaagtaccccgccaaataaagcagagccagcaaaatacaaacccgaaagaaacgccaggtataaaccggattaag

SEQ ID NO: 460047 - DNA, 1219 bp, Homo sapiens
cacccatctattacttcactgttctgtagatcacaagtccaacttggcatggctgctgcatactttgctcaggatgtccgaggcaaaaggcaaggtataggctggttcaagttcctgtctgaaggctctgggggaatacccaattccaaatccattcaggttgtttgcatgatctggttcctctcagttaaagaactggttccccgctcttcttctgcgtctattaatgtggaggttacattgtgctgtgatgcgttttttatgtctgtttactcccacaagaatagagcttttcaaaagagaagattgtctctgtcctatttgcagtttagtcctcagtgcctagggtgcctggcacatggcaggttctccatcttcccatctgacggcttaaaagtgtggcacttcctacctcactctctctctctctcctgctgcattgtgaagaaactgcttgcttccctctcaccctctgcagtttcctgaggcctccccagccatgcggaacgaatcaagcccaagttttccctatggatgatgcaaattcaactactgactgaccactaggaacccaatccaacaacctggtcagttccctcggcgcaggcccagcgcctcccaggcccaccttcctcacttccgtcaagcctcatggcagcatctgcccacagaggaaagagacaaaaccattaccaataaaattgtgaagttttccaaaaaaaaaaacacaaacaacaacacacacacacaacactgtttcgccccccctgcgcccccccacaaccctttctccccccatcccttggcgcccgcgggcccccacacgcccaccgccaaccacgtgcgcacaagacgtgtaccccacacagaaacacccgggccacgcaaacagcgcggcgcggaacccctcacccaataaacaaacgccccgcggggacacacacgcaacgcgttctatgaaacaaatcccacaactggccatcccgacggacaaaactaccggcgaaagccattcatcaccgacgagggcaatctccacagggagaagtcctgccaaattctccaaaatataagcccccccctacccctgtggaagacaccacaccctcaacgcgtcacagaaaccacactcaccgaccccacaacagccgccacccacgacggaaaacgaaacaagacacacaacacaaccacaccacacaaccacagataaccacga

SEQ ID NO: 460048 - DNA, 315 bp, Homo sapiens
ccattttctttccctcccttcttctttctttcctaactattaaggagtagattgaattcaaggtctttatgtgtgtcagtttttgttttccaacaaatatttcttaaaaaccaaccattgaaacgtaatggtaaccactggcccctgtctccacctccacacctaagaagccccaaatccagatgtgtccattaaaatcagtccagatcttctttaccaagccactagatgtcatattaatttcacagcagaatagggaagcccatgccggagctgaaaacctgcaacaacaaaaaagcatctaaatactgcaaa

SEQ ID NO: 460049 - DNA, 2577 bp, Homo sapiens
cacccatctattacttcactgttctgtagatcacaagtccaacttggcatggctgctgcatactttgctcaggatgtccgaggcaaaaggcaaggtataggctggttcaagttcctgtctgaaggctctgggggaatacccaattccaaatccattcaggttgtttgcatgatctggttcctctcagttaaagaactggttccccgctcttcttctgcgtctattaatgtggaggttacattgtgctgtgatgcgttttttatgtctgtttactcccacaagaatagagcttttcaaaagagaagattgtctctgtcctatttgcagtttagtcctcagtgcctagggtgcctggcacatggcaggttctccatcttcccatctgacggcttaaaagtgtggcacttcctacctcactctctctctctctcctgctgcattgtgaagaaactgcttgcttccctctcaccctctgcagtttcctgaggcctccccagccatgcggaacggccagatgcagtgcctcatgcctgtaatcccagcactttgggaggctaaggagggaggattgcttgagcctgcttccatatcgtaaactgccttggaaccaattaccactaccagggagacaaactattgcttagaggatgctgacaggagcagcatgccaaaattggaagaaggagaaagtttaagctctcctcactatgagttttcaagtataaaagactttttcttccacgattttgagaacaactgaggactcttgtgaccaggacaacagggaagcttgcagcaagatagctccaggttggattcatgcttcgcaccccaagggctgccagccagagaggaggagaagcaatcactcctgcagtttctgaacactacacagacgccaggtagcttcttcaggagaacagccctctgaggaggcaggaagaggaggcttatctttcagcagccggagctgctgagatctctgggcagattaagctctctctaatggatgggctccagcctggcacattcagtggagagggatccactcatccatcatcaacataatatggtcctccctgcacttcacagtgtcctcttgctattgaaaaggcttttttgccttctcaagtttctttgtcaacagtctacaggaagaagctcaggccgccaccggcagaggtgaatgcaagctcacgttttatttctgactgcttaatcattgcctcgatcactgctcaagctctgcctttgtttccaaaggttacctgtgggaaaacttctttttctatgctgaaattaatagggaggcaaagatgagtccactgataagcagagccttaaaactcacatagagaaacaactttgctggagtgtgtgtgagtgaaccactaaggaatcagatagtgtgatggcagttatcattgcaggttaagacatttctacaaatatttcgacatctccatatactcactcctttcccccctgagtggagagactcagctaccaagagaggaagctcaaaaaaaacagaagcttcaaacaaacaaccaaccaaaaaaaaaaaaaaactgtgggttcatcagaggtggtagggaagacaaaaacatgggaggagcagctgggcacggtggctcaagcctgtaatcccagcactttgcgaggctgaggtgggtggatcacctgaggtcaggagttcgagaccagcctggccaacatggtgaaaccccatctctactaaaaatacaaaaaattagccgggcgttgtggtacgcacctgtaatcccagctactccggaggctgaggcagcagaatcgcttgaacccaggaggcagaggttgcaacgagccaagatcgcaccattgcactccagcctgggcaacaagagcgaaactccatctaaaaaaaacaaacaagcaaacaaacaaaaaacacgggaggagcaataaaaaggaatccatgctttgatttttttttttagtgagaggaagggaaggctgctgcctctcacttctccctgttttgttgttcttttaagtagcatgtgtcactctgtatatatcctgtccatgtgttttcttttattattatttgtccacttgcctagaatgaaaactccatgggagcatggctatagtgtcttgttcactcctgcctctccagggcctgaaacagaagtaggtagacagagcctgaaacaaaagtaggcagtccataaactttgctgaaggaatgagtgaatgaatgaagaccccaaggatggacctcaggaaggtgagcctgggcaaaggttttcagtcctagtccatcatgaccacatagctggaatacacttatttcactttgtcacatgaattagagattcatttggggaaacaagcaactgttagagttgcagacatctctgaggggtaaatggctgttcaaatcttgcatcttaccctgatcctcactctatctgctttccaaaaacatggagctaagatcccagcactgagaagatgggcattcctagcagggggcatttaggtgtagacagcctcagtgactcctgggtttaggatcagtgagataat

SEQ ID NO: 460050 - DNA, 2404 bp, Homo sapiens
cacccatctattacttcactgttctgtagatcacaagtccaacttggcatggctgctgcatactttgctcaggatgtccgaggcaaaaggcaaggtataggctggttcaagttcctgtctgaaggctctgggggaatacccaattccaaatccattcaggttgtttgcatgatctggttcctctcagttaaagaactggttccccgctcttcttctgcgtctattaatgtggaggttacattgtgctgtgatgcgttttttatgtctgtttactcccacaagaatagagcttttcaaaagagaagattgtctctgtcctatttgcagtttagtcctcagtgcctagggtgcctggcacatggcaggttctccatcttcccatctgacggcttaaaagtgtggcacttcctacctcactctctctctctctcctgctgcattgtgaagaaactgcttgcttccctctcaccctctgcagtttcctgaggcctccccagccatgcggaacgggagaaagtttaagctctcctcactatgagttttcaagtataaaagactttttcttccacgattttgagaacaactgaggactcttgtgaccaggacaacagggaagcttgcagcaagatagctccaggttggattcatgcttcgcaccccaagggctgccagccagagaggaggagaagcaatcactcctgcagtttctgaacactacacagacgccaggtagcttcttcaggagaacagccctctgaggaggcaggaagaggaggcttatctttcagcagccggagctgctgagatctctgggcagattaagctctctctaatggatgggctccagcctggcacattcagtggagagggatccactcatccatcatcaacataatatggtcctccctgcacttcacagtgtcctcttgctattgaaaaggcttttttgccttctcaagtttctttgtcaacagtctacaggaagaagctcaggccgccaccggcagaggtgaatgcaagctcacgttttatttctgactgcttaatcattgcctcgatcactgctcaagctctgcctttgtttccaaaggttacctgtgggaaaacttctttttctatgctgaaattaatagggaggcaaagatgagtccactgataagcagagccttaaaactcacatagagaaacaactttgctggagtgtgtgtgagtgaaccactaaggaatcagatagtgtgatggcagttatcattgcaggttaagacatttctacaaatatttcgacatctccatatactcactcctttcccccctgagtggagagactcagctaccaagagaggaagctcaaaaaaaacagaagcttcaaacaaacaaccaaccaaaaaaaaaaaaaaactgtgggttcatcagaggtggtagggaagacaaaaacatgggaggagcagctgggcacggtggctcaagcctgtaatcccagcactttgcgaggctgaggtgggtggatcacctgaggtcaggagttcgagaccagcctggccaacatggtgaaaccccatctctactaaaaatacaaaaaattagccgggcgttgtggtacgcacctgtaatcccagctactccggaggctgaggcagcagaatcgcttgaacccaggaggcagaggttgcaacgagccaagatcgcaccattgcactccagcctgggcaacaagagcgaaactccatctaaaaaaaacaaacaagcaaacaaacaaaaaacacgggaggagcaataaaaaggaatccatgctttgatttttttttttagtgagaggaagggaaggctgctgcctctcacttctccctgttttgttgttcttttaagtagcatgtgtcactctgtatatatcctgtccatgtgttttcttttattattatttgtccacttgcctagaatgaaaactccatgggagcatggctatagtgtcttgttcactcctgcctctccagggcctgaaacagaagtaggtagacagagcctgaaacaaaagtaggcagtccataaactttgctgaaggaatgagtgaatgaatgaagaccccaaggatggacctcaggaaggtgagcctgggcaaaggttttcagtcctagtccatcatgaccacatagctggaatacacttatttcactttgtcacatgaattagagattcatttggggaaacaagcaactgttagagttgcagacatctctgaggggtaaatggctgttcaaatcttgcatcttaccctgatcctcactctatctgctttccaaaaacatggagctaagatcccagcactgagaagatgggcattcctagcagggggcatttaggtgtagacagcctcagtgactcctgggtttaggatcagtgagataat

SEQ ID NO: 460051 - DNA, 1882 bp, Homo sapiens
cacccatctattacttcactgttctgtagatcacaagtccaacttggcatggctgctgcatactttgctcaggatgtccgaggcaaaaggcaaggtataggctggttcaagttcctgtctgaaggctctgggggaatacccaattccaaatccattcaggttgtttgcatgatctggttcctctcagttaaagaactggttccccgctcttcttctgcgtctattaatgtggaggttacattgtgctgtgatgcgttttttatgtctgtttactcccacaagaatagagcttttcaaaagagaagattgtctctgtcctatttgcagtttagtcctcagtgcctagggtgcctggcacatggcaggttctccatcttcccatctgacggcttaaaagtgtggcacttcctacctcactctctctctctctcctgctgcattgtgaagaaactgcttgcttccctctcaccctctgcagtttcctgaggcctccccagccatgcggaacggccagatgcagtgcctcatgcctgtaatcccagcactttgggaggctaaggagggaggattgcttgagaaccttccactggccactctcagcgaaaggcagctgattcagcacctggagaagaccggcaacagggctgagtttccttgcactgcagaggaggggagaggcaaggagtggacatgagcacggaggatccagggcactcccttgatggtgatgccctcgaagggctgccccgtgcccattgtacagaatgtggattccaccccacgccatgagagctctcgcgcaggcccagaccactttataagccatatttcccaccaattcctgtttctggatctgtcaggttatttcatatttctaggcccttagctttgcttcctcttccctgaacgccctttgcccacatcatcccagctctccttctcctcctgccttctgtcttctcttcctctcatttcttgtcacccaggctggagtccagtggcgtgatcacggctcactacagccttgaactcccgggctcaggtgatcctcccacctgagcctcccgagtagctgggactacagatgcacaccaccatgccagctaatttttaaaactgtttttagggatggggtcatcttcctgtgttgcccaggcttgtctcaaactcctgggctcaagtgatcctctcacctcagccttccaaagtgctgggattacaggcatgagccacaacatccagccccttttctcttttcttacccttctttcctattttcttttccattttctttccctcccttcttctttctttcctaactattaaggagtagattgaattcaaggtctttatgtgtgtcagtttttgttttccaacaaatatttcttaaaaaccaaccattgaaacgtaatggtaaccactggcccctgtctccacctccacacctaagaagccccaaatccagatgtgtccattaaaatcagtccagatcttctttaccaagtgccaatgccagcctgcacagtgcagaaagtgaatagacagtgaatgtgttcgtctaattggggtttacagtaaacaccaataaaactgtagacaactgaaaaccccaaatctaccctatccggcactcacaccagaaccacactcaagtcaataccggaggacacagattagcccgaggagcacacgcaggaccgtcggaggctcaaagcctggccgacatagcgaacgaacacgggctcaactcacaaccccagacattacttgcatgagcgtcgaacatgagggccagataaacgccacggaagtaccccgccaaataaagcagagccagcaaaatacaaacccgaaagaaacgccaggtataaaccggattaag

SEQ ID NO: 460052 - DNA, 1065 bp, Homo sapiens
cacccatctattacttcactgttctgtagatcacaagtccaacttggcatggctgctgcatactttgctcaggatgtccgaggcaaaaggcaaggtataggctggttcaagttcctgtctgaaggctctgggggaatacccaattccaaatccattcaggttgtttgcatgatctggttcctctcagttaaagaactggttccccgctcttcttctgcgtctattaatgtggaggttacattgtgctgtgatgcgttttttatgtctgtttactcccacaagaatagagcttttcaaaagagaagattgtctctgtcctatttgcagtttagtcctcagtgcctagggtgcctggcacatggcaggttctccatcttcccatctgacggcttaaaagtgtggcacttcctacctcactctctctctctctcctgctgcattgtgaagaaactgcttgcttccctctcaccctctgcagtttcctgaggcctccccagccatgcggaacggccagatgcagtgcctcatgcctgtaatcccagcactttgggaggctaaggagggaggattgcttgagcctgcttccatatcgtaaactgccttggaaccaattaccactaccagggagacaaactattgcttagaggatgctgacaggagcagcatgccaaaattggaagaatggactggagccgggagtgaatggctggctgcatagttactgtggaaaccaaagatctgaaggggccctgtcaccctttggacaaacaccggcagactggcgtgcatgtctcccagggaccagggacattactgcgagtgatgtgccaatctgcagtagggtgatcacattctagggataaaactaaatttaaaaaatatttacattggcaacttgtcattttggaaagggctcaagatccagagtcagaaacctctgtaataaatgaggagccttctgtttccaagatggagaagggatggggagaacggtaatacccactttgcaggaatggcagagggatgacatgaacatactctgacatgaagctagtgctcaagaat

SEQ ID NO: 460053 - DNA, 978 bp, Homo sapiens
gtgaaaaccctgccggctggagaaagacaagagccggggatcaaagtcacgtagtctgacttcaaagcttctcaccactatgccatggtaaaggaaggaagaaatggaggaccaaagacagcagcagatggcctggagggcacaacagcaatgccagaagttaaggcagcaaggatggccatgtccatacggaggaaacacgggcacagcgaagcctgcgccgacccgattctaagggaactgcctgcctcttccaagcattccatcaatgctgtggggagagtgaagcaaactgtcctaaccagatactctggagccatctttggcttctctagcaacctagctgggacacgcaagaccaacccagatgaagtaggaatgaaagaaaaaaacttaggtgcaacacaagttccagaaagaacgaagtcagctggttctaaaataattgaggaaggcttcagggaagagatgagagagaaggataagcagagttttgaaagacaagcagagggatgtcatgagactggaaaacagcaggcacagggcgaagaggaggcgcggcagagcccaagggaagaccaagcccagggaggagaccccacctccggttctgccgggacaggaagtgagggtgaagctactgctctctggatggctgcttccagatggatgatttaaacactcttctgcatctcccagcagcagggttcttcctggctctctttctcccacctaacatctgtcccctgcaactagagcaaggagatttaataaggagaatattcccaagtcatcagactccaagaacataccaggcactgggtaaagcttcaggcagagttcttaactagggatccatgtataggggtcaggggactgtgtacctcctcccaaaatagtatgcaaaatatacaggagacgagcaaacttctggggaaagtgtaaccgtttcttcaccagattccttttttcttttct

SEQ ID NO: 460054 - DNA, 359 bp, Homo sapiens
  misc_feature (11)..(11): n is a, c, g, or t
tttttcccccnaaccaaattttatctacgagactgaagttgaaagattaagaatgaaaacatttcctgctcttgttcaaatgtaaaaacgctggcaggaaaacacaaggccaaatcaatcatttaaaaaatcatttcatttgggtaaaatgatttccttttctttcttactgggaaattgaagtagcatgtcctctgagttgcatgttttagataaaaaattgtttaattttagccttaattgtatacaaatttttgtcctgcatgaataaatgtgtaaaataccatgaattgctgtttttattcaagaataaacaagacttgaagtcagaaagtattcaagatctattttactcattt

SEQ ID NO: 460055 - DNA, 546 bp, Homo sapiens
cctcataggttcgcaggaggtcgagagagtgttcctgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaaggtaaattctccctacccccctacatagttttaattttattcattaatgtattcattcatttaaccagtatttaataagaagcctctgtgatatcaagcatattctaagccaggagtgtttcaaaatatatctgtgagttatttttcttccaacagtttacatttgcagcctcca

SEQ ID NO: 460056 - DNA, 1296 bp, Homo sapiens
taatgatcaagccctgaaagtttgaggccaatccttaaaaaggctgtggtttagtttcccagctgatgattgtagaggttgtgggtcagaattctgttgttacatatgaagctgttcggaaatctagagaagacctggatgtgtgcaaggagcactatgacaacttactggcagaagacaaagtaaagcagaaagcagctgacttattggaaatggcaactttcctccagaagagagttgaggaggaagagaaggtgcaacaggagattgagagagtgttccatgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaagtacctaaatgaaccaaactatgaggctctgattagtattcagattggaataatggaacaaaccattgctgttttagataagatgcacaaaaagaatgtggaaaactgcaagaaactactcaaaaaacttggaaagttcagcaatcaaaaagatatagcaaattatgccctaagctgcaatctacgagaagagttggtagctgtctcagagagaaaagacatctgtaatgcaatggggtctaaactgacttgtgaaaagattgtcaaagaacggtatgaaaacatgatgcaacagcagaagttaacaaatatttcaaaacaacaagctgaacagatttcaatactacagactgaagttgaaagattaagaatgaaaacatttcctgctcttgttcaaatgtaaaaacgctggcaggaaaacacaaggccaaatcaatcatttaaaaaatcatttcatttgggtaaaatgatttccttttctttcttactgggaaattgaagtagcatgtcctctgagttgcatgttttagataaaaaattgtttaattttagccttaattgtatacaaatttttgtcctgcatgaataaatgtgtaaaataccatgaattgctgtttttattcaagaataaacaagacttgaagtcagaaagtattcaagatctattttactcattt

SEQ ID NO: 460057 - DNA, 797 bp, Homo sapiens
aatcaattggccttgcaaaagtaggcatgaggagggaatgaacccaagggaaacttaaagaaggaggcagactgctgctgaaagcactgtgatgtgtcccaaagccaacgggcagttggttttcgatgatccaaggttagtccggacagagtccgttccgtgtgacatcaacaaccctctacggaagccacctcgctattcagacctgcacatcagtcagacgctccccaaaaccaacaaaatcaacaaggaccacatccctgtcccttaccagccagactccagcagcaacccctcctccacgacgtcctccacgccctcctcgccagcaccccccctccctcctagtgccacgccgccttctcccctacacccttccccacagtgcacacggcagcagaagaacttcaacctgccaggtacctccatgcttggggagacatgaggggtgcagcgttggaggggcagagattagggagggggtgggttcatgccagagccctgatgcagcaagtctctgcaggaaagcgaatgggtcaatgaccagagaggggcaaggaagtatgtggactgacccttatcgtaccctaagcaattacccttatatcacttatttaatctttggaacagccacaaggtaagcattatcagctcattttacagatgaagaaacagaggctcaaagaggtgcaggaactcttagagactctgtcttttggcgagctacaacccagggtcttcgcctaagtctaagtcacagaagggagccattggctctggagatgacagttgtctta

SEQ ID NO: 460058 - DNA, 2536 bp, Homo sapiens
aaactttggaaaaaatggactctctggaatggaaccaagaacaggctctcagtgcatcaataggaaggtcgtgtactccctggcagactcagctggtggggtcttctccattgacagctcatctggcatcatcatcctggagcagccactggaccgtgagcagcagtcttcgtacaacatcagcgtgcgggccactgaccagagtcctggacagtccctgtcctctctcactactgtcaccatcaccgttctggacattaatgacaacccccctgtgtttgagaggagggactacctggtgacggtgcctgaggacacctcccctggcacccaagtccttgctgtttttgccaccagcaaagatattggcacaaatgctgagatcacttatctcatccggtctgggaacgaacaagggaaatttaagatcaaccccaagacagggggtatttctgtctctgaagtcctggactatgaattatgcaaaaggttttacctggtagtggaagccaaagatgggggcaccccagctctcagcgctgtggccactgtcaacatcaacctcacagatgttaatgacaaccctcccaagttcagccaagacgtctacagtgcggttatcagtgaagacgccttggtgggagactctgtcattttgctaatagcagaagatgtagacagccagcccaacggacagattcatttttccattgtgaatggagatcgggacaatgaatttactgtagatcctgtcttgggacttgtgaaagttaagaagaaattggaccgggaacgggccgtagacagtggcattcctgcaatgtcatcaactgcaactgtcaacattgatatttctgatgtgaatgacaacagcccggtgtttacacctgccaactatactgctgtgattcaggtactgagcgtcctctacttctcagtatttctaggagctgaaagcccaactttaggaggatcaggaaatctagcccaggaaaactgtcagtgtagaggacttagagaagacagagtgatatgcatgacttggagggccacaggtggttgtgggaagcagccaaagataaggaacatgacacttacagacaccaacatgttttcagaagacaaggaaaataagccagtgggcaccagcatcttgcagctggtggtgacagacagagactcctttcacaatgggcctcccttttcattctctattttgtcgggaaatgaagaggaggagtttgtgttggaccctcatgggatcttgcggtcggctgtggtcttccagcacacagagtctctggaatacgtgttgtgtgtccaggcaaaggattcaggcaaaccccagcaagtttctcacacttacatccgcgtgcgagtcattgaggaaagcacccacaagcccacagccattcccctggaaattttcattgtcaccatggaggatgactttcctggtggggtcattgggaagattcatgccacagatcaagacatgtatgatgtgctcacatttgccctgaaatcggagcagaaaagcttatttaaagtgaacagtcacgatgggaaaatcatcgccctgggaggcctggacagcggcaagtatgtcctgaatgtgtctgtgagtgatggtcgcttccaggtacccattgatgtggtcgtgcatgtggagcagttggtgcatgagatgctgcagaacactgtcaccatccgctttgaaaatgtgtcccctgaggacttcgtggggctgcacatgcatgggttccggcgcaccctgcggaatgcagtcctcacccagaagcaggacagcctgcgcatcatcagcatccagcccgtggcaggcaccaaccaactggacatgctgtttgcggtggagatgcacagcagcgagttctacaagccagcctacctgatccagaagctgtccaatgctagaagacacctggagaatatcatgcgcatctcagccatcttggagaagaactgctcagggctggactgtcaggaacagcattgtgagcaaggcttgtcactcgattcccacgcgctcatgacctacagcacggctcgcatcagctttgtgtgtccgcgtttctacaggaacgtgcgttgcacctgcaatgtcaaagccatagctgcacagagtcacatgcccgtagtgatcgatgagaagcattgccctctctctcttttcctccgtctgacatgtggagccataaattcactgcccccttctaagaaaattgcagccagagtttttctagccagtgtgaatttggtccaaagggaccatggccagagggaggccatttgtaaaacatcctttagtgttcagtacagtagcatgctgtacaagcctgtagcctaggagccataggctgtaccatatagcctgggtgcatagtaggctgtgctatctaggtttgtgtaagcgcactctatgatgtttgcacaatgacgaaatagcccaacgatgcatttcacagaatatatccccattattaagcaattcatgaccgtaatgtgattttcctag

SEQ ID NO: 460059 - DNA, 2839 bp, Homo sapiens
tcagagctaatgctcagaatttcagtcttcagagttcttgggtcagacctttactatgaaaaggtatagtttggcagtggggcctccaaaaaaagacccaaaagttaaaggtgtccaatcagcagctgtacaagcttttcttaaaaggaaagaagaggagctgagacgaaaagccttagaggagaaaaggagaaaagaggaactagtgaaaaagcgaattgagctcaaacatgacaagaaagcaagagctatggccaagaggacaaaggataatttccatggttacaatgggattcctattgaggaaaagtcaaagaagaggcaggcaacagaaagccataccagccaaggaaccgaccgagagtatgaaatggaagaagagaatgaattcctcgagtacaatcacgcagagtcagagcaggagtatgaggaagagcaagaacctcccaaagttgaaagcaaaccaaaggtcccccttaaaagtgccccaccacccatgaacttcactgatttactcaggctggctgagaaaaagcagtttgaaccagtggaaatcaaggtagtgaagaaatcagaagagcgacctatgaccgcagaagaacttagggagcgagaattccttgaacgaaagcataggagaaaaaaacttgagacagatggaaaactacctccaactgtgtccaaaaaggcaccctctcagaaagaaagtgtgggcacaaaacttagcaaaggttctggagacaggcatccttcttccaaaggaatgccccttcctcatgctgagaagaaatcaagacccagcatggccaatgagaaacacctcgctttgtcttcatccaaatccatgccaggagagaggatcaaggcaggatctggcaatagctcccaaccctcacttcgtgagggccacgacaaacctgtttttaatggagctggaaagcctcattccagcacctcttcaccaagtgtcccaaagacttctgctagcaggactcagaaatctgctgttgagcacaaagccaaaaaatctctgtcccatcctagccattccaggcctgggcccatggtcaccccacacaataaggctaagagtccaggtgtcaggcagccaggcagcagctctagctcagcccctgggcagcccagcacaggggttgctcgacccacagttagttctggccctgtgcctaggcgccagaatggcagctccagctcaggacctgagcgatcaatcagtgggtccaagaagccaaccaatgactcaaatccctctaggcggacagtcagtggtacatgtggccctggacaacctgcaagcagctcaggtggccctgggcgacccatcagtggttcagttagttctgcaagacccttggccagctctcgtggccctggcgggcctgtgagcagtccacatgaacttcgacgaccagtgagtggcttgggccccccggggcggtctgtcagtggccctgggagatccataagtggctcaattccagctggacggactgtcagtaattcagtcccaggaagaccagtgagcagcttgggacctgggcaaacagttagtagctcaggtcccactataaagcctaagtgcactgttgtctccgaaacaatttcttccaagaatatcattagccggtccagcaatggacagatgaatggaatgaagcctcccctatctggctacagagctgcccaaggtcctcaaaggcttcccttccctactggttacaaaaggcagcgagaatatgaagaggaagatgacgatgatgatgaatacgactctgaaatggaagattttattgaagatgaaggagagcctcaggaagaaatatccaagcacattagagaaatctttggttatgaccgaaaaaaatacaaagatgaaagtgattatgccttacgttacatggaaagtagttggaaagagcagcagaaggaagaagcaaagagcttaagactgggtatgcaagaggacttagaggaaatgagacgtgaagaagaagaaatgcaacgtcgaagggccaagaagctgaagaggcgttagctgctgcttttatttttgtgaaattctagagctgctctgctgcaaggatttcctgccttcagactgaagaagcccccttatcattttagatttatacttgggtactcaaggagaaggaatgcatactgtcatttgcaggctgtcatttgagcataaaatattttcagatattttccagggtgaaatctgtaatgcagatgatataatgcccacttgtgctcttatgaagttaactgttcacagatgccagccttgatcctgatgagctatgcactctaatgtggggccactcaccagtcagccaatcttttattgttcctttgctactttgaaaggaaaaaaaaggttgtctcttgatttctgtaattcttctgctgatctgtgagtagggcactgccctgctcccaatcaaacttagtctttttatgagaaacctggaccttccatgaatgttgccagcaataaagtgacttgtcctaatctatggattgagaacttgaaaatgtagagtagaatttataactatcatatggatgtcatcctgtgactttgaagtacaaagtagaataaattctgtattcatggattggatgctgagcattcttactcattaatttaggtggctaggaattaatgaaaaaattttcaagttaaaatacaggttataacagtataatattcttttctaagttttcctttcagatttactgttatgttggctttagtgtaagacaaggtcactgtgctgattgatttttatctaaaaaaattcatttttatatc

SEQ ID NO: 460060 - DNA, 1082 bp, Homo sapiens
aaccagactcaagtcccagcagacccctaaagaaaacatcattttattctctgttttcatgcgttcagttttttcgcacttcatgtataggacccttctctattcattcaatatctgcactttcgggctactcagtggaacatcttttcaataccaagatcaaatgaaatatttttccttacacctcatcaattatataaatcattgtttctttttatcttctttttttcttaatgctgctggtttttctcacatgtctaatcgtcttcgggtttgtctcttcctatttaagaatgaaggatggggatctggtataggcatctcctctgatatactggtgtccagtactgatgtccagataggctattccaccaagcggaaattctgcatgcttgttgtctgcctatcctgttacaacatcacctccacaaggacagggaatttgcctgtgttgttcactgttatacccactccacttcctaggaaatgcctagaaatagaaggaactcagtaaatacttcctggaacagaaaccccaatcgttcatgaattctcagagcatccctttctgtgataatagagtggagaaaaacttcctgtgggtctgcaatcctatccccgcacagaaaggctgtcaccatttgaccaaaagggaggaccaggacagaaggaccataagtcaatggttttctttagtgtgctgccagcagaatcagaatcacctggaagctggggacatggatggacttggaagccattatcctcaggaaactcatgcaagaacagaaaaccaaccactgcatgttctcacttataagtgggagctgaatgatgagaacatatggatgcatcagggggaacaagacacactggggcctgttggggcatgggaggaggaagagcatcaggaataatagctaatggattctgcgcttaaaacctaggtgatgggttgatctatgcagcaaaccaccagggcacacattcacctatgtaacaaacctgtacagcctgcacaggtacccctgaacttaaaattaaagttgaagtaaaaataaaaagaaaaagtctgtgaacccttt

SEQ ID NO: 460061 - DNA, 1726 bp, Homo sapiens
tcctgctgcagatcaaaaatattcgacttggtgcttttgaaaaatgcagactccacttagctgtcctgcctctcccgtcttccctgggtcctgtctcctcttgtggggacacatggctgtctccaagctcaccctggcagacccagatgggcctggctgtggtagccttctttgattttccccaggcccctgagcagccccatctccttcgagggtcccacctggtttggctccagggacacggacagcgcagaggacagaggctgctcagcatgggagtggtccccctggcattgccttctgcgggcctcccggtggaggaggcatggctggccagtgagacaaacagcctttcttctgctccatgcaagccttgcggctggaaatttgtctccacctccacacaggtgctggcggcctgggtcctgccttggcgagagtcctgctgggcttccatggtattccgaggagcatctctgggctgtgaggagcctggcttgggcaaaagcagcagaggctgggatgagagtgagcagagtttcagggaagccacccagggcagtgctgcctacacagacagaagggctcctggtcacccatgactccggcttaccctccagcttcctgggcatcactttctgataccatgtgcaaaattttgcgttgaatttaagcaaattaggcttaatgtggatcaataaccatttccaagttcattaacgagttcccaggccctgttttatggacctttattgtttaaaggaatcctgactgcctctctatgaggggtccggaaatatgcatgcttttaacagtatgacccaaatgtgcacatttattagcgtttagctgtggactagtgctgagatgtgtttttagacagagtttcttcatcacttaaaaaaaaacctggcattggaaaaggagagcgtggagctccagccctatccttcagcttctgtctttggaaaacttagtctaaatcaaccaaagacaagctgactgcaaattactctgagctgcagtgaggtaagccatgaagtacattacaaaggtaatgtgtgtttaagaaggaactactgcagaatgtatattttcattatcaaaaacgttaagccatttatcctgaggagtcagaataatcattaatggctgggaatttatggtgccagatcttaaactaatgtgaatgattccaggtgttactaatggcttcagtgaaatgtgccagtatctaagacttctactaaatctgagataattctttgaggtagcggcatgaacagcatgggagcaagtggctatgtggaagatgtcaagccagacctgtaatgatcgccacggcgctggattgacggttgccctctcttgtctggcgctgcgtggaaagcgggtgaaggcagagaagcctgcctgctgacccatcgctctgccccatcaggagttcaatttacttcccctgacacgcagcgatgaggcggtatgggttgcatttgattggtccatgtaggttaaataaaaattggtttaatgaatatttcaaaatgccttgtctggatcagatattttaattaagggacatgcattccgcatgtgtgcggggccccctctcctccagtgtctttcatgggtgtctatagggtcttcggcttcagtggaagacaggaatgtaaaatggccaggtgtcaatgtttgtgtgggttctgaaaagctgtgatctttgtac

SEQ ID NO: 460062 - DNA, 695 bp, Homo sapiens
tcatcataatacagagggacctgttcaatgatcaatgtctcgaataagtactgtggtggcacagatgacagactccactggcagggagaagggatcagagaaggctttggaagacagcaacctctgtacagacgaccaggccagatccacatggccccgtttggtgcttggatgtctggtaaactgcctgccaaggaggaacgcagtgataaagaacaaggacttcagaatcaggtaaatctgggtgtaaatttcagtcctacaactttctacctgtggactgaccatccatccaaccattcactcatcagtaaatgtcgatatagcacctatgctgtgccagatgctgtgacggcgagcctctttgaaaaggaggaagagctcgcaaagggtgacggcagagagatgcccagaatcttgcaggaggaaggagaatgcagcctaacttgctggaaggattcaggagacgtgtgagtaagagccaagatttcccagatcagcctacagccaagataagcacagctttctacccaacctgcacctcaccacagagaatggaagaatcactcagccatcctgtatattgtagcaataatgtatggttattttttctaggcactgagttttgggatgatttgttatgcagcaacagctggctgctacagagattgtgcccaccctcacagccccctgga

SEQ ID NO: 460063 - DNA, 1708 bp, Homo sapiens
atccatcacacccatgcccagtgccacaaaaagcttcagtggtcagggagttgtcttcaggacccaggacccaggacccaggacccaccatccattcttctggccaagggtagcatggatgtgcgtgggcagtctcgaccttcattgcaagttcctgctccagctcctctgcttctgccatctccgtggcactaccacaagcccagggccagaaattttaacaatcacagcattgtttatgatgggagttgtggatcctttggagccaaagactcgaacagacatgcgagacctctaccaactgaaggtttcgccacgaagctccttagtgaggagctgccatgctgggccatccaccatctggattcctacgactcagggaatagaacactgcaccttccagaagcacttgtttcttcgtgggtacaccaccagctgagaaagaagcctcatgatgattgttgtcttatggatgcttctcattgcaggaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattattttgtcatattttatgttaagaagttaccgcactttttttttttttttttttttttttttgagacagagtctcgctgtgtcgcccaggctggagtgcagtggcgcgatctcggctcactgcaagctccgcctcccgggttcatgccattcccctgcctcagcctccagagtagctgggactacaggcgcctgccaccacgcctggctatttttttgtgtttttagtagagacggggtttcaccgtgttatccaggatggtctcgatctcctgacctcatgatctgcccgcctcggcctcccaaagtgctgggattacaggcgtgagccaatgtgcccggcattaccgcattttttaagatgaatgcagactagtattctgttagcttgtaacagagagacagaggttgggaagtagttgagtgatgggagacaattgggtccttctgctacatggtctctaagactggcattaagatacctagttttgcctggcgcgatggctcacacgtgtgatctcagcactttggaggcccaacacaggtggatcatctagggtcaggagttcaagaccagccttgccaacatggtgaaaccccgtctctactaaaaatacaaaaaattagctagggcgtggtgtggtggcacgtctgtagtcccagctactcgggaggcagtggttgcagtgagctgagatcggccactgcactccagcctgggtgacagagtgagactcagtctcaaaagaaaaaaaaaaaagaaccctaagcttataccatgtggggtaagaaactcatttttaatattagggttaaatactgaagtataattatcctaatccttaaaataaccttctgaagctattagcctcatcttacaaaatggcaaaaatgaagttgaggggcatgtttatcttgccaacacacacagccctgggctgcagagtcaagattaagatccaggccttctcccttcacactttcatgtgccaaggaaaagagccaaacaagagactgtgggatatccaagatcttgctgtttaaatgtctccctcacctgaaaacccaagaa

SEQ ID NO: 460064 - DNA, 712 bp, Homo sapiens
caccgaagcgggagcggccaaaatgaagtttaatccctttgtgacttccgaccgaagcaagaatcgcaaaaggcatttcaacgcaccttcccacattcgaaggaagattatgtcttcccttctttccaaagagctgagacagaagtacaacgagcgatccatgcccatccgaaaggacgatgaagttcaggttgtacgaggacactacgaaggtcagcaaattggcaaagtggtccaggtttacaggaagaaatatgttatctacattgaatgggtgcagcgggaaaaggctaatggcacaactgtccacataggcattcactccagcaaggtggttatcactaggctaaaactggacaaagacagcaaaaagatccttgaacggaaagccaaatctcgccaagtaggaaaggaaaagggcaaatacaaggaagaaacaattgagaagatggaggaataatcttatatacaagctttgattaaaacttgaaacaaaggagaaaaaaaagaagagccttatgactagagctccgagagtaaagagttggccaattttaagactgaaattctaagtgtcgtcaactttttacttccattcctgatgtccaactacctgttgagataacaggactttatattcacctttttgttgctgcaagctatttgcctaccttatgactgaaattgcagcttccccttcaaaattacattt

SEQ ID NO: 460065 - DNA, 775 bp, Homo sapiens
caccgaagcgggagcggccaaaatgaagtttaatccctttgtgacttccgaccgaagcaagaatcgcaaaaggcatttcaacgcaccttcccacattcgaaggaagattatgtcttcccttctttccaaagagctgagacagaagtacaacgagcgatccatgcccatccgaaaggacgatgaagttcaggttgtacgaggacactacgaaggtcagcaaattggcaaagtggtccaggtttacaggaagaaatatgttatctacattgaatgggtgcagcgggaaaaggctaatggcacaactgtccacataggcattcactccagcaaggtggttatcactaggctaaaactggacaaagacagcaaaaagatcctcgaacggaaagccaaatctcgccaagtaggaaaggaaaagggcaaatacaaggaagaagatcctgaacggaaagccaaatctcgccaagtaggaaaggaaaagggcaaatacaaggaagaaacaattgagaagatggaggaataatcttatatacaagctttgattaaaacttgaaacaaaggagaaaaaaaagaagagccttatgactagagctccgagagtaaagagttggccaattttaagactgaaattctaagtgtcgtcaactttttacttccattcctgatgtccaactacctgttgagataacaggactttatattcacctttttgttgctgcaagctatttgcctaccttatgactgaaattgcagcttccccttcaaaattacattt

SEQ ID NO: 460066 - DNA, 2341 bp, Homo sapiens
ctcattcattcctcttccaaagacttgctgagcaccttctaggtgccagatgcggtgctggctcctggggacatgggagtgaacaggccaggcgtggccctgaaccatcaaatagacaaccacagaaataacaacaacaaagacaaaaccgggcccttccacacagtagctggaacacaaaggaagatcagccaagcctcaacataatctcataaaaattcttcaaatatcccattgttatggattcatacatcaggaaagcagatgccaagaacctgaacaccttctactggtaacatatattttggcgagccagcctggagacaagaccactatgggcaacttcctgtctattctacctggtgtcactgtggacaacttcctatctattccacccgattcaccgcttggctacatcctccaccattgggatgaatttgaccctaacaatctaaagaaaaggcatatgattttttactgcaatattgtttgacacaattatgagctgcccaatccggaacaatgggcagtcaatgccctgctactctcagagaaatagcaggggctgaggggccaatcctagtgtgggtccccttctctatgattgatatacaacaatgtaaggaaaagctaggaagctattctgaggattccgggaagtttgcagatgggttccaaactttgaccttagcctttgatctctcatggagagacgttcaattcactctagcaacctgttgcacctcctcggaaaaggaacgaatctttgaggctgccctccgagaagtggacgaattattcacccaaaaccgcaagttattaatggcacaacgtttcattagccaatccacaccagacattagacgtaagctccaaaagctacacatggggccacaaactaaccaaaatcagcttcttggtactgccttcatggtgtataacaatcgtgacctggaggaaggagaagggaaacagagtaaagaaaaacggcaagccaaaattatgttagccatcactggtgatgccctaaatgcacaaagattgtccaagggaaactcaaagggccataaggataatgccagcaaaggctcttgcttcaaatgcaataaaagtgcgattgggcacaggaatccactaagcccccgccagtcccctgccgtcaatgtaaaagcaccagttgtggctcctggccctggagaattgactgtccctgctcccaccaaggggctcaaaataaagggacacatctggatgacaggggaaatgttaactaaataccagcccatgctcctagacaatccagatataactcttaaaacctgcaacactttaaatccagcttcattgctgcccacaggcccaataattgatcattcctgtgagcaggtcattgcacatacatatgttagccagcctgatttaaaagatgaggctctcccagattctgaagctgaccggctcacagacggcagtagttctttgtcgaatggggagcacagagctggatatgcagcagtaaatcatgacacaattattgaagcccagccagttgggtcaaaggttaccccagaaaaggctaatgaggttctaaggtcctcttaaaagaaataattccccagtttgggttacctcagggtctccaaagtgataatggctaatcctttatctcccaaataactcaaggggttgctaaggctcttggaataaaatactatttacattcagcctggaggccccaatcctctggaaaagtggaaagggttaaccaaactctaaaataagcactagctaaactatgtcaggaaacatcagaaacttgggttagcttattgctcacagcccttttaagaatttgtaatacccctagctcaaaaattaacagaagcccatataaaatgttatacagaaggccattcttaactaatgatttaattattgacccagaaagagttggtgtaattaaatacctagtcaacccagaacaattccagcgggtttacaagagtttggaattcaaaggctcctcacacttggaactaaccagcaacccaaaatcaggccaggagatagggtacttgttaaaacatggaatgagggatcacctgcccaacaattacaaccccaatagaagggacttttttcagtaatactggccacgtcttctgtggtcaaagtactagtattagatagctggatacatctttcaaggatcaaaccatcaataccagaagctccagaccaggaacctgaagttcccatcagccagtacacctgtgaaccagtggaggacctgaagtacctgtttaaaagatagccaaaagataagtaaatgcctaccaac

SEQ ID NO: 460067 - DNA, 1109 bp, Homo sapiens
gcttgatcagatttgtatattttggaaaataactgatatagtttggatatttgtcccctccaaatctcatgttgaaattccacccccagagtctcagccttgccactgcccaaagactgctgagcccctgtctgtccaccgccaccacccactctggacacagaacatccagtcatggataaaaatgagctggttcagaaggccaaactggccgagcaggctgagcgatatgatgacatggcagcctgcatgaagtctgtaactgagcaaggagctgaattatccaatgaggaaaggaatctcctctcagttgcttataaaaatgttgtaggagcccataggtcatcttggagggtcgtctcaagtattgaacaaaagacggagggagctgagaaaaaacagcagatggctcgcgaatacagagagaaaattgagacggagctaagagatatctgcaatgatgtactgtctcttttggaaaagttcttgatccccagtgcttcacaagcagagagcaaagtcttctatttgaaaatggaaggagattactaccgttacttggctgaggttgccgctggggatgacaagaaagggattgtggatcagtcacaacaagcgtaccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagggacaacctgacactgtggacatcagatacccaagcagacgaaggtgaagcaggagaaggaacacagttgtgacccattttactctgtataagggcagaaatggttcacattccattatttataaagttacctgctgttagcattcattatttttgctacactcattttatttgtatttaaatgttttaggcaacctaagaacaaatgtaaaagtaaagatgcagtaaaaatgaattgcttggtattcactacttcatgtatatcaagca

SEQ ID NO: 460068 - DNA, 2346 bp, Homo sapiens
tacggtgtccttataagcaatgtcgtctacagcgtcctcgttagcatgccttgtgggtgtcattagcgatgtcatatacagcatcctcattggtgatgtcttatatggtgtcctcattagcgatgttgtgtacagcgtcctcgttagcaatgccttgtacagtgtcctcgttagcaatgtcatatacagtgtcctcattagcgatggcttgtacactgtcctcattagcgatgttgtgtacagcatccttgttagcgtgccttgtacggtgtcattagcgatgtcgtatacagccgccctcattggtgatgtcttgtacggtgccgtcattagcgatgttgtgtacagtgtccttgttagcgacggcttgtatggtgtcctcgttagcgatgtcgtatacagcgtcctcattaccgatgccttgtatggtgtcctcattagcgatgtcgtgtacagcgtcctcgttagcgtgccttgtacggtgtcattagtgatgtcatatacggcaccctcattagcgatgtcatatacggagtcctcattagcgatgtcgtgtacagtgtccgccgatgtcatatacaacgtcctcattaccgatgccttgtatggtgtcctcattagcgatgtcgtgtacagcgtcctcgttagcgtgccttgtacggtgtcattagcgatgtcatatacggcaccctcattagcgatgtcgtatacggagtcctcattagcgatgtcgtgtacagtgtccacgttagcgtgccttgtgggtgccattagcaatgtcagtgtcctcgttagcgatgtcatatacaacgtcctcattaccaatgccttgtatggtgtcctcattagcgatgtcgtgtacagcgtcctcgttagcgtgccttgtacggtgtcattagcgatgtcatatatggcatcctcattagcgatgtccgatgccgtgcacggcatcctcgttagcaatgccgtgggcagcgtcctccttggcgatgccgtgggcggcgtcctccttggcgatgccctggacggcgtcctcgttggcgatgccctgggcggcgtcctcgttggcgatgccctgggcggcgtcctcgttggcgatgcccttgtcggcggcctcgttagcgatgccgtggacagcgtcctcgttagtgatatcgtgtgaggcatcctcgttagtgatgttgtgtacggtgtcctcatggggagctagaagaacacagagttaaggttttaaaaaaacacttcccctatacttattcctatcacaatcccaggatcagggtggctcttcacattgaaaccaggcaaggatgccacacctttcttggcatccagattgttttctcggcctccttttctttgtcatgcatgcatattaattgaggatggagaatatctacgcttgttcaggccagccaacatacgacagtttacttcaagacaggagacatgggttgaatgctgaaaacatgcacagccaagcccagatgccagtcttgttagctgccttcctttaccttcaagagtgggctgaagcttgtccaatctttcaaggttgctgaagactgtatgatggaagtcatctgcattgggaaagaaattaatggagagaggagaaaacttgagaatccacactactcaccctgcagggccaagaactctgtctcccatgcattgctgacccatctcagtatttcctgtgaccacctcctttttcaactgaagactttgcacctgaaggggttcccaggtttttcacctcggcccttgtcaggactgatcctctcaactactgaccatttcacctccattcatgtccatgccacatcaggctgtgttgtctagatggcatgaatctaccccaaatgtccctttctggaggaagccaccattatgctgtacctccaagcataatgatacgtccacacacaccaaggcacctcactcatgcaaggtgtgtgtcctctaacaaagtttcacgctctaaacccagataacttttgaaacccaagttctgttgattcccctactttgggtgctccatagatgctcatttgtctactaaacactgccccaggcaattaaatattccaaagtgaccagcagaatttttatgttaattctgacattgcattgttagtacaagtgtttttcccccttcaaatttatgtctttgttactgataaatgtaactgataatgcttttttcagctatgttgccaagcatatttatataaaaatatactcagattgttttcagaatttgacaaagatgatagcaacaacgataatctcatttgtcttatactaatctttatgtgttactttcatcatttcttacatatt

SEQ ID NO: 460069 - DNA, 1879 bp, Homo sapiens
cagccggtcgctggctccgccggccgccggctcccagacgcaagcggagggcggaggggaggggcaggcggcgcccgggagggaggcaccgggccgcgggccaagcctaccgggggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacaggtgagctctgcttcccttggcgtctcctgtggtcccatcactgctgcctttgtattgctttcgcatcagcccattgatgagttggctcacatgatcatcaatgggcctggtaaccatcaaggatgtgtcactgtgcttctctcaggaggagtggcggagcctggacccctctcagacagacttttatggagaatatgtcatgcaggaaaactgtgggatagtagtctctctgagatttccaattcccaaactggacatgctttctcaactagaaggaggagaagaacaatgggtccctgacccccaggacttagaggagagggacattctgagggtcacatatacaggtaagaacctagaataggctttcagccacttccttcacagttcgggacatcatcattccatgttcgtttaatccctcctctgcctcagagagttccagagacaaaaggtttagagatttttttcttcaaaagcaagggagtgtaatagaatgatgtagcaggcactttgtggatttgaattctgggctgtagttgtgggaccttggaaaagtaataaaactccctttggtttcttcatctgtaaattattgtgaaaattaaatatatgaatatattagaatattagaatagaacagtgccaagcacataataagcactcaataaatgttagttgttgttattgttgatattgttgtcaacctcccacccatttcaggaatgccttgaggactgccgacaggtgtcattcagccagtgacaattgcggcacattctgtaattctctccatctatgcttagatagaaagatgctgattaatagtaatatacagtagtaaataaataatggtaataaataataacaataacatatacaatttactaagtacttaaactatgtgcaggttctgtgctatctatcttataactgccggagagagaggtattattccaattttacagaagaaatgaaggtttagggaagttaagtgggaaagctgagattccatcttaggtaatctgcctcctaagcctaggcttttaacctctatatctattgcactgtcttgtacgacattagactatgttctctcagcccttctggggtcaagtctgggccctggcaggtatcagacaacctcatttgtgacttaggcctcaagcactctcttgtgactcttctcttggggttggtatttccccttctccgcaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgt

SEQ ID NO: 460070 - DNA, 1875 bp, Homo sapiens
ggaggttgcggtgagccaagattgtgctactgcactccagcctgggcgacagtgagactccgtctcaaaaaaaaaaaaatgctgtggcaagggaggcaagaaagaatgttttatctgtagcattttgtgctgatagaaaaggcagggtccagtggaagaaggaggaaatggtacataatttcttcataaaaagagtaaggccagggagaagtgactgagtagacacctgtagctaaacagaggtggtgatgagtttatggtgcctccagcttctcatggccccacttgggaaattcctccagtaacattacactcactcactccttgaccatctacctttactcctctcctcatttccctgttaccaaaactatgtgccctacccagggacttctgggcagctcttttctcagatcatttctcaccctctctcctctactaacttagcctttcatactgaatcacattttccttaaaaaacagctgctgacagaagatgctacattttgtttcagggcctggtaaccatcaaggatgtgtcactgtgcttctctcaggaggagtggcggagcctggacccctctcagacagacttttatggagaatatgtcatgcaggaaaactgtgggatagtagtctctctgagatttccaattcccaaactggacatgctttctcaactagaaggaggagaagaacaatgggtccctgacccccaggacttagaggagagggacattctgagggtcacatatacaggtaagaacctagaataggctttcagccacttccttcacagttcgggacatcatcattccatgttcgtttaatccctcctctgcctcagagagttccagagacaaaaggtttagagatttttttcttcaaaagcaagggagtgtaatagaatgatgtagcaggcactttgtggatttgaattctgggctgtagttgtgggaccttggaaaagtaataaaactccctttggtttcttcatctgtaaattattgtgaaaattaaatatatgaatatattagaatattagaatagaacagtgccaagcacataataagcactcaataaatgttagttgttgttattgttgatattgttgtcaacctcccacccatttcaggaatgccttgaggactgccgacaggtgtcattcagccagtgacaattgcggcacattctgtaattctctccatctatgcttagatagaaagatgctgattaatagtaatatacagtagtaaataaataatggtaataaataataacaataacatatacaatttactaagtacttaaactatgtgcaggttctgtgctatctatcttataactgccggagagagaggtattattccaattttacagaagaaatgaaggtttagggaagttaagtgggaaagctgagattccatcttaggtaatctgcctcctaagcctaggcttttaacctctatatctattgcactgtcttgtacgacattagactatgttctctcagcccttctggggtcaagtctgggccctggcaggtatcagacaacctcatttgtgacttaggcctcaagcactctcttgtgactcttctcttggggttggtatttccccttctccgcaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgt

SEQ ID NO: 460071 - DNA, 465 bp, Homo sapiens
gaaatatagaattgctgttgaactaattgacagctctattttcctttcccatgagcaggatttccaattcccaaactggacatgctttctcaactagaaggaggagaagaacaatgggtccctgacccccaggacttagaggagagggacattctgagggtcacatatacaggtaagaacctagaataggctttcagccacttccttcacagttcgggacatcatcattccatgttcgtttaatccctcctctgcctcagagagttccagagacaaaaggtttagagatttttttcttcaaaagcaagggagtgtaatagaatgatgtagcaggcactttgtggatttgaattctgggctgtagttgtgggaccttggaaaagtaataaaactccctttggtttcttcatctgtaaattattgtgaaaattaaatatatgaatatattagaatattagaatagaa

SEQ ID NO: 460072 - DNA, 905 bp, Homo sapiens
cagccggtcgctggctccgccggccgccggctcccagacgcaagcggagggcggaggggaggggcaggcggcgcccgggagggaggcaccgggccgcgggccaagcctaccgggggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacagggcctggtaaccatcaaggatgtgtcactgtgcttctctcaggaggagtggcggagcctggacccctctcagacagacttttatggagaatatgtcatgcaggaaaactgtgggatagtagtctctctgagatttccaattcccaaactggacatgctttctcaactagaaggaggagaagaacaatgggtccctgacccccaggacttagaggagagggacattctgagggtcacatatacaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgt

SEQ ID NO: 460073 - DNA, 1530 bp, Homo sapiens
cagctccacattaggagcctaattccacagccacaccccagacccttgtcattccttggaactgccactgcatggtgcacaactcatggggcaccactcaggagacaatgcatctgaagctcaggctcctgtttctaccagccctctcctctctgcctacatgcatatttgttttcctcgtagcctcttaaaaaccttcctgggcccaactttctccttaagcttcaacttcaaccacctcccctttcctttactgccaaacttcttaaaagagtattcagtacttgctgcctccacctccctcttcactccatccactgccatctggcagaggtccctccccacatccattgaaattgctcagtcgacagtcagtcatggcatcctaactgccaagtccaatggcctctttcagcgttcatccacttcctcatccttaatcaccctgctgacaggagatgagaaaaatgttggacaatccctctccagagagcttgcataatggctcccaaagggtggtcccagagcagcagcattgacattatctaggaatttgtgtgatatacattcttttttattatactttaagttctggggtacatatgcagaatgtgcaggacaaggatccagggagaactctaacattacatttgcaaacactgatgacaagagtcagtgtgaagcattctattaaccagtatgctttgtaacaagaaagcagattgctagaacaataaatttggcaggatgcaaaatatttaacctattaatttttttaaagttttctgaaagttttctatttaggaaaaagacaagtttctaaaacataaagcaagtcttttttttttaaatcaaggctttcaacaaaaaacatttccatctaactctgaggaaattcatttttaaaacttttcccaaaagccccaaaagaaaacttaactgctattataattcaccgacgcctgcacacattcaattgaatcatctgtggtaatggaaacaatgacagcagagacaaatgaaattcagactttatctcaatttagctaatacatactctttaactttgtctccccttttcattttattcaatattggttgatttcaattcaacagctctttagttttctgttgtcctttattaagattgtgaaggattaatgcctctcagcagaattcaagaaaacctgtctttatcagatgtctgagtcccttaccatcagtagacagaggtactgagttttgcctagtgctttggtgatgcttcataatgtttacaagacaccatgcgtccactccatggaaataatcatcaatgagagaagcaacatcatcctaatcagttgcacagttaaacaaaaaaaaaaaaaaaaaaaaaaaacgacatcactgaagtcaagaagcacaaaatgacaaatggtcaagttccaacagctaaaaagatccaagacattatgagcttttaatgagtgaaacatgccatgagaaagagaccttctgtcaataaatccaaatccttgttcactaatt

SEQ ID NO: 460074 - DNA, 2903 bp, Homo sapiens
gacagctgctgaatcctctgatcacacacgatgggacttggcctcatccagctcctgcagctgtcagtcctctcagacctcatccacctgcagctgtcagtcctctcagacctcatcaacctgcagctgtcagtcctctgggacctcatccacctcctgcaactggcagtcctcccggatctcatctacctgcagctgtcagtcctccgggacctcatccacctcctgcagctgtcactgtcagtcctctgggacctcatccacctcctgcagctggcagttctcccggacctcatctacctgccgctgtcagtcctccaggacctcatccacctcctgcagctgtcagtcctccaggacctcatccacctcctgcagctgtcactatcagtcctcccggacctcatctacctgcagctgtcagtcctccgggacctcatccacctcctgcaactggcagtcctcccggacctcatctacctgcagctgtcagtcctccgggacctcatccacctcctacagctgtcagtcctccgggacctcatccacctgcagctgtcagtcctctgggacctcatccacctcctgcagctgtcagtcctccgggacctcatccacctgcagctgtcagtcctctgggacctcatccacctcctgcagctggcagtcctcccggacctcatctacctgcagctgtcagtcctccaggacctcatccacctcctgcagctgtcagtcctccgggacctcatcgacctgcagctgtcagtcctctgggacctcatccacctcctgcagctgtcagtcctcccggacatcatccacctgcagctgtcagtcttctgggacctcatccacctcctgcagctggtggtcctctcggacctcatccatctcctgcaccagtaggtcctctgggatctcatccacctcctgcagctgttggtcctctgggacctcatccacctcctgcagctccttgtcctcccggaccttatccatcttctgcatgtttctgtcctccgggacctcatccatcttttatagctgcctttcctctgggacatcattcacctttttgttctgtgaggcctctgggacctccgactacatctccacttagtaatctctggatcctcagccaccccttctacctgggtggccctctggcccctcaacaaccaccttcacatgaatctcctcagctacttcaataatctccacttgtggtccctgggacttcagccacctcctccaccagggtctcttctagtacatctgccacctcctccacttgcctggcctctgctatctgaaccaactcctctgggacctcaaccagctcctctacccattgtggcctgtaagacctcaaccaccaactccacatgtaccacttggataattttgaaatttgaagagtctcctgggccatgatatcttggaaaagtctccaccatatttgatgctccatgccccgtgctccctcctctctctctcatttccagtgtttccctttagaaacatttgcagtcctatctttctgggtgtctgcttcctggaggaccagttcacaccccagggtataccaggtgtgactcctcgtacactattcaaactcaggcagatactgccttgctggacacagaagcagggttaccctttgggtagtgttgactgcacttatcaccttctaacattctgtacaatttccttcctgtataaatttcatatttgtttcccctcactagaatagaagctccaggagggcagagacttttatttctccatgtgcctagaatagtatatgacattcaggagtgcaaaaaaccaaagcaacttgtaagtgctctccacttccctgtccagcagctgctccagtgagcaccatggcagccacagaagctgccaggagaggacactttatgggaagaggactctggatggggctgtgcctcctcccaagggagcagtttcaagtttccagacaaattgaacagaaaatctagagctcccccacagcacctcttcctccacacacaacttccccaattaacatcatgcattagtgtggtacgtttgtcacacctgataagctagtattgctatattattattaactagagcctctagtttacataagggctcagtctttgtattgtgcattcaatgggttgtgacaaatatatgtcatgtatcaaccattacatacttcatgcagaatattatattttcaatcccctgaaaaaatgtgttcttcctacttatcccttccttcctctgacccccaaactttaggcagttgaaattattagcttctctatagttttgtcttttccagaatgccatattttggaattatattgtatgtagcctgttcacattggcctctttcacttagtaatatacatttacggttccttcatgttttttccatagcttgataatcatttctttttatcactgaataatattccattatatggatataccacagtttgtttatcaattcacctattggaggataactcagttacttccagtttttggcaattatgaataaagttgctgtaaacattcgtataaaggtttttgtgtggacatcagttttcaactcatttgggtaaataccaaggagctagatcatatgatatatgatttgcaaatattttctcccattctgtgggttgccctttcacctctttgatagtatcctttgaagcacaaatattttattttaattattctatttatctactttgttgtcattgcttgagtttttggtgtcatatctaagatatatgtctttttccttaagttcacattctttccatctgttgagttctggattctgcctgatgtttgcaaatgtcttttctaccacttgcattttgaacaagcct

SEQ ID NO: 460075 - DNA, 2334 bp, Homo sapiens
agtgaaatgcttcaaggatgccatttttatttgggggtctcagttccaactccctaccttgcacatgggcattacaatccaagaaccagataaatggacagttctcaaaccccaggtttactgggaaactggtgctcagatcacatctcctcatgataaagaaattctaaaatgtatagaagaatgtgtggaaccctggaatggttcctggaatgataatttagtggataccagcccgctgaagagagaccctctgcaggacatttgcaggagatacatggaagatctgaaaaagatctgtttttacagagtgaagctgttcaatccttttgtgagatttattctagcaatattcaactattttggtgcaagcctggaaaaggaacacatttgggttcaacaagatttggggtattggagggtcaaagtagccagactgacatataagaaggaaacattaccaggttttaaatggattggaagtaggataatagacctcctggaaaatgggaaagaagtcctttttgcatttgaagagtctattggttttctctgtggaacttcagttttggataaagatggggtgagtgcagctgttgtggttgctgagatggcatcttacctggaaaccatgaatataacattgaaacagcaactggttaaggtttatgaaaaatatggttatcatatttcaaaaacttcctatttcttgtgttatgaaccacctaccatcaaaagtatatttgaaaggcttcgtaattttgattctccaaaagaatatccaaaattttgtggaacatttgctatattgcatgtacgggacgttaccactggatatgacagtagccagcctaataagaaatcagtgctgcctgtgagtaaaaacagccaaatgattacatttacttttcaaaatggctgtgttgctacccttcggacaagtggaacagaaccaaagataaagtattatgcagagatgtgtgcgtcacctgaccagagtgacactgctttactggaggaagaactgaagaaactcattgatgctctgatagagaattttcttcagcctagtaagaatggactgatctggcgttctgtttaggggtacaccaatatgtcatgacactgtgtgggcatatggaacagagcaaccgagaactgcatacattgaaccttgtgttagcattctctctctatctcatctggccgagtatctttttccttttattttctttctttttggtcaactggctagactaaacaaagtataagtttgaaatgaaatggtctagagggaaatgattcaaattttttcataattcaaacaaaagttattacactaaaagtattatagtaacgtattgtccttccgttaacagaaacatcacaattcaaaagtgagttttcttattatagtgtgattaagcctagttctgtatctcgtaattgtgtatagcatggtaaaagaaaaaaaaaaagacaggtaaatgttatataattgtagggttagttaaggaaattagtccataaaattggcaagaaaatggtactttccttgattgttatgaaaaagtgtcattgtgacatcacaggtattaatttacaaattagagtatttgaaataggatatttagcatttctgtagtttagaacagatgttacagtgtgtggttttggcatgtctgtttcaggtgcccttggtgcagtataaatttactgtatgtatttaaaattctgatgtttactgaacataaaacaatagtggcaacactcctattggctttgttcttatcaaatttctcagtgccttctcagggtctggtgtgaacagaaaaaacagtgttcctgcatttaccataatttaatcagtcaatttgcagatagctaaggaaaatcttccaaaatctgtaggtgcttcctctatatcaagtgagtttgctgattttaaaatcttaggaatataaataaagatcttaataaaagcaagcttaatgtagttaaggatcttcatattagaattgtgtcatttatcaaaccttttattacagaaaaaaatctgaactgagaaaggagctctgaatttatttgacagtctaacttttgaattacatttttgtttccttgtacttggggagccaaagcacaagatctaaggaaatcttattcacatttgtccctcagagcatcttaccctaagccatagaggtataaatagtaagatgagaattgctcattgtctgactccttgcacagcatgaatttaattctagttggaaacaaagttagtgttgactactggttaccttaaagtattcaccatactatatatttatt

SEQ ID NO: 460076 - DNA, 2301 bp, Homo sapiens
agtgaaatgcttcaaggatgccatttttatttgggggtctcagttccaactccctaccttgcacatgggcattacaatccaagaaccagataaatggacagttctcaaaccccaggtttactgggaaactggtgctcagatcacatctcctcatgataaagaaattctaaaatgtatagaagaatgtgtggaaccctggaatggttcctggaatgataatttagtggataccagcccgctgaagagagaccctctgcaggacatttgcaggagatacatggaagatctgaaaaagatctgtttttacagagtgaagctgttcaatccttttgtgagatttattctagcaatattcaactattttggtgcaagcctggaaaaggaacacatttgggttcaacaagatttggggtattggagggtcaaagtagccagactgacatataagaaggaaacattaccaggttttaaatggattggaagtaggataatagacctcctggaaaatgggaaagaagtcctttttgcatttgaagagtctattggttttctctgtggaacttcagttttggataaagatggggtgagtgcagctgttgtggttgctgagatggcatcttacctggaaaccatgaatataacattgaaacagcaactggttaaggtttatgaaaaatatggttatcatatttcaaaaacttcctatttcttgtgttatgaaccacctaccatcaaaagtatatttgaaaggcttcgtaattttgattctccaaaagaatatccaaaattttgtggaacatttgctatattgcatgtacgggacgttaccactggatatgacagtagccagcctaataagaaatcagtgctgcctgtgagtaaaaacagccaaatgattacatttacttttcaaaatggctgtgttgctacccttcggacaagtggaacagaaccaaagataaagtattatgcagagatgtgtgcgtcacctgaccagagtgacactgctttactggaggaagaactgaagaaactcattgatgctctgatagagaattttcttcagcctagtaagaatggactgatctggcgttctgtttaggggtacaccaatatgtcatgacactgtgtgggcatatggaacagagcaaccgagaactgcatacattgaaccttgtgttagcattctctctctatctcatctggccgagtatctttttccttttattttctttctttttggtcaactggctagactaaacaaagtataacaaattttttcataattcaaacaaaagttattacactaaaagtattatagtaacgtattgtccttccgttaacagaaacatcacaattcaaaagtgagttttcttattatagtgtgattaagcctagttctgtatctcgtaattgtgtatagcatggtaaaagaaaaaaaaaaagacaggtaaatgttatataattgtagggttagttaaggaaattagtccataaaattggcaagaaaatggtactttccttgattgttatgaaaaagtgtcattgtgacatcacaggtattaatttacaaattagagtatttgaaataggatatttagcatttctgtagtttagaacagatgttacagtgtgtggttttggcatgtctgtttcaggtgcccttggtgcagtataaatttactgtatgtatttaaaattctgatgtttactgaacataaaacaatagtggcaacactcctattggctttgttcttatcaaatttctcagtgccttctcagggtctggtgtgaacagaaaaaacagtgttcctgcatttaccataatttaatcagtcaatttgcagatagctaaggaaaatcttccaaaatctgtaggtgcttcctctatatcaagtgagtttgctgattttaaaatcttaggaatataaataaagatcttaataaaagcaagcttaatgtagttaaggatcttcatattagaattgtgtcatttatcaaaccttttattacagaaaaaaatctgaactgagaaaggagctctgaatttatttgacagtctaacttttgaattacatttttgtttccttgtacttggggagccaaagcacaagatctaaggaaatcttattcacatttgtccctcagagcatcttaccctaagccatagaggtataaatagtaagatgagaattgctcattgtctgactccttgcacagcatgaatttaattctagttggaaacaaagttagtgttgactactggttaccttaaagtattcaccatactatatatttatt

SEQ ID NO: 460077 - DNA, 1027 bp, Homo sapiens
cttttcgttatatgtaaagattatgtggtctcaactaggccaaccagacatttggattgtgggtttcatacgtgggtctctggctgtactctgccacaatcatttaattaagggttgtcttgtgcatccagcatctcagaaatggtctcctgagaaaaaaatgccttcatttgtccttgtactttcctctctggagcttgagtaccatggtggtcctacagaagaatgcaaagggtggggaggcagacattcattcagcaggtgtttactgagcacttgttatatgccaggctatgctctgggtgttagggagatcatggggaacaagaagttggaagagtttgccatcacagagcatacatttctggagtgcttgagaaagaggtactggctaaagactgtctgggctgggcagaaaatgatcgtggctttcttcttcatcacaaacccagatcccaaaaccagtatggggggatgggggatgtcctattgaaagccagactggaactaaccccgtcccctccctcacaacactttttccgcacgtccattagtacacttatcaaccttagcattggatcagagttatttttgtctgtttgtcttcccccatgagattgtaaatttctagatactggacctgggcatttccccctctttgtggagagatttttaaccttttgtggatcacatacatccgtaagaatctgatgaagaggccaggcacggtggctcatgcctgcaatccagcactttgggagactaaggtaggaggatggcttgagcccaggagtttgagaccagcatgggcaacatagcgagaccctgtctctacataaaatttaaaaattagcccaggccaagcatggtggcacacacctgtaatctcagcattttgggaggctgagatgggtggatcacttgagtccaggagttcaagatcagcttgggcaacatcgtgaaaccctgtctacaaaaaatataagaattagctggaagtggtggcactactatagtcccagctact

SEQ ID NO: 460078 - DNA, 1528 bp, Homo sapiens
ggtttatatcccgatcattgtccatcctgctgtgctctcaggtgataggtgattggctgttcctttacctcctatgaattctcggggctccatgggtgtaggaccctctgagtcatgtacgggatataatctcctggtgtgccgtttgctaagaccattggaaaagcgcagtattaggattggcaatgtctgctgggagctctactgcctggaacatggcatccagcccgatggccagatgccaagtgacaagaccattgggggaggagatgactccttcaacaccttcagtgagacgggtgctggcaagcatgtgccccgggctgtgtttgtagacttggaacccatggtcattgatgaagtttgcactggcacctaccgccagctcttccaccctgagcagctcatcacaggcaaggaagatgctgccaataactatgcccgagggcactacaccattggcaaggagatcattgaccttgtgttggaccgaattcgcaagctggctaaccagtgcactggttttcagggcttcttggttttccacagctttggtgggggaactggttctgggttcacctccctgctcatagaacgtctcttagttgattatggcaagaagtccaagctggagttctccaattacccagcgccccaggtttccacagctgtagttgagccctacaactccatcctcaccacccacaccaccctggagcactctgattgtgccttcatggtagacaatgaggccatctgtgacatctgttgtagaaacctcaatatcgagcgcccaacctacactaaccttaaccaccttattagccagattgtgtcctctatcactgcttccctgagatttgatggagccctgaatgttgacctgacagaattccagaccaacctggtaccctactcccacatccacttccctctggcgacatatgcccctgtcatttctgctgagaaagcctaccatgaacagctttctgtagcagagatcaccaatgcttcctttgagccagccaaccagatggtgaaatgtgaccctcgccatggtaaatacatggcttgctgcctattgtgccatggtgatgtggttcccaaagatgccaatgctgccattgccaccatcaagaccaagcgtagcatccagtttgtagattggtgccccactggcttcaaggcctgggctcgcctggaccacaagtttgacctgatgtatgccaagcgtgcctttgttcactggtacgtgggtgaggggatggaggaaggcgagttttcagaggcccgtgaagacatggctgcccttgagaaggattatgaggaggttggtgtggattctgttgaaggagaggaggctgaggatgaagggaaatagggtgttgttgtttaatggttatagtttcacttttgcaagatgaaaaagttttggagattggtgcacagcaacatgaatatgtttaacactactgaactgtacacttaaaatggttgttggtaaattttatgttctgtgtattttatc

SEQ ID NO: 460079 - DNA, 1513 bp, Homo sapiens
atgagctggcacaccagcggcatgggcggctgccctgggctcgcctcttccagcccagcatccagctggcccgccagggcttccccgtgggcaagggcttggcggcagtcctggaaaacaagcggaccgtcatcgagcagcagcctgtcttgtgggggcattgtgacagctgaggacctgaacaactactgtgctgagctgatcgagcacccgctgaacatcagcctgggagacgcggtgctgtacatgcccagtgcgcggctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggccagctctggggtctcagcaggtggtccgcaacatgacctctgagttcttcgctgcccagctccggtcccagatctctgaccacaccactcacccgatctcctactacaagcccgagttctacacgctggatgacgggggcactgctcacctgtctgtcgtcgcagaggacggcagtgctgtgtccgccaccagcaccatcaacctctactttggctccaaggtctgctccccggtcagtgggatcctgttcaataatgaatggacgacttcagctctcccagcatcaccaatgagtttggggcacccccctcacctgccaatttcatccagccagggaagcagccgctcttgtccatgtgcccgacgatcatggtgggccaggacggccaggtccggatggtggtgggagctgctgggggcacgcagatcaccacagacactgcactggtatgtgtcaccccttttctccctggccctgcccactctgcacagcccccaagccacgctgatcacactcccatgccccaggccatcatctacaacctctggttcggctatgacgtgaagagggccgtggaggagccccggctgcacaacaagcttctgcccaacgtcacgacagtggagagaaacattgaccagctccaccttgatgctgactaggctgggccatgcggagagggttaggggatagagatgggagctggggagcagggctccactctgggaggggggcagccttgccggatccagggcagagttaagcggccccagctctgctttcccagagctgctgagaacctggggaatggtgtggaggttccagggagccctgcccctacctggcaaccgcagtgcagcacgcaccaagttctcctgcacattgcgacagtgtgaccatgggctctggcgggcggtagctatctggcctgtctgtcgatccatcttcgtgtctgtcttcagcccccacctgtttgtccatctgtccaattacctgccccatttgacccccggcctttgcccacgccgctgttgctgctgactccaaggtcttctcaaatattgtacg

SEQ ID NO: 460080 - DNA, 1119 bp, Homo sapiens
tctggcactagatgcaccctgcctccttatataagagggggcgggagacaagccctatcagcacatcccagaaaatgggaaaccgaatcacccaggggatggcaaggaatgaccagagggaaagttccagttctgtccaacatgcactaccagccccattttggaaaagaacagatttaatagacctcaccaagacaagaattgtttttcgtcaaaggaaatcaaaggaacaaacaagaggcagtgaccaccagagacttcaccttttgggaaacgtggctgcactgctggaggaagaacttgatcatgacgggcaatgcttggaagtaaagaagcatctgctgccttggaaaggcttggtcagggcaatcattgtcacaggccatgttttttctctgactatctcttggaatttcagagtgactaagtgattactacaattagagcaagaggcggtgtcttccagaagtcggtgtgggcagcaccaaaccatccaccatgcatcagagaaaagccagacagctggaaggctctattcccaggccactctccagtcctcaaacatgtcaccatctctcatgcctccttactgggcccatgctgtctccttgaccaggaatgtcctccaccccgatcccatccccatagcccccttcactgtaagatctgggcccagcaaattgcccagctcctcttctctgaatgcttctttaatgtctctgagaaggagttccttcctcctttactgtccatctcttccaccacatgaggggtttgggggaggtctttgaagacaagggacccttcctcattcatatttgaatactgagcccaagcacacgcccctagcatctgcaatacacacatgtcaaggtgaatggggagatagatgccaagatccttgagcgctgcaaatcttcactgccaacttcaactactccaaaataaagtcaaaattttaaaagtaagctttgatgactcaagtgactaattttatggacaagggccccttaatgaaatctaagaggaggaatgtggtgacataagcaggacatggctgtgagacactgagcaaacagtttatcctccctgagcttcgattttctcatctgtaaaaac

SEQ ID NO: 460081 - DNA, 2463 bp, Homo sapiens
ggatggactctgaggacactatgctgagtgaaataagccagacacaaaaagacaagtactgaatgattccacacgtaccaggtcccaagagtcgtcagattcagagacagaaggtaggagggcaggtgccaggagctggagaggacaatggggagtttaatagggacacagtttccatttggggagatgagaaatcatggaggcagatgctgatggcggctgcatgacagtgtgaatatgcttagtgtgaatatactcagtgtgaatacgctcagtgtgaatatgctgagtatgctcggtgtgaatatgctcagtgtgaatatgctcagtgtgaatatgctcggtgtgaatacgctcggtgtgaatacgctcggtgtgaatatgctcggtgtgaatatgctgtgtgaaaatgctcagtgtgaatacgcttggtgtgaatacgcttggtgtgaatatgcttgtaatatgctcggtgtgaatatgctttgtgtgaatatgctttgtgtgaaaatgcttagtgtgaatacgctcagtgtgaatacgctcggtgtgaatatgctcggtgtgaatatgctcggtgtggtgtgaatatgcttgtaatatgctcggtgtgaatatgctttgtgtgaaaatgcttagtgtgaatacgcttagtgtgaatacgctcggtgtgaatatgctcggtgtgaatacgctcagtgtgaatacgcttagtgtgaatacgctcggtgtgaatatgctcggtgtgaatatgctcggtgtggtgtgaatatgcttgtaatatgctcggtgtgaatatgctcagtgtgaaaatgcttagtgtgaatacgcttagtgtgaatatgcttggtgtgaatatgctcggtgtgaatatgcttggtgtgaatatgcttggtgtgaatatgcttgtaatatgctcggtgtgaatatgctttgtgtgaatatgctgtgtgaatatgctcagtgtgaaaatgcttagtgtgaatacgcttagtgtgaatatgcttggtgtgaatatgctcggtgtgaatatgcttggtgtgaatatgcttgtaatatgctcggtgtgaatatgctcagtgtgaaaatgcttagtgtgaatacgcttagtgtgaatatgcttggtgtgaatatgctcggtgtgaatatgcttggtgtgaatatgcttggtgtgaatatgcttgtaatatgctcggtgtgaatatgctttgtgtgaatatgctgtgtgaatatgctcagtgtgaaaatgcttagtgtgaatacgcttagtgtgaatatgcttggtgtgaatatgctcggtgtgaatatgcttggtgtgaatatgcttgtaatatgctcggtgtgaatatgctttgtgtgaatatgctgtgtgaatatgctcagtgtgaaaatgcttagtgtgaatacacagtgtgaatacgcttagtgtgaatatgctcggtgtgaatatgcttagtgtgaatacgctgtgaatacgcttagtgtgaatatgctcggtgtgaatatgctcggtgtggtgtgaatatgcttgtaatatgctcggtgtaaatatgctcagtgtgaaaatgcttagtgtgaatacgcttagtgtgaatatgctcggtgtgaatatgcttggtgtgaatatgcttgtaatatgctcggtgtgaatatgctttgtgtgaatatgctttgtgtgaatatgctcagtgtgaaaatgcttagtgtgaatacgcttagtgtgaatatgctcggtgtgaatatgctcggtgtgaatatgcttagtgtgaatacgctgtgaatacgcttagtgtgaatatgctgtgtgaatatgcttagtgtaactatgcttagtggcactgaactgggtaggaggccacgtgagacagaggcagaaatcggagggaagtggctgcaagccaaggaatgcctggagcccccagatgacgaggaagggtccccacataaggtctggtgttctggtccttggggagggcagcccctgctgaaaaggggcaggttgagacccagggaccacttcaggccctcgctggcagcccccaggctgggggcagcagactctagcaactctggccagtgcctgcacctgaggccccatctccaggcgttccctcttgtcctcccagccctgcacccgccttgctcagtgaggcactgtcctccctcctcggactggcttccagccaggcaggcactggtgagggccggtgtgggcagccctgccatgcccagggtctgggttctgaggaggtgaagcttctccccatgtcccagatacagaaactgagacctagggagatttggaaacttggtggacaccacagacttcttgaggagctcgacaagggtgatctgtgtgggtccgccctgagtggggtcctggacacagctgtagctgccccgtttctcctgggctgggctgggctgggccaggctgttgggttgtcatggtaagtaacatcc

SEQ ID NO: 460082 - DNA, 1113 bp, Homo sapiens
ctgcagtagcatgaagaggtctgaggaagctgtgcgtccctcaagaaagcaattctttattgcccatcaaagatgaatccataggggatcattaacaaggagatcatcccagagagcagcttctagaatcaccaaccaagtttccttcatttctattcagcctcatgaaataaagaaataaagaaaacaaacaagtaaataaaaacaagatctttatggatgtggcagaaagctttgcaagccaagaaagtcttctatccaggtgatgcaaataactgtaaaacttcagacttcttgaactacaaagatgaactctgccaacccaagttctagtacttcctctactcccagcctgacccccactgtttcttggtttcctcactccttctctttctgtttgactcttgagagtaataaactcagccaagtcctactacttgagcccatatttaaatgcagaacaatttggccttcagtttattcttcccccttcttccagactctgcacttcatggtggttgggggttctcttatttacaaccaaagaagaagaagaagaagaataaggaggaggaggaggacgaggaggaggaggaggggaggaggaggagggggaggaggaggaggaggaagaagaagaagaggaagaggaagaggaagaagaagaagaagaagaagaggaagcagcagcagcagaagcagcagcagcagcagcagcagcttgagggccccctctccttcccaaaaccataccactacctggaaagcttgctcgggataaggacaattgaggaaggagctctaacctccaatttttcaagagtaataaagacaaaagagaacctgatatttgatctaacaagactaaaaagagcaaaacaagagaaggagagaagaggaggaggtggagacagagaagtagagataaaaaaaaaacagaagagttggaggagggagagaataaaagcttgggagttttaaatttcagaaaaatatctccccattgataaataatgagcaaatgcaggacacttaagtagtgttcccatcagtagtgtgaaccctgtcagcactaaccagctggtccttgtctgttttgcagtcaaagaaaac

SEQ ID NO: 460083 - DNA, 1092 bp, Homo sapiens
ctgcagtagcatgaagaggtctgaggaagctgtgcgtccctcaagaaagcaattctttattgcccatcaaagatgaatccataggggatcattaacaaggagatcatcccagagagcagcttctagaatcaccaaccaacctcatgaaataaagaaataaagaaaacaaacaagtaaataaaaacaagatctttatggatgtggcagaaagctttgcaagccaagaaagtcttctatccaggtgatgcaaataactgtaaaacttcagacttcttgaactacaaagatgaactctgccaacccaagttctagtacttcctctactcccagcctgacccccactgtttcttggtttcctcactccttctctttctgtttgactcttgagagtaataaactcagccaagtcctactacttgagcccatatttaaatgcagaacaatttggccttcagtttattcttcccccttcttccagactctgcacttcatggtggttgggggttctcttatttacaaccaaagaagaagaagaagaagaataaggaggaggaggaggacgaggaggaggaggaggggaggaggaggagggggaggaggaggaggaggaagaagaagaagaggaagaggaagaggaagaagaagaagaagaagaagaggaagcagcagcagcagaagcagcagcagcagcagcagcagcttgagggccccctctccttcccaaaaccataccactacctggaaagcttgctcgggataaggacaattgaggaaggagctctaacctccaatttttcaagagtaataaagacaaaagagaacctgatatttgatctaacaagactaaaaagagcaaaacaagagaaggagagaagaggaggaggtggagacagagaagtagagataaaaaaaaaacagaagagttggaggagggagagaataaaagcttgggagttttaaatttcagaaaaatatctccccattgataaataatgagcaaatgcaggacacttaagtagtgttcccatcagtagtgtgaaccctgtcagcactaaccagctggtccttgtctgttttgcagtcaaagaaaac

SEQ ID NO: 460084 - DNA, 1786 bp, Homo sapiens
ctcaccgggaacatgagtggaagagcccgagtgaaggccagaggcatcgcccgcagccccagtgccacagaagtggggcgcatccaagcctcgccattgcctagatctgttgatcttagtaacaatgaagcatcctctagcaatggcttcttgggaacaagcaggatctcaaccaacgataaatatgggatatcttctggtgatgctggaagtaccttcatggaaagaggtgtgaaaaacaaacaggactttatggatttgagtatctgtaccagagaaaaattggcacatgtgagaaattgtaaaacaggttccagtggaatacctgtgaaactggttacaaacctctttaacttagattttccccaagactggcagctataccagtaccatgtgacatatattccagatttagcatctagaaggctgagaattgctttactttatagtcatagtgaactttccaacaaagcaaaagcattcgacggtgccatcctttttctgtcacaaaagctagaagaaaaggtcacagagttgtcaagtgaaactcaaagaggtgagactataaagatgactatcaccctgaagagggagctgccatcaagttctcccgtgtgcatccaggtcttcaatatcatcttcagaaagatcctcaaaaagttgtccatgtaccaaattggacggaacttctataatccttcagagccaatggaaattccccagcacaatgctgatgtgagttacaaagtcctccggaatgagacggttctggaattcatgactgctctctgtcaaagaactggcttgtcctgtttcacccagacgtgtgagaagcagctaatagggctcattgtccttacaagatacaataacagaacctactccattgatgacattgactggtcagtgaagcccacacacacctttcagaagcgggatggcaccgagatcacctatgtggattactacaagcagcagtatgatattactgtatcggacctgaatcagcccatgcttgttagtctgttaaagaagaagagaaatgacaacagtgaggctcagctcgcccacctgatacctgagctctgctttctaacagggctgactgaccaggcaacatctgatttccagctgatgaaggctgtggctgaaaagacacgtctcagtccttcaggccggcagcagcgcctggccaggcttgtggacaacatccagaggaataccaatgctcgctttgaactagagacctggggactgcattttggaagccagatatctctgactggccggattgtgccttcagaaaaaatattaatgcaagaccacatatgtcaacctgtgtctgctgctgactggtccaaggatattcgaacttgcaagattttaaatgcacagtctttgaatacctggttgattttatgtagcgacagaactgaatatgttgccgagagctttctgaactgcttgagaagagttgcaggttccatgggatttaatgtggactaccccaaaatgtgagaatacattgaattttgttcatatattaatttggtttggttagaaggaaattcatagttacagtgagtagaaatgttttcagagttcattccctcagtgagaattggaatcaattgggtgagtcagtgtgaagatatgttttcagaggaacagcaaagccatttccttagattttcatatttattctcattaggaaggaaaatgacataaaattagtttatatctaattagaggatttaaagacttgaagacactaatatttgatttt

SEQ ID NO: 460085 - DNA, 1660 bp, Homo sapiens
gtcctgggcaccgggcgagagtgtgagaggagcggacgcccaggagggagccgaggacgcgcggcgggtagggggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggcttctgggcactctccgcccggcggaccgctgaccatggctggcctgccccgcgcccagcgcgcgcccggtgcccagtccgccgccgcacttctcctcggaaagcgcctgagtttcagccgggcggagcgggtggctggagccgggggtggcccgggagcccgggtcgttgctcaggccaggatgccccggggcggagggccgacggggcgggaaaatggactcccggatggtcgagaggtggacccgctcccagagcagggcgcccccgaaggctggtcaagcatccctgacccgggcgcgcgccctcgcccggagcaggggcggccggggtccccgcccgccgcactcaggctccctcccctctgccccgcagacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcaggggacaacggcagctggtgtttgctgggctgaccagcattgttgggcctgttgttggaaaacccatgaggaggacgggggctggggggagggccacccccgggaccccgctgacctctctgaaacctggtcggagcatgggaggaggatcccactaaagggccccaaggaacccacaacttctttccaaggagagccagcctggggctttcgctggcctctcaataataataggaaggcttgccctgcatctggaaatgatctgctggaggattccccatatgaaccagttaacagcagattgtcagatatattccgggtggtcccattcatatcaggggcctggaacatgaagcgagcgggaggacacacaggagaaagtgcgccggtgcaagaggatgtcggaggagaggcaggaacacagaagtgtcctaggatcccagagggcagagctgtgtgggcgctcagaggctcagaggcagaagccaccgtctctggcaacaagaactagtggctggaatgttaattttcatatttcttggcacccttcagggttgtctgtaaggaaaagtgagaaattatttgttgcgttaagccctcagattttttttaaagataatctttcattcagag

SEQ ID NO: 460086 - DNA, 1669 bp, Homo sapiens
agggctggctagggagctgccgccgccgccaccgagggctcggactccaggcagctgcaggctccgctcgcgacgctcggaaagttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggcttctgggcactctccgcccggcggaccgctgaccatggctggcctgccccgcgcccagcgcgcgcccggtgcccagtccgccgccgcacttctcctcggaaagcgcctgagtttcagccgggcggagcgggtggctggagccgggggtggcccgggagcccgggtcgttgctcaggccaggatgccccggggcggagggccgacggggcgggaaaatggactcccggatggtcgagaggtggacccgctcccagagcagggcgcccccgaaggctggtcaagcatccctgacccgggcgcgcgccctcgcccggagcaggggcggccggggtccccgcccgccgcactcaggctccctcccctctgccccgcagacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcaggggacaacggcagctggtgtttgctgggctgaccagcattgttgggcctgttgttggaaaacccatgaggaggacgggggctggggggagggccacccccgggaccccgctgacctctctgaaacctggtcggagcatgggaggaggatcccactaaagggccccaaggaacccacaacttctttccaaggagagccagcctggggctttcgctggcctctcaataataataggaaggcttgccctgcatctggaaatgatctgctggaggattccccatatgaaccagttaacagcagattgtcagatatattccgggtggtcccattcatatcaggggcctggaacatgaagcgagcgggaggacacacaggagaaagtgcgccggtgcaagaggatgtcggaggagaggcaggaacacagaagtgtcctaggatcccagagggcagagctgtgtgggcgctcagaggctcagaggcagaagccaccgtctctggcaacaagaactagtggctggaatgttaattttcatatttcttggcacccttcagggttgtctgtaaggaaaagtgagaaattatttgttgcgttaagccctcagattttttttaaagataatctttcattcagag

SEQ ID NO: 460087 - DNA, 3896 bp, Homo sapiens
gccacctgggatgaatgggggtcatggcatgtaagcagaaattcatcatcctgctcaaccatcctaggcttcaaggggagaaggagctgggggagctgggccagctccagacccaggccagcgacacgtctgtggtgctgtccatggacaacaaccgctacctggacttcagcagcatcatcactgaggtccgcgcccggtacgaggagatcgcccggagcagcaaggctgaggctgaggccttgtaccagaccaagtaccaggaacttcaggtgtctgcccagcttcatggggacaggatgcaggaaacgaaagtccagatctctcagctacaccaagagattcagaggctgcagagtcagactgagaacctcaagaagcagaacgccagcctgcaggccgccatcactgatgctgagcagcgtggggagctggccctcaaggacgctcaggccaaggtggacgagctggaggctgctctgaggatggccaagcagaacctggcccggctgctgtgcgagtaccaggagctgacgagcacgaagctttccctggatgtggagattgccacttaccgcaggctgctggagggcgaggagtgcaggatgtctggggagtgcaccagccaggtcactatctctatgaggtcctccgtctctcggcaaacatactccacaaaagggggcttcagctccaactctgccagcggagggagtgggtcccaggcccgcaccagcttcagctcagtgacggtgtctcggagcagtggcagtggtggcggggcccactgtggccccggcacaggtggctttggcagccgaagcctctataacttggggggccacaagagtatctctgtcagtgtggccggaggggccttgtcggggcgggctctggggggctttggctttggcagcagggcatttatgggacagggggctggcaggcagacgtttgggcctgcttgtcctcctggggggatccaggaggtcactgtcaaccagagcctgctgacccccctccatgtggagattgaccccgagatccagcgagtgcgcactcaggagcgggagcagatcaagaccctcaacaacaagttcgcctccttcatcgacaaggtgcggttcctggagcaacagaataaggtgctggagaccaagtgggcactgctgcaggagcagggccagaacttgggtgtcaccaggaacaacctggagcccctctttgaggcctacctgggtagcatgcggagcacgctggacagacttcagagcgagcgggggaggctggactcagagctcaggaacgtgcaggaccttgtggaggacttcaagaacaagtacgaggatgaaatcaacaagcacactgctgcagagaacgagtttgtggtgctcaagaaggatgtggatgcagcatacatgggccggatggatctgcatggcaaagtgggcaccttgacccaggagattgacttcctgcagcaactctatgaaatggagctgagccaagtgcagacccacgtgtctaacaccaatgtggtgctgtccatggacaacaaccgcaacctggacctggacagcatcatcgccgaggtcaaggcccagtatgagctgattgcccagaggagccgggctgaggccgaggcctggtaccagaccaagtatgaggagctgcaggtgactgctgggaagcatggggacaacctgcgggacaccaagaacgagattgctgagctcacccgcactatccagaggctgcagggggaggctgatgcagccaagaagcagtgtcagcagctgcagacggccattgcggaagcggagcagcgtggggagctggcactcaaggatgctcagaagaagcttggggatctggatgtggccctgcaccaggccaaggaggacctgacacggctgctgcgtgactaccaggagctgatgaatgtcaagctggccctggacgtggagattgccacctaccgcaagcttctggagagcgaggagagcaggtggtggcccctcctgcccgacccagaaagctgggtcgggcctgccctgggggagagcccagggagtctgctccgggctgtgactggcaactccaccactgtgtgcggaggtggcgcagccagctttggaggtggcatctccctgggtgggagtgggggggccaccaagggtggattcagcacaaatgtgggctatagcaccgtcaagggagggccagtctctgcgggcacctccatcctgcggaagaccactacggtcaagacgtccagccagagcccccacatccagtcggcaagaaaaatccacacttaattgggttttgtggtttacacatacattactttgcctgtgaccatcaccacagccctaggttcagtagtgggcatgtggtgttccagtttacagggtgtaaaggcgctcttgcataggaagttcttccttaggtctaccttcggtttctcaggctcagtttgaagattttgtgagcttcttgcaattctgatttaataataaggacacagaatgtggctctagactagaactttcttcttgtttggattgggtttatggtagggtttgtcatgaaattaatttggatttagttaattggaggatacaaaactggcccctcaggacagtgtcataccttattgggtacttgtaaggacagggccacatcaaccaagcaactgaccatgtgctgagggtaaggacaaaaaggagcggagctgcatctgcagagcttgcagcctgctggccagaccccatggctgtcttggtggaccatgaggtacagggctgtataagttgctgtgtatttttttccctgcatattctgtgtgggccagtcactcatataaaacattatacctaccgttttatacattgtaaggtcacaagctttgaagtcagacagatagtactgacttcctatctctaccacttcctggctgtgtgatctcaggcaacttacatacccctctgagcctcaatatctgcagctccaaactggacatagcaaagcacctctttgactgggttgttggaagaagcacctagtgttcagcatataacagtagttccaagagagaatcccttctacccaagaggcaccgctgcctttccttcatcttccttcttgtatcagcgatggcacacctcaagtcaccttcatgagaagtacctcaatcgtagctccatggtttgggtgccccacaggcacaaaataagactgattacatattctatattgtttccctgaaaatccccttggctcctggcttgctttttgttctaagcagtagacacaactctaggggcagtgaacccatgccattttctcctagtgttggagtgttacagccatagagtaaaagacccaataagcacactatgagccatctcagggattcacttgtgctcaggcaaagcctaccccggcctgtgatagtccccatcaaatcccaggggctaccagagaagaaagcagtgaacggcaggtgcagaggctgaggtgaggcagccggggggtgagctccagccatcactcagggtgagatcctgatggccctgccacgtcctctggggcaggtaaccagtcaattggacctcagcttcccaagtgggaggctcacatgtctcctcagctcctgcagctgcagcccgcaaagacctgcagtagctcccaccctccttccaagccatgcccaccttaggagcaacagtggaaatcgatagaccctgggatgctagtgcccccagagcccctttgacccgaacagtcagttccatcagatttatttgggtgcacattctggattggttgtgacacaatttagacagagtggctttataccaggcagaacagtgtgagtgagaggctataga

SEQ ID NO: 460088 - DNA, 1554 bp, Homo sapiens
cgccgcccgtcggggcgcggccgggcgcgggccccgggcgatggccgcggagctggcgatgggcgccgagctgcccagcagcccgctggccatcgagtacgtcaacgacttcgacctgatgaagttcgaggtgaagaaggagcctcccgaggccgagcgcttctgccaccgcctgccgccaggctcgctgtcctcgacgccgctcagcacgccctgctcctccgtgccctcctcgcccagcttctgcgcgcccagcccgggcaccggcggcggcggcggcgcggggggcggcggcggctcgtctcaggccgggggcgcccccgggccgccgagcgggggccccggcgccgtcgggggcacctcggggaagccggcgctggaggatctgtactggatgagcggctaccagcatcacctcaaccccgaggcgctcaacctgacgcccgaggacgcggtggaggcgctcatcggcagcggccaccacggcgcgcaccacggcgcgcaccacccggcggccgccgcagcctacgaggctttccgcggcccgggcttcgcgggcggcggcggagcggacgacatgggcgccggccaccaccacggcgcgcaccacgccgcccaccaccaccacgccgcccaccaccaccaccaccaccaccaccaccatggcggcgcgggacacggcggtggcgcgggccaccacgtgcgcctggaggagcgcttctccgacgaccagctggtgtccatgtcggtgcgcgagctgaaccggcagctccgcggcttcagcaaggaggaggtcatccggctcaagcagaagcggcgcacgctcaagaaccgcggctacgcgcagtcctgccgcttcaagcgggtgcagcagcggcacattctggagagcgagaagtgccaactccagagccaggtggagcagctgaagctggaggtggggcgcctggccaaagagcgggacctgtacaaggagaaatacgagaagctggcgggccggggcggccccgggagcgcgggcggggccggtttcccgcgggagccttcgccgccgcaggccggtcccggcggggccaagggcacggccgacttcttcctgtaggcgccggaccccgagcccgcgccgccgtcgccggggacaagttcgcgcaggcctctcggggcctcggctcggactccgcggtacaggacgtggacaccaggcccggcccggccgtgctggccccggtgccaagtctgcgggcgcggggctggaggccccttcgctcccggtccccgttcgcgcgcgtcggcccgggtcgccgtcctgagcctccctttccttgccttttttaacttcccctccccgttttaaaatcggtcttattttcgaagtatttataattattatgcttggtgattagaaaagaaaaccttggaggaagccccttctttccccagccggggtccgccctcagtcgcgagtcacagcatgagtcgctcgccaggaggggcccggcccctgcctgccccctccccgcttgcccccgaccctgctaccggcgttccttggag

SEQ ID NO: 460089 - DNA, 1743 bp, Homo sapiens
cgccgcccgtcggggcgcggccgggcgcgggccccgggcgatggccgcggagctggcgatgggcgccgagctgcccagcagcccgctggccatcgagtacgtcaacgacttcgacctgatgaagttcgaggtgaagaaggagcctcccgaggccgagcgcttctgccaccgcctgccgccaggctcgctgtcctcgacgccgctcagcacgccctgctcctccgtgccctcctcgcccagcttctgcgcgcccagcccgggcaccggcggcggcggcggcgcggggggcggcggcggctcgtctcaggccgggggcgcccccgggccgccgagcgggggccccggcgccgtcgggggcacctcggggaagccggcgctggaggatctgtactggatgagcggctaccagcatcacctcaaccccgaggcgctcaacctgacgcccgaggacgcggtggaggcgctcatcggcagcggccaccacggcgcgcaccacggcgcgcaccacccggcggccgccgcagcctacgaggctttccgcggcccgggcttcgcgggcggcggcggagcggacgacatgggcgccggccaccaccacggcgcgcaccacgccgcccaccaccaccacgccgcccaccaccaccaccaccaccaccaccaccatggcggcgcgggacacggcggtggcgcgggccaccacgtgcgcctggaggagcgcttctccgacgaccagctggtgtccatgtcggtgcgcgagctgaaccggcagctccgcggcttcagcaaggaggaggtcatccggctcaagcagaagcggcgcacgctcaagaaccgcggctacgcgcagtcctgccgcttcaagcgggtgcagcagcggcacattctggagagcgagaagtgccaactccagagccaggtggagcagctgaagctggaggtggggcgcctggccaaagagcgggacctgtacaaggagaaatacgagaagctggcgggccggggcggccccgggagcgcgggcggggccggtttcccgcgggagccttcgccgccgcaggccggtcccggcggggccaagggcacggccgacttcttcctgtaggcgccggaccccgagcccgcgccgccgtcgccggggacaagttcgcgcaggcctctcggggcctcggctcggactccgcggtacaggacgtggacaccaggcccggcccggccgtgctggccccggtgccaagtctgcgggcgcggggctggaggccccttcgctcccggtccccgttcgcgcgcgtcggcccgggtcgccgtcctgaggttgagcggagaacggtgatttctaaggaaacttgagccaggtctaacttctttccaagcgtccgcttgtacatacgttgaacgtggttctccgttcccaccttcgccctgccagcctagagggaccgcgctgccgtcccttcccgggtggcccctgcctgcccccgccctccttcgttctcttctcagcctccctttccttgccttttttaacttcccctccccgttttaaaatcggtcttattttcgaagtatttataattattatgcttggtgattagaaaagaaaaccttggaggaagccccttctttccccagccggggtccgccctcagtcgcgagtcacagcatgagtcgctcgccaggaggggcccggcccctgcctgccccctccccgcttgcccccgaccctgctaccggcgttccttggag

SEQ ID NO: 460090 - DNA, 1094 bp, Homo sapiens
cgccgcccgtcggggcgcggccgggcgcgggccccgggcgatggccgcggagctggcgatgggcgccgagctgcccagcagcccgctggccatcgagtacgtcaacgacttcgacctgatgaagttcgaggtgaagaaggagcctcccgaggccgagcgcttctgccaccgcctgccgccaggctcgctgtcctcgacgccgctcagcacgccctgctcctccgtgccctcctcgcccagcttctgcgcgcccagcccgggcaccggcggcggcggcggcgcggggggcggcggcggctcgtctcaggccgggggcgcccccgggccgccgagcgggggccccggcgccgtcgggggcacctcggggaagccggcgctggaggatctgtactggatgagcggctaccagcatcacctcaaccccgaggcgctcaacctgacgcccgaggacgcggtggaggcgctcatcggcagcggccaccacggcgcgcaccacggcgcgcaccacccggcggccgccgcagcctacgaggctttccgcggcccgggcttcgcgggcggcggcggagcggacgacatgggcgccggccaccaccacggcgcgcaccacgccgcccaccaccaccacgccgcccaccaccaccaccaccaccaccaccaccatggcggcgcgggacacggcggtggcgcgggccaccacgtgcgcctggaggagcgcttctccgacgaccagctggtgtccatgtcggtgcgcgagctgaaccggcagctccgcggcttcagcaaggaggaggtcatccggctcaagcagaagcggcgcacgctcaagaaccgcggctacgcgcagtcctgccgcttcaagcgggtgcagcagcggcacattctggagagcgagaagtgccaactccagagccaggtggagcagctgaagctggagggagaaggagcaaggtgaggaggcttctccaccgtgagtctcagacggagagctgtgccctcattcacctttggaacctctgacctgaggcaccttgagacgcaataatattaataccttaactgcaagactccgcgactcacagagagatgtaagt

SEQ ID NO: 460091 - DNA, 2661 bp, Homo sapiens
acatctgtttcctttacctggaggctggagcatccccagggtcagccagcctctgagatgttaagattttgtggccttggagtcagggaccaggggtggtggtggtggtggtaatgatgataagtagttgatggcagccatggtgatgctgtttatggtggtggtggtgttggtggcggtcatggtgatgatcgtggtgatgctggtggtggtgctcatggcgatgatggtagtgatgctggtggtggtggtcatggtgatggtcatggtgatgatggtgttgatgctggtggtggtggtcttggtgatgatggtggtgatgctggtggtggtggtcacggtgatgatagtggtgatcctagtggtggtggtcttggtgatgacagtggtgatgctggtggtggtggtggtcacggtgatgatagtggtgatcctagtggtggtggtcatggtgatgctggtggtgatgctggtggtggtggtggtcatggtggtcatggtgatgatggtggtgatgctggtggtggtggtcatggtgatgatggtggtgatgctgctggtggtggtggtcacggcgatgatagtggtgatcctagtggtggtggtcatggtgatgatgttggtgatgctggtgttggtggtggtcatgctggtggtggtgatgctggtggtggtgatcttggtgatggtggtgatgctggtggtggtcatggtgatgatggtggtgatgctggtggtggtggtcatggtgctgatggtgatgctcatggtggtgatcttggtgatgatggtgatgctggtgatggtggtcgtggtgatgctggtggtgatgctggtggtggtggtcatggtgatgatagtggtgatgctgtttttgttggtgatgatggtagtgattctattgatggtgatagtcatggtgattgatggtggtagtgatgtgactagcaatgatgctggtggtgatggtgtcagaggttttaagatgataaagggatgatgctagtcaagtctggcactccaccttggtgaacgctactgctctggccatgaacaaatattcttcctcatcccagccctgtgcagccttccctttgtttggaggaggttcctggctttccccttctagttcttgaaatttcatttctttcctcacatcccctcttgatgtaaagaaatcaacaccacacttggtgcccttgagaaaaattattttacccttgtatgtctcagctttctcatctgtaagttggatttatatgccctgcagatagacacgccctgcagggttgttgcagtggctcacagagaagaatgtaaaggtataaaagtccatacgcatacaagaattgttaccaacagcactgatggaatgggcttcctgatagtaatacctgggaacaccagcaccaccaaggctctggccatgcagggcactgtggctacagtagcaggtcattgtcactcctgctctgccctcacctccacccagcccctgcccatctgcttccctgctttgtgaggcttggtctaatagactgtcctacccccagctccattgtaaaaggaggccaggccagagacagcccagggtggctgcagaggagaaaggcacagaagcaaaggacaggtgcaaaggtcataattccactttattgccccgtcatttataagccctgtgctgcccgtgccagctgtgtttccacttgaaagttactcctggtgtttgttggaaattctggcacggtcccgcttaccctgagaggagacttgggctgcagtgtgggaacctctacactgctagaggtctggtcccgggcccatctgtgcatagcaggtaggacaccagcccatcagtggtcccaggcgaccaccctcagctgatagtggaacccctcctctttgagcccctgcttagaaaccaaagagtccctgaagcggacagagcatccccatgtccactccctcgacctggtgcaaattaatctcggcttttgtttgggcagcctggtgcccgagatgggggatgatgcccaaggccgctgttacctctcttgctttgtcactgcaccccctgtcctggaacatgtgagcccctggaaggtgtggcagggtccagcaccacctggaagcctgagactaacggcagctccggccacctggaacaccctctagagacctcccttcaccccactgacaggccctgcccagcccctggggggtgctggagagacagaggtagtggcattcactgggaacagactcctctccctgcaaccggcaggctgcctctgctccactgagcgggtgatggagcttggcggggttgtggggagcagggccagctggcaaaaaaaaggagagaggagacttttggagagaggagagttaggtaaggggatgggccaccaccctggacaggagagctttggggggcatctggagcaatgcaggtttaaagcagagatctgctttgatgagtgagggcccctccccctcgggtcaccccaacacttttagcagcaaacctcatgcctcctcaagtctgggggtaagatggtgtgtggacgagggtaggagggggcccaggcgcccccaggggtctgtcctgtgtggtgtgcaggtctcctgtcccctcctggccatgcccattgggcccat

SEQ ID NO: 460092 - DNA, 1417 bp, Homo sapiens
  misc_feature (1)..(2): n is a, c, g, or t
  misc_feature (5)..(5): n is a, c, g, or t
  misc_feature (10)..(10): n is a, c, g, or t
  misc_feature (13)..(15): n is a, c, g, or t
  misc_feature (18)..(18): n is a, c, g, or t
  misc_feature (21)..(21): n is a, c, g, or t
nnganattgnctnnnaancanatggttcagacatcgaaccatttctgcatcagctggtaaacagctgtggcctggagggctccttttggacctccctatgctgacccagcaactaaagaggatatttggttataaacagtgtgctctgaaggttaaagaacctccagggctccaggaactggacttctactgctgtaccttcaagtaccctccttggacagaactgggggctgaggccaaatcacagttcctgatctggattggcctgacctttgaacatgagatagggcaatcaatggggacgggcactaaaatgaactctaagaccctcccctcattgccaaggcttctagcacaacaagaatggcttgttcaggcctgcattcataagtggcaaagtacccctgattttgaaacatgtatggtcgtgatatcaagagtgacaacctgggcaaaagagagccattgcaaagaagaaaggcctttagggaaatggagcagaaagaggaagcagtaagatattgtctttagcgcctacaaccatatatggattggggtgctcagggaaggggcatttttttccaaaacagaagtgcaagtcttgacttggttcctgagtgtgaatagtgtgagttatatagtgggttcaggtctctgtttaccctgcttctccagcctgagttccttttttttctccattctgcttgttgaactcctgccaaactccgattttgacatcaaagcccaccttgaatgctgcttgtcgctaaagccatcgctggcatttccagacattgtcaatatctactggactaaagaaattctctactaatcagaaaaggaattggtctgtattgaagctggaaagaaaatcagaggagccaatgctgtcagagtgcatccaaggaccatttaaagatgtcctggccggaggtctgggctgtcaggtcctgccagcaggtagattccttccagagacattccttgacctgataccatcaaatcactttagtaggacaagtaactttccttattctcatttcatgcttgctagacaactgattatactttagttttggaagtaaatttcttacatgaaggaaataatctggtctcaggatgggatgtttaaaccccttgcagttctagtatggtaataaattggcattctgggctgtacatcagtccctcatgaccttgattagtgagactccatccctgagatccttattcattcttagtggaataaaacaaaatcatatttcacaacctgtgaggctgtgaatgatatcctattactgtggtgaatataataatggcaataactagcattcatagagcattgctttggttatctgttgctggatagcaaatcaccacttagtggcctaaatcagaaacaatcattttattattt

SEQ ID NO: 460093 - DNA, 1683 bp, Homo sapiens
tgtgaagtagctgttaactatatctaaaattataagctgagaaatggagaactatcttaatagctttctgtatcctatagcaaccagagtgccttgcagacctcatggctgctaccctgtcggaagatgccagacccggaatgtaactcaaatggagccaaaggaagactttccagagcaacctacacttgagatgagtcgtggatctgtgtcaaaagtcatttccatgaagatgatttcccatcaatctgatgtttactgtatgtcatcaaggcatatatctgagaaacaaacatacagtagcccagctcagtacacagaagatacagacaagcacaagtccttggatgaaagaagatcctggcttcagtccacacagtacatagagaagagaccagtgaagaataatctttcctcatggcaacttaaacaagaggaattccactggcatgctaaaacaaaattgtaatgacttaaaaattcagtgaatatgagggttggagatattacagtatataccttttcaagatatttgatgatttcagatggtattagatttatccaggatgatcattaaattgagccaatggatgattgcctgacagaaagaagaatacacttttaggataactatgtgtgaagttgtttgggccaataagcaacacgaagaaagagttcccagccccatttcaaactgaagtgttttaagaatatgaaatgtacctgatggaatcttagatggctatttttcctctgacataactaaattgactcatgtgtggcaaaacttcttcaatataaaacaaatcactttctcaaaccatgtttttgtccattgttcctgttaataaatgtcagcgatagactagaaagccagttagatgttaaaatatgtaagataaactgtagcttcatcctgaggcatttaagtttcctggcttttgtgtacaatttagattatattttccatttttgaggataattaattttggaaaattcttaagaatatacattcagttataggttgtatgatgtaaaggagatttgaagaaatagaatttgacatcactattacattaggttcactgagttcttgtatgcaaagtatatatacagaaaggcatcatgatatcttctaggttgatgcttcccaatctactaaaaatatgctaaatattgaggattgaaggcaaggaacaaagagaaggcaatcctaaaaaaatagcacttcaccccttttttcatccactgaactctggatttgtggctttatattcagttttaattatagaatgagaactctaagtagcttctaagatctcttccaatgtaacactgacttacctcactatattcctattaaatttttagaaatgaataatattaatttttcaaatatgtagaaaatgaacatgttaaaaagaactaactctcggtagaattttgccaaaattaaaacgtcctgaaagaagagtaggaaaatacaaagggaaaatcaaacaggagacatcttaactatcttagtccattttgcactgctataacagaatatctgagactgggtagtttataaataacagaaatttattttatcacagttctagaggctagaaagtccaagactgaggtgctacaggtttagctatccaatacatatgtttaattctataccaatatctattt

SEQ ID NO: 460094 - DNA, 753 bp, Homo sapiens
  misc_feature (741)..(742): n is a, c, g, or t
  misc_feature (744)..(749): n is a, c, g, or t
  misc_feature (751)..(751): n is a, c, g, or t
aacccgctcaggcggcgacggagccatgtcgccgctgctggggctccggtccgagctgcaggacacctgcacctcgctgggactgatgctgtcggtggtgctgctcatggggctggcccgcgtagtcgcccggcagcagctgcacaggccggtggcccacgccttcgtcctggagtttctagccaccttccagctctgctgctgcacccacgagctgcaactgctgagcgaacagcaccccgcgcaccccacctggacgctgacgctcgtctacttcttctcgcttgtgcatggcctgactctggtgggcacgtccagcaacccgtgcggcgtgatgatgcagatgatgctggggggcatgtcccccgagacgggtgcggtgaggctattggctcagctggttagtgccctgtgcagcaggtactgcacaagcgccttgtggagcttgggtctgacccagtatcacgtcagcgagaggagcttcgcttgcaagaatcccatccgagtcgacttgctcaaagcggtcatcacagaggccgtctgctcctttctcttccacagcgctctgctgcacttccaggaagtccgaaccaagcttcgtatccacctgctggctgcactcatcacctttttggtctatgcaggtggtatagatcgtttcggatactcttactgaaaaatgatcctggctttacaaagttcctttcgatttaaagcacaaggcacatgattggttagtannannnnnnangt

SEQ ID NO: 460095 - DNA, 1069 bp, Homo sapiens
tgtgaatcttggacccatatggacactgctgtatgttactgtcatgattctctgctcttccatgagttcagacttggcgccttattttacttctgagccactctctaccgtccagaaacatggtggacctgcagaactacattgttctgccaaacctgataatagaaacgatgtcagctgtgatcgcacagaaaatccagaagagttcagcagaggagacagctgtgtctattcagaaacagacagcaacaatttacattggaatcctcttattttgccacctatctcagaggacggtgctgaaaagacaacatggcctccgcctggtgttcctttggacagcccctcaggggtcctccagcagccccaggaaactggaggatgtgcaaacaaccagtcatcttctgacttcaagcctggatggaagatacagccagtgggaaacttgggcatagcaaccctagacctgctgttccggggtggagattctaccctatcagtggaggttatgaaagatcgttacactgggaaggctgcccatagaaaaccataattgaaggcattgcatgttgatcccaccaagagggccacactcaccttggaagtggttgagcctgtccaccggtcctgtgatgcgccctgtagtgagctctggattcacaggctggggcatgtgcagcagcacggactcactcctgcaaggaagtatgtcatttatgctccaagcagccacagcaagtattcaggggagtcatttccaggagtttctaacgctctgtttgatattgaaaggaaagtggacccatgcgaggctaagggagaagtgaagagaaagctttgttgcaaccttcactgtgcaggcagcttcagaggctttgaaacaagaagcctaagaggattccttagagaacctatattgaatttgtgtggtatgtcactcagaaagagtcatgatgggtatattgatgtattttaaaattagtatattagaaataaagatggatagtatatacagttatgtgagtgttcatatatttgtctgtgtatatattttttcttttattttctc

SEQ ID NO: 460096 - DNA, 450 bp, Homo sapiens
gctggagggtgctggggaagttcaggctgtccccagaagtcaacttatacgaccttcatgctggactacacatgtcatctcccggagcagcaggcggtggctgggacggcagcacagagaaagcccggcacaggctccgctcagagcctcaggatgtggggaggcttctacagatgaccagcttggtggcgtcatcatccccacctggaggaaggagaccttatctggaaccaagaggcatgtctgtaagaaactcttatgaagttgtcggggttcaagttggccttcctgttgttcaacctggtggagaatgttcctgtgggccttggcagcaagtcagcattcttcgttggcatggagtcctaggaaaaagaggctctccaccctgaagccagtcgcatatcaccccaataaacagttacaacgcctctgccaacacaggatcccaaa

SEQ ID NO: 460097 - DNA, 556 bp, Homo sapiens
ggccagtagccatcggttgggatgagtttcaggtttgtttttgtttttgctttaaaatatagtgcaaaataatttgaagcaaaattcccaggaatatcatctggggcaaagacaatcgaatgcttaatgaagtctattcctgagcctgctatttttatcccccgttcatctttgccagtgtcatctcccggagcagcaggcggtggctgggacggcagcacagagaaagcccggcacaggctccgctcagagcctcaggatgtggggaggcttctacagatgaccagcttggtggcgtcatcatccccacctggaggaaggagaccttatctggaaccaagaggcatgtctgtaagaaactcttatgaagttgtcggggttcaagttggccttcctgttgttcaacctggtggagaatgttcctgtgggccttggcagcaagtcagcattcttcgttggcatggagtcctaggaaaaagaggctctccaccctgaagccagtcgcatatcaccccaataaacagttacaacgcctctgccaacacaggatcccaaa

SEQ ID NO: 460098 - DNA, 1179 bp, Homo sapiens
ctcaagttatgactgtgccacttatgagccatgtgacctcaggaggacacctctttgaatctaagttattttgcggccctgagaagaaagatgcccaggtgtcactggagagggtagttcttatttacaagaacacatggagcctggtgagcaggcagccctcctccttggccttgactttatcacagcaaacaggcctgaccaagagctttccttcagacacttgcagctggctgggaaatgagtgtgatagaacccaaacattatcattcaaaggccgtattcacaaacgaagtgggatggccataaaactgatgaccttgctgcttctggaatctcataaaaagtttccaagctgctcctccccagagcaaataagggcgttgcagttgctagtcccctggcagggttccagctggggctattacattcctccctcataaatacagacttgtcggcctgacagggtgcttaactctggaggtgctgctgtgtttggagcatttaaacccagaggcaggggcgacgcagaaaaaaaaaaggcatcagagttgtcggggagcagcaggcttactctcgagattctccctgctgacctgatgaagtaagcagccttgtcgggaaagcctacatggcaaggaactgcaaatggcctctaggaactgtgagtggcctttaggagctgaagttggcctccaatcagcaagaagccagggcacttagtcctactgcagcaaggaaatacattctgccaaccatctgaatgagcttggaagtggattcttcccaagccaagcctccatataagaatgcagcccacctgacacattcataacagctgagcagaggacccaattaaaccgtgcctggactcttcatccacagaaacttcgagataatcaatgcatgttgcgttaagccatgacgtttgtgataattcgttatgcagcaataaatgactaacacactcctttacacagctctagtcagcttttctttatgtgcagccaaactgatacatagttggtggatacacagatgatcatctagggagacctcccaaaatgggaggaacgggaactgatgcttagagaagaagaataatgcttatgcctagagatagaatgtgctttttctgtggtcacaccatgacaaggcaacaagcccagtgtttactca

SEQ ID NO: 460099 - DNA, 1154 bp, Homo sapiens
  misc_feature (1)..(1): n is a, c, g, or t
  misc_feature (4)..(4): n is a, c, g, or t
ntcnttccaggagcctctctttccaccagcggaggaggagacagatgccttccagctgctggctggtccccaggaccccactgccactgagagctgacgagtggtcgagtgcacgcaagtatgtgcagcttggagaggtgcagtgacgtgcctgaggtctacggccccaaatggcagatgaggggctcaattccaggcttgtctgtggggtgccctccctggacacaaggactgccaaccctgtgtgaatgtgagcctcatgaaggagacaggtgagaagcctgagcgctggtggctgtaggctgctaaactgtaaatacagataatgtccaaagcactggtggctgtgagctcctcaactgtaaatacaaataacgtccaaagcgctggctgcccctttgccttccgccacgattgtaagtttcctgaggcctccccagaagccgagcagatgctggcagcatgcttcatgtatagcctgcagaacctgcccaggtgtgactacgaggctgcctgggacacagactgtgtgccctgggaaccctgcccagtggtgggaacccaggcaaaggagatgctgaagaactgtgcccagtggttcagcctcctgggaccagcagacagcatcccctgggaggatgtgggcccagccaaggggtcctctggggagatggggagctgccggggtttgaggctcaggccccggactgaccactgcagagcccagtggatcccaccccctgggtgcaatgctcctgggggcagagcctggagcagacacgccctcaacagatgcccctgatccctgcatttatggagcatgttgctgtgggccacggccccggagcacagggactttttactacctggcctccagtaccttgggcctacacgaattttgacgtagttatcatttgagggctgcgtccaggactgatggcaggcggcagggctcagcacagcgccccagggctccagctcagactcctgatcgccccagcctccatctacccctgagcagtccccgcacctcagttctctgagagccagcgtgggtctgccttgggaacagggcttcagccctgagggtttgccaagggtcctaagctgcagttgttccggggcatctggcccgctcaggtcactgggagtcc

SEQ ID NO: 460100 - DNA, 2678 bp, Homo sapiens
ggagatgtattcccaggacatggtgtgaatgacagacggcagcgtgctccgagccgacgcctcctgggagcaggcactgtgcctcctgtcctgcccgtagcttctcatcctaatattcctaccaacttcgttcttcattcttcccctaggaccacgacattgaccaagggcccagggtctctgaggccagaagtcactccggagactcagcagcctcagacgttttacttggtgcaccagaggctgactgatcagattggatggctaggggcctgggcttcatggagtgactgtttcaaaacttgttcacaccaacactgatcacaagacgctcattaacaaaccccagtgccaatctgttcatgtgttggtaaatacactgctccattcaccaaaatgctatgtctgccagccaggccactccccaaacccaagatagttacaagaaagaaatttggccaggccatggggtgaacatcagcaccagttccggggccgtgccaacctgcatgtgtttgaagactggtgtggcagctctatccagcagctcaggaggaacctgcatttcccactgtacccccatattcgcacaaccctgaggaagcttgctgtgtcccccaaatggaccaactatggcctccgcatctttggctacctgcacccctttactgatgggaaaatccagtttgccattgctgcagatgacaacgcggagttctggctgagcctcgatgaccaggtctcaggcctccagctgctggccagtgtgggcaagactggaaaggagtggaccgccccgggagagtttgggaaatttcggagccaaatttccaagccggtgagcctgtcagcctcccacaggtactacttcgaggtgctgcacaagcagaatgaggagggcaccgaccacgtggaagttgcatggcgacggaacgaccctggagccaagttcaccatcattgactccctctccctgtccctcttcacaaatgagacgttcctacagatggatgaggtgggccacatcccacagacagcagccagccacgtggactcctccaacgctcttcccagggatgagcagccgcccgctgacatgcttcggcctgacccccgggacaccctctatcgagtgcctctgatccccaagtcgcatctccgccacgtcctgcctgactgtccctacaaacccagctatctggtggatgggcttcctctgcagcgctaccagggactccggtttgttcatctgtcttttgtttaccccaatgactatacccgcctgagccacatggagacccacaataaatgtttctaccaggaaaacgcctactaccaagaccggtgagagacactgagtggggcaggaaggtgaccttgcagagggctctgcgggagccaggagagctgcctggaccagggttcagctttcaggagtacatcaagattgaccagcctgagaagcaggggctggagcagccagaagagtcccagtatggggaagtggcagaggagacccctgcctccaacaaccagaatgccaggatgcttgagggaagacagacacctgcctccaccctggagcaagatgccactgactaccgcctccgaagcctgcggaaactcctggctcagccccgggagggcctgctggcccccttctccaagcggaactccacagcgtccttcccagggaggaccagccacattccagtgcagcagccagagaagaggaagcaaaaacccagccctgagcccagccaagattcacctcattccgacaagtggcctcctgggcaccctgtgaagaacctgcctcagatgagggggcccaggcccaggcccgctggtgacagccccaggaagactcagtggctgaaccaggtggagtcgtacatcgcagagcagagacggggtgacaggatgcggcctcaggcccctggaaggggctggcatggggaggaggaagtggtggcggccgcaggccaggaaggacaagtggagggagaggaagagggggaagaagaggaggaggaagaggatatgagtgaggtgttcgagtacgtacctgtgtttgacccggtagtaaactgggaccagaccttcagtgcccggaatctcgacttccaagccctgaggactgactggatcgatctgagctgtaacacatctggcaacctgctgcttccagagcaggaagctctggaggtcacgcgagtcttcttgaagaagctcaaccagaggagccgggggtaaggtaaagggctctcctggggccagggactggggcacgtggcagccagctggcctggaaggcaggggcctaagggctggtagtgggttcccccagccgcggaaatagctggaactttgcccccgactcaggctcctgggaaggacaagtgcccggggcccctgtccctggagaggatcttgaccaggcaggtgtttgtcccgccattaggcaaggttctgaaatccctgggtgcctggcccagtacgtgtgttgaggactggaaggactcagtagatgaggtcccctcctccgaggaaagagctagtaaatagacaaacaggcaaaacagaggctagaaaaatacaaattaagaccctgcatgtgggctggaagggttagggcgtgatgcatgactggagttctttgtgttttcattcatcca

SEQ ID NO: 460101 - DNA, 499 bp, Homo sapiens
  misc_feature (472)..(472): n is a, c, g, or t
tcggcgcagcgccatggggagcccccgggccgcgcggcccccgctgctcctgcgcccggtgaagctgctgcggaggcgcttccggctgctgctggcgctcgccgtggtgtctgtggggctctggactctgtatctggaactggtggcgtcggcccaggtcggcgggaaccccctgaaccggaggtacggcagctggagagaactggccaaggctctggccagcaggaacattccagctgtggatccacacctccagttctaccatccccagaggctgagcctcgaggaccacgacattgaccaaggggtgagcagtaacagcagctacttgaagtggaacaagcctgtcccctggctctcagagttccggggccgtgccaacctgcatgtgtttgaagactggtgtggcagctctatccagcagctcaggaggaacctgcatttcccactgtacccccatagtgtgcacaancctgacaactcgcgtgatggtaccggc

SEQ ID NO: 460102 - DNA, 1706 bp, Homo sapiens
tggttctgtaggggagatgtggaccaggggcttgactcagggttgcatttggtccatagggcctgggatcactagcataacaaggggaatgagagccccatctgcatcaccacgtttcattcggcgctcagagcaacccttctctccctgccaagggcgggtccctagcagccctatgtgatcccagccaggggcaggcttaaccctggctggctgatttcttaccaagatctcactctcttactcctgctgctgatttttccacttccaggttcatctgtcttttgtttaccccaatgactatacccgcctgagccacatggagacccacaataaatgtttctaccaggaaaacgcctactaccaagaccggtgagagacactgagtggggcaggaaggtgaccttgcagagggctctgcgggagccaggagagctgcctggaccagggttcagctttcaggagtacatcaagattgaccagcctgagaagcaggggctggagcagccagaagagtcccagtatggggaagtggcagaggagacccctgcctccaacaaccagaatgccaggatgcttgagggaagacagacacctgcctccaccctggagcaagatgccactgactaccgcctccgaagcctgcggaaactcctggctcagccccgggagggcctgctggcccccttctccaagcggaactccacagcgtccttcccagggaggaccagccacattccagtgcagcagccagagaagaggaagcaaaaacccagccctgagcccagccaagattcacctcattccgacaagtggcctcctgggcaccctgtgaagaacctgcctcagatgagggggcccaggcccaggcccgctggtgacagccccaggaagactcagtggctgaaccaggtggagtcgtacatcgcagagcagagacggggtgacaggatgcggcctcaggcccctggaaggggctggcatggggaggaggaagtggtggcggccgcaggccaggaaggacaagtggagggagaggaagagggggaagaagaggaggaggaagaggatatgagtgaggtgttcgagtacgtacctgtgtttgacccggtagtaaactgggaccagaccttcagtgcccggaatctcgacttccaagccctgaggactgactggatcgatctgagctgtaacacatctggcaacctgctgcttccagagcaggaagctctggaggtcacgcgagtcttcttgaagaagctcaaccagaggagccgggggtaaggtaaagggctctcctggggccagggactggggcacgtggcagccagctggcctggaaggcaggggcctaagggctggtagtgggttcccccagccgcggaaatagctggaactttgcccccgactcaggctcctgggaaggacaagtgcccggggcccctgtccctggagaggatcttgaccaggcaggtgtttgtcccgccattaggcaaggttctgaaatccctgggtgcctggcccagtacgtgtgttgaggactggaaggactcagtagatgaggtcccctcctccgaggaaagagctagtaaatagacaaacaggcaaaacagaggctagaaaaatacaaattaagaccctgcatgtgggctggaagggttagggcgtgatgcatgactggagttctttgtgttttcattcatcca

SEQ ID NO: 460103 - DNA, 1948 bp, Homo sapiens
tgaggatcccggagcgtgttcatgctggtgggcagtgtggacaagactggaaaggagtggaccgccccgggagagtttgggaaatttcggagccaaatttccaagccggtgagcctgtcagcctcccacaggtactacttcgaggtgctgcacaagcagaatgaggagggcaccgaccacgtggaagttgcatggcgacggaacgaccctggagccaagttcaccatcattgactccctctccctgtccctcttcacaaatgagacgttcctacagatggatgaggtgggccacatcccacagacagcagccagccacgtggactcctccaacgctcttcccagggatgagcagccgcccgctgacatgcttcggcctgacccccgggacaccctctatcgagtgcctctgatccccaagtcgcatctccgccacgtcctgcctgactgtccctacaaacccagctatctggtggatgggcttcctctgcagcgctaccagggactccggtttgttcatctgtcttttgtttaccccaatgactatacccgcctgagccacatggagacccacaataaatgtttctaccaggaaaacgcctactaccaagaccggtgagagacactgagtggggcaggaaggtgaccttgcagagggctctgcgggagccaggagagctgcctggaccagggttcagctttcaggagtacatcaagattgaccagcctgagaagcaggggctggagcagccagaagagtcccagtatggggaagtggcagaggagacccctgcctccaacaaccagaatgccaggatgcttgagggaagacagacacctgcctccaccctggagcaagatgccactgactaccgcctccgaagcctgcggaaactcctggctcagccccgggagggcctgctggcccccttctccaagcggaactccacagcgtccttcccagggaggaccagccacattccagtgcagcagccagagaagaggaagcaaaaacccagccctgagcccagccaagattcacctcattccgacaagtggcctcctgggcaccctgtgaagaacctgcctcagatgagggggcccaggcccaggcccgctggtgacagccccaggaagactcagtggctgaaccaggtggagtcgtacatcgcagagcagagacggggtgacaggatgcggcctcaggcccctggaaggggctggcatggggaggaggaagtggtggcggccgcaggccaggaaggacaagtggagggagaggaagagggggaagaagaggaggaggaagaggatatgagtgaggtgttcgagtacgtacctgtgtttgacccggtagtaaactgggaccagaccttcagtgcccggaatctcgacttccaagccctgaggactgactggatcgatctgagctgtaacacatctggcaacctgctgcttccagagcaggaagctctggaggtcacgcgagtcttcttgaagaagctcaaccagaggagccgggggtaaggtaaagggctctcctggggccagggactggggcacgtggcagccagctggcctggaaggcaggggcctaagggctggtagtgggttcccccagccgcggaaatagctggaactttgcccccgactcaggctcctgggaaggacaagtgcccggggcccctgtccctggagaggatcttgaccaggcaggtgtttgtcccgccattaggcaaggttctgaaatccctgggtgcctggcccagtacgtgtgttgaggactggaaggactcagtagatgaggtcccctcctccgaggaaagagctagtaaatagacaaacaggcaaaacagaggctagaaaaatacaaattaagaccctgcatgtgggctggaagggttagggcgtgatgcatgactggagttctttgtgttttcattcatcca

SEQ ID NO: 460104 - DNA, 2274 bp, Homo sapiens
aaggtgtctgtacggcccggattacgggatgcagagcagaccttgtccccaaggccaggccatggggtgaacatcagcaccagttccggggccgtgccaacctgcatgtgtttgaagactggtgtggcagctctatccagcagctcaggaggaacctgcatttcccactgtacccccatattcgcacaaccctgaggaagcttgctgtgtcccccaaatggaccaactatggcctccgcatctttggctacctgcacccctttactgatgggaaaatccagtttgccattgctgcagatgacaacgcggagttctggctgagcctcgatgaccaggtctcaggcctccagctgctggccagtgtgggcaagactggaaaggagtggaccgccccgggagagtttgggaaatttcggagccaaatttccaagccggtgagcctgtcagcctcccacaggtactacttcgaggtgctgcacaagcagaatgaggagggcaccgaccacgtggaagttgcatggcgacggaacgaccctggagccaagttcaccatcattgactccctctccctgtccctcttcacaaatgagacgttcctacagatggatgaggtgggccacatcccacagacagcagccagccacgtggactcctccaacgctcttcccagggatgagcagccgcccgctgacatgcttcggcctgacccccgggacaccctctatcgagtgcctctgatccccaagtcgcatctccgccacgtcctgcctgactgtccctacaaacccagctatctggtggatgggcttcctctgcagcgctaccagggactccggtttgttcatctgtcttttgtttaccccaatgactatacccgcctgagccacatggagacccacaataaatgtttctaccaggaaaacgcctactaccaagaccggtgagagacactgagtggggcaggaaggtgaccttgcagagggctctgcgggagccaggagagctgcctggaccagggttcagctttcaggagtacatcaagattgaccagcctgagaagcaggggctggagcagccagaagagtcccagtatggggaagtggcagaggagacccctgcctccaacaaccagaatgccaggatgcttgagggaagacagacacctgcctccaccctggagcaagatgccactgactaccgcctccgaagcctgcggaaactcctggctcagccccgggagggcctgctggcccccttctccaagcggaactccacagcgtccttcccagggaggaccagccacattccagtgcagcagccagagaagaggaagcaaaaacccagccctgagcccagccaagattcacctcattccgacaagtggcctcctgggcaccctgtgaagaacctgcctcagatgagggggcccaggcccaggcccgctggtgacagccccaggaagactcagtggctgaaccaggtggagtcgtacatcgcagagcagagacggggtgacaggatgcggcctcaggcccctggaaggggctggcatggggaggaggaagtggtggcggccgcaggccaggaaggacaagtggagggagaggaagagggggaagaagaggaggaggaagaggatatgagtgaggtgttcgagtacgtacctgtgtttgacccggtagtaaactgggaccagaccttcagtgcccggaatctcgacttccaagccctgaggactgactggatcgatctgagctgtaacacatctggcaacctgctgcttccagagcaggaagctctggaggtcacgcgagtcttcttgaagaagctcaaccagaggagccgggggtaaggtaaagggctctcctggggccagggactggggcacgtggcagccagctggcctggaaggcaggggcctaagggctggtagtgggttcccccagccgcggaaatagctggaactttgcccccgactcaggctcctgggaaggacaagtgcccggggcccctgtccctggagaggatcttgaccaggcaggtgtttgtcccgccattaggcaaggttctgaaatccctgggtgcctggcccagtacgtgtgttgaggactggaaggactcagtagatgaggtcccctcctccgaggaaagagctagtaaatagacaaacaggcaaaacagaggctagaaaaatacaaattaagaccctgcatgtgggctggaagggttagggcgtgatgcatgactggagttctttgtgttttcattcatcca

SEQ ID NO: 460105 - DNA, 2555 bp, Homo sapiens
tcggcgcagcgccatggggagcccccgggccgcgcggcccccgctgctcctgcgcccggtgaagctgctgcggaggcgcttccggctgctgctggcgctcgccgtggtgtctgtggggctctggactctgtatctggaactggtggcgtcggcccaggtcggcgggaaccccctgaaccggaggtacggcagctggagagaactggccaaggctctggccagcaggaacattccagctgtggatccacacctccagttctaccatccccagaggctgagcctcgaggaccacgacattgaccaaggggtgagcagtaacagcagctacttgaagtggaacaagcctgtcccctggctctcagagttccggggccgtgccaacctgcatgtgtttgaagactggtgtggcagctctatccagcagctcaggaggaacctgcatttcccactgtacccccatattcgcacaaccctgaggaagcttgctgtgtcccccaaatggaccaactatggcctccgcatctttggctacctgcacccctttactgatgggaaaatccagtttgccattgctgcagatgacaacgcggagttctggctgagcctcgatgaccaggtctcaggcctccagctgctggccagtgtgggcaagactggaaaggagtggaccgccccgggagagtttgggaaatttcggagccaaatttccaagccggtgagcctgtcagcctcccacaggtactacttcgaggtgctgcacaagcagaatgaggagggcaccgaccacgtggaagttgcatggcgacggaacgaccctggagccaagttcaccatcattgactccctctccctgtccctcttcacaaatgagacgttcctacagatggatgaggtgggccacatcccacagacagcagccagccacgtggactcctccaacgctcttcccagggatgagcagccgcccgctgacatgcttcggcctgacccccgggacaccctctatcgagtgcctctgatccccaagtcgcatctccgccacgtcctgcctgactgtccctacaaacccagctatctggtggatgggcttcctctgcagcgctaccagggactccggtttgttcatctgtcttttgtttaccccaatgactatacccgcctgagccacatggagacccacaataaatgtttctaccaggaaaacgcctactaccaagaccggtgagagacactgagtggggcaggaaggtgaccttgcagagggctctgcgggagccaggagagctgcctggaccagggttcagctttcaggagtacatcaagattgaccagcctgagaagcaggggctggagcagccagaagagtcccagtatggggaagtggcagaggagacccctgcctccaacaaccagaatgccaggatgcttgagggaagacagacacctgcctccaccctggagcaagatgccactgactaccgcctccgaagcctgcggaaactcctggctcagccccgggagggcctgctggcccccttctccaagcggaactccacagcgtccttcccagggaggaccagccacattccagtgcagcagccagagaagaggaagcaaaaacccagccctgagcccagccaagattcacctcattccgacaagtggcctcctgggcaccctgtgaagaacctgcctcagatgagggggcccaggcccaggcccgctggtgacagccccaggaagactcagtggctgaaccaggtggagtcgtacatcgcagagcagagacggggtgacaggatgcggcctcaggcccctggaaggggctggcatggggaggaggaagtggtggcggccgcaggccaggaaggacaagtggagggagaggaagagggggaagaagaggaggaggaagaggatatgagtgaggtgttcgagtacgtacctgtgtttgacccggtagtaaactgggaccagaccttcagtgcccggaatctcgacttccaagccctgaggactgactggatcgatctgagctgtaacacatctggcaacctgctgcttccagagcaggaagctctggaggtcacgcgagtcttcttgaagaagctcaaccagaggagccgggggtaaggtaaagggctctcctggggccagggactggggcacgtggcagccagctggcctggaaggcaggggcctaagggctggtagtgggttcccccagccgcggaaatagctggaactttgcccccgactcaggctcctgggaaggacaagtgcccggggcccctgtccctggagaggatcttgaccaggcaggtgtttgtcccgccattaggcaaggttctgaaatccctgggtgcctggcccagtacgtgtgttgaggactggaaggactcagtagatgaggtcccctcctccgaggaaagagctagtaaatagacaaacaggcaaaacagaggctagaaaaatacaaattaagaccctgcatgtgggctggaagggttagggcgtgatgcatgactggagttctttgtgttttcattcatcca

SEQ ID NO: 460106 - DNA, 343 bp, Homo sapiens
atgagacgttcctacagatggatgaggtgggccacatcccacagacagcagccagccacgtggactcctccaacgctcttcccagggatgagcagccgcccgctgacatgcttcggcctgacccccgggacaccctctatcgaggtaaggcctcggccagcgcttggcgtcctttctggggacactgcactgccaggtccactgctgatggtggagaaggcttgagagacctgccaagtatcccaatcaccgtagaactttttatcgtccttgtaacatagaacatgcatacagaaaagagagcatgtaaataagtataaaatatttacgtgtaattttacaa

SEQ ID NO: 460107 - DNA, 562 bp, Homo sapiens
ttattactatatgtcaagttaagtaaatgtgagcaggcttcagccaaaccaactgacaggcggtggaggggaaagattaagattctggatgtaccaggcaccattgtgagaggtaaccagttggctgagttgtgtggtcatggcatttgtggtgtcatagccaaagaattgttatgctgtgctctgtgctggggctcccatttgcactttcccagacctttccttcccacggcgctgctctgtaattagatgtagttccctcagagcggaccaccgagagcccaggccaaggccgaaatggccgagccttcctctgcatctgggcagcctgtgatgcaccaggtcaggcatggcgggaatgggaggacttctgcatactgcattcttcactcttaaaaaagcaggcatcggccaggcgcggtggctcacgcctgtaatcccagcactttgggaggctgaggcgggtggatcatgaggtcaggagatcgagaccatcctggctaacaaggtgaaaccctgtctctactaaaaatacaaaaaaaaagtcgatgcggtggcgggc

SEQ ID NO: 460108 - DNA, 1418 bp, Homo sapiens
ttattactatatgtcaagttaagtaaatgtgagcaggcttcagccaaaccaactgacaggcggtggaggggaaagattaagattctggatgtaccaggcaccattgtgagaggtaaccagttggctgagttgtgtggtcatggcatttgtggtgtcatagccaaagaattgttatgctgtgctctgtgctggggctcccatttgcactttcccagacctttccttcccacggcgctgctctgtaattagatgtagttccctcagagcggaccaccgagagcccaggccaaggccgaaatggccgagccttcctctgcatctgggcagcctgtgatgcaccaggtcaggcatggcgggaatgggaggacttctgcatactgcattcttcactcttaaaaaagcaggcatcggccaggcgcggtggctcacgcctgtaatcccagcactttgggaggctgaggcgggtggatcatgaggtcaggagatcgagaccatcctggctaacaagacatgaaaacccctcatggaccattccggagccatgccagaaaattacccttgctaattacaatgaaataaagagtacttctgtgccaagcagcaagcctatgctatctctacagcaactgtcagggaaaaagcaatccagagtcgcattaaaagagagaactcagatgtctttaccttggtggatgccctttctgcctgcagatgggtcagcagagcccagcgggaagcccatggatagtcagagaagagatgagcaggaagctcgcggacttgttgctacagcaccagccacagggagtcattttcagcacacatccaacatcacccatgaccagaacctggcgcggccaggaactctgcagggtgctctaaaaggccacacccctccttcggcacttgtattcttcatcacgctctcagccccggatggtttctgtctacttccaaagaaagagaaaatcagccattataagaacagtcgaacaaatgagcatcaagctttgaagcctgttccaaaaagaagacagtgaggattcaattacaaaaaatttacctgtcttgcctgtcccattcatgaggtcccagctctgtggcccagtgtttgctctgcttatgagaggcattggcagaaggccctgcccaggctgggttctgatgacaggcacccctcgtcacactccagtggactcttctgacagagtcaggacccctgggggcagaatcctgtgacctaattgagtggcaaccccatttcagccatgtcactgccaccagcagggccccgggctctgtatagccacctcagacagtctctctcaaagcagggcttgggtccccatagcctctcttggctgaggtcacgtctccatttccctccaatgctcctccccaactaccacctctgcaca

SEQ ID NO: 460109 - DNA, 558 bp, Homo sapiens
acttccttttctcaatactatatgaggttcctggctttgcccaggaaacaattcaagggcaagctggaagtgaaagtaaacaggccaggcatggtgggagttactacccctttccatggcaatgaccccacgacccaaaattgtgagagaaggtctgctgtggacaaaatgctaccaaacagcatcgcgtgctacggagaaatcttttgtgaaaggaagaagctcaatgtggccagctttattctgggcataagagcaaaactccatctcaaaaaaaaaaaaaaaaaggaagaaattgccacagccacctcagccttcagccaccaccaccctgatcagtcagcagccacaaacaagaccttccaccagcaaagagatcccaacttcctcaagcctcaggtgattgctggcactttctatcagtatcttagttttttgtttgtttgttttttaatttttgagacagagtctcactctcttgcccaggctggaatgtatgagccgagatcacgccactgcactccagcctggatgacagagcaagactccgtctcaaaa

SEQ ID NO: 460110 - DNA, 905 bp, Homo sapiens
acttccttttctcaatactatatgaggttcctggctttgcccaggaaacaattcaagggcaagctggaagtgaaagtaaacaggccaggcatggtgggagttactacccctttccatggcaatgaccccacgacccaaaattgtgagagaaggtctgctgtggacaaaatgctaccaaacagcatcgcgtgctacggagaaatcttttgtgaaaggaagaagctcaatgtggccagctttattctgggcataagagcaaaactccatctcaaaaaaaaaaaaaaaaaggaagaaattgccacagccacctcagccttcagccaccaccaccctgatcagtcagcagccacaaacaagaccttccaccagcaaagagatcccaacttcctcaagcctcagcactaccgaggttgacgcagctagatggttttctccccggctggttgctgcttctcacccacagaggcggtggagcccttggaactgggcagaacacagggctgccttgtcaccactgcctggctgaacctgaaattgggccgtttgacagaaagacttgaaagggccaccagtaaattcttttttcttttcattgattttcctcttcttactttcctcctcctgaagttggggtcatgtcccaagaagacccacaaggcctggcctgtgggtgcacatgtggggagggtcaggtctgtcggctgaggagggcattggtaggggactttgagcagtgctgctccggagacacgaatgatgggatgggaggctctcccatatctgccgagagcacagcaccccatgactcctgggagcttgtcatagatgctgcagatgagtccttcctcagacgggatatttgctaatgcctctgccagcctgggcttgtcttctcagggcctttc

SEQ ID NO: 460111 - DNA, 1201 bp, Homo sapiens
tgggcttggaatcagacccagctgggtttgagtctttttttattttaatttttgtttttattttttggagaagctcccattctctgaaaaggtctcactaggttgtccaggctggtctcgaactactgagctcaagggatcctcccgccttggcctcccaaagtgctgggattataggtgtgagccactgtgcctggcctaaaactcattattgaattattcactggtgttggctttggggttacctgtctacatcctgtgacctacctaaaggaagccacagcacctggcctgggtttgtcttaactctgttggggtctcagttatctcatctagatatataatgggatgattggcttagatgatctcccagccccaacatcccagcccatcctatgggcttcgtcattgctgggctgcctgcacccatccccttgggctcccatatccttcacctttggaccttctgctcctcattccaccccattccttagggaaactggctgactgtgctcagctgctggacgtggatgacatggtgcggttggctgtgcccgactccaagtgcgtctacacatacatccaggaactgtaccgcagccttgtgcagaaaggactggtgaagaccaagaagaagtgaggaggtgactggctctgtgggcagagatgggcagggtgcccagctcagcagccacggcccgggggttcccttctgctccatggaggcaccagagccaggggcttaggcaagggtgtgtggcgttggttttaactgcattaaaagtacttttgtaaaatcctgtctggcccctcagtgctctctccatacttggcccaggaacctctgcactctgggataataaactctggccataggggattcctcacctgctgaggtctcaataactgcgcaaggtgtttgggaaaggacaatggcctggttcccaccactaaccagctgtgtgacacatacagttaacctctctgggccccagtttacagtctgaaaggggataatgagagttccaaccttatgaaggtgttgcaagagttaaacgagataatgaaatgggcaaaaagctttgcccagtcctgccactcaagtgttcagtaagtggtcgccaaaaataaaaaacttacattttgactctggtggcacttcttctggttatcttcccctcttttcacacttcttctcagg

SEQ ID NO: 460112 - DNA, 2196 bp, Homo sapiens
agcctggagggtggaaagctgaggtgataaacacgcaggatagccgaggagccaagactgaaccacggacttcctgactcccaggccagagctctctgagggtggggtcttcacctcatgctgggctggggcatgaccaggtctgcttgtcttctctttccagagatggagcagaaggaagggaagctctctgaggatgggaccaccgtctccccagctgcggacaaccctgagatgtcaggaggtggagcccctgcagaggagaccaaaggcacagctggaaaggccatcaatgaggggcctcccactgagtcaggaaagcaggaaaaggcaccagccgaggacggcatgtcagcagaactccagggggaagcaaatggattagatgaggtcaaagtggaatctcagagggaggctggtgggaaagaggatgctgaggctgaacttaaaaaggaggatggtgagaaggaagagaccactgtgggttctcaggagatgactggcaggaaagaagagaccaaatctgaacccaaagaggctgaggaaaaggagagcacgctggcctctgagaagcagaaggctgaggagaaagaggccaaacctgaatctgggcagaaagccgatgccaatgacagagacaagcctgaacctaaggcaacagttgaggaggaggacgccaagacagcctctcaggaggagacaggccagaggaaagagtgcagcactgaacccaaggagaaggctactgatgaagaggccaaggctgaatcgcagaaggctgttgtggaggatgaggctaaggctgaacccaaggagcccgatgggaaagaggaggccaaacatggtgcaaaagaggaggctgatgcaaaagaggaggcggaggatgcagaggaggcagagccaggcagtcccagcgaagagcaggagcaggacgtggaaaaagagccagagggaggggcaggggtgattcccagctccccagaggagtggcctgagagccccactggggaggggcacaacctcagcacagatgggctgggtccagactgtgtagcttccggacagaccagtccttcagccagcgacgtgccccagagtccccctgagtccccttcctcaggggagaagaaggagaaggcaccagagcgcagggtatcagcccctgctcggccccgggggccccgggcacagaaccgcaaagccatcgtggacaagtttggcggggcagcttccggccccacggccttgttccgcaacactaaggcagccggggcagccattggtggtgtcaagaacatgctcttggagtggtgccgagccatgacaaaaaaatacgagcatgtggacatccagaacttctcctccagctggagcagtggtatggccttctgtgccctcatccacaagttcttccctgacgcctttgactacgcagagctggatcccgcaaagcgccggcacaacttcaccctggccttctccacagcagagaaactggctgactgtgctcagctgctggacgtggatgacatggtgcggttggctgtgcccgactccaagtgcgtctacacatacatccaggaactgtaccgcagccttgtgcagaaaggactggtgaagaccaagaagaagtgaggaggtgactggctctgtgggcagagatgggcagggtgcccagctcagcagccacggcccgggggttcccttctgctccatggaggcaccagagccaggggcttaggcaagggtgtgtggcgttggttttaactgcattaaaagtacttttgtaaaatcctgtctggcccctcagtgctctctccatacttggcccaggaacctctgcactctgggataataaactctggccataggggattcctcacctgctgaggtctcaataactgcgcaaggtgtttgggaaaggacaatggcctggttcccaccactaaccagctgtgtgacacatacagttaacctctctgggccccagtttacagtctgaaaggggataatgagagttccaaccttatgaaggtgttgcaagagttaaacgagataatgaaatgggcaaaaagctttgcccagtcctgccactcaagtgttcagtaagtggtcgccaaaaataaaaaacttacattttgactctggtggcacttcttctggttatcttcccctcttttcacacttcttctcagg

SEQ ID NO: 460113 - DNA, 824 bp, Homo sapiens
acagacaagttgcattcactgctaacttaatcatggtccagctcactgtaaagagtacatgtcagagaggaggtagcagagccatgtgcgtctgtcatggaggtggggggaggatgcaagggctttttccagtgaagaaaatgaaaactgattcaaactgtgagcagtgttttgtaaacatgtctcatggcaaggatgataatgatagagacaggaaacagccaagggtccccagcgaaaccccaccttcaaacctaaaacagcctgaaggctggaaaattggactgccgccggctttgctcgtctttgagccttcagctcagatgtcacttcctggaggagcctttcttaatggtacagaatgtggaattggagctggtaatgacgacgtcaggacaggttcaaaggaagcccatcacttgagtaaaaatttatagccctgcttgtgctgtgctgtgctgtgctgtgagtttcagttccgggccagcaaaagatttatcaaaggaaagcaacaaggtaagaaaaattaatttcagagaggaaaataaagttgcttgaggggctcttcaatgaccaaaggccataagagactggaaggcaaaaggacccattaatgtaatccaaacatcagtctcctgcagcaaagaggtgaatggagaagggtggagagtagctgtggacgagtgaaaaagacatcgcaccatgtcttcaaattacatccagcaacttcatatgaactatgaaacccttgttgccacaatagtccctctttgtttgaactactacaagaataaagaaatttctttctaatcttttgcagaaga

SEQ ID NO: 460114 - DNA, 366 bp, Homo sapiens
tttggacacagactggtacagaaggaagaccatgtgaaaacacaagatgtcaaagcaagtaagaaaaattaatttcagagaggaaaataaagttgcttgaggggctcttcaatgaccaaaggccataagagactggaaggcaaaaggacccattaatgtaatccaaacatcagtctcctgcagcaaagaggtgaatggagaagggtggagagtagctgtggacgagtgaaaaagacatcgcaccatgtcttcaaattacatccagcaacttcatatgaactatgaaacccttgttgccacaatagtccctctttgtttgaactactacaagaataaagaaatttctttctaatcttttgcagaaga

SEQ ID NO: 460115 - DNA, 1036 bp, Homo sapiens
ggacacttctgagcactagcacagcccactgcttcagtctggcttgctctgcctttctacagcagtgctatggtttccctgcctctgattttgattcaaaaccttttcattgctctgtccatccctgtcgattcaagtatagctgtcgactggagcacaacatctacaagccagggaggacccctggagggtggcaggggccactcttggaagacagagaagtgggcatcatttggaatggatgtgagaactatcctcattgcaacttcacagagtgctgaggaaaggcaacaaaaagggagtatggagaaaaataagaattttaataacagtgttcagaaccttcaggagtccatgttcatgcagtgcagggattggcagacttctctaaaggaccagataataaatatctcaggctttgccaacctatacctacaatctagttgcaactactccactctgacatcgtaagacaaaagcaggcataaacaaatgggcatggctgtgttctgataaaactttatttagagacaatgacactttaatttcaaataatttgcacaagtcatgaaatatgattcttctttaattttttcaaccacttaaaaatatgaaattcattgtgagcccacaagctattcgtaaacctacctgccttaatctgctgatccctagtgacatgaaatgagacaataagagtcaacactggctttgagatatttttcatcctggctgtagtgcagtggcgcggtcttggctcaccacaacctctgcctcccaggttcaactgattctcctccctcagcctcccaagtagctagaattacaggtgtgtaccaccatacctggctaattttattttgcatttttagtagagacagggtttcaccatgttggccaggctggtcttgaactcctgacctcaagtgatctgcctgccttggcctcccaaagtgctgggattacaggcgtgagtccccgtgcctgtctggccccattctaaaactggtatcaatcccgttgttccttttgccca

SEQ ID NO: 460116 - DNA, 3321 bp, Homo sapiens
cagtgactttctgtgtcattcagaagcaaaaacattagtaatgctaacacagtgttttgaaaaaggacggatcagatgccatcagtattggccagaggacaacaagccagttactgtctttggagatatagtgattacaaagctaatggaggatgttcaaatagattggactatcagggatctgaaaattgaaaggcatggggattgcatgactgttcgacagtgtaactttactgcctggccagagcatggggttcctgagaacagcgcccctctaattcactttgtgaagttggttcgagcaagcagggcacatgacaccacacctatgattgttcactgcagtgctggagttggaagaactggagtttttattgctctggaccatttaacacaacatataaatgaccatgattttgtggatatatatggactagtagctgaactgagaagtgaaagaatgtgcatggtgcagaatctggaccagatacttgatcttaagcaggccacatatccaggtgactaacagatttattggttaaacatattttaaatgcgctgatgatgtatagatatgctgactcacagatttcaaaagtaaatttagcatttgtattccaacagtcattctaacaagaaaactgtaagagaatttaccaattaggtctaacaggaaaaaaactcataaacaaatttatgtaatataattttctacttcttatgataacagcaagaaagaatatattaatacttggtgtttagtgacaagtgttagaaaaaaacttgaagcttcaagagaccacaggaatttagaaagcctcctatttgaaatggtagaaaatcatatctatactatgataaattctgtgtctgtaacttagctatttatttgatgaattcagtactgcttttagctttaacaatataactccctttatgaaactcttcatcaatatatttgtttaaccactctgtctttggtgtctaggcacagtatatctttttacaccagtgcattctggatctcttatcaaataagggaagtaatcagcccatctgttttgttaactattcagcacttcagaagatggactctttggacgccatggaagcaaaaatgtatcaaaagagtaataaaaacactgtgcgtgtttcaagcttgtaaaccaatgatgtgctgctgtggtgccaacagagacttccaaatggattatgttaaatggccgtcatttcatttcccaaggttgattttgagcagtatacttggtggaactgaaaacaaagaaattaaccatgtatagcaaattcaaggtttctttatagaaaatctttcagcctccatcttattaaatagtgacaatgtggtaagttttgaattacatgaactcattttgtcatagatttcaattaagagtaataaatagtattaattattctcttctatgataagaagtatatcttatgcttatttccgctggaacatatatatataagaaatgctatggccaataaaattgaattttaatgaattatcttgcagcataatttcagaagttcctatataaataaaaatttgattttgtatctcctattaagacataataattatactaatcctcacataaaatacataaaataaagatatacctacaagtataatatgacataatttatgtaatataatataaataattaagatataattatttcttaagacatccataagtaattttaatgtgggatatactatccaagaaattaaagaccttagtctcacagtctctagaaaagtgtaaaatttacttcctttttttttcatggcaaggaagtacaaataaatacaatccactactgttccagctaataagtttatagaaagttaccgaaaacaataaaaaatgatgagaactctaaaagattcaagttggggttatacgttctttagtttcctttatgtcaattatggaaaatatatggcaagccagtatggggttttgtactcgttaaagacaaataacataaccggtgggaagtattggtgaggctgctccttgttagaaaagaaataatttgggggctgctttttattagaagggaaatcttgccaaggactcttttaccttccctatttgcctaaataatttctttctagctcctgtgtcaatattgatagcagttatgatgtttttttctgtaagaattcaaatatgccaaaaatatgacctattgattcacacagccacttgaaaaatatacagaatacagaattataatcataatgattagtttcaaattagcctagtgggaatagagggaattcttccttggtttttagtggaatttcacattcagtatttttcttttaactttaaaaaaggaaaacaaagtaaatatgattattgactttgaggcatttccaacctaattccttgttatataaaccgcatttttctaaattttaatctttataatattcaaataaagtttttccaagcaaaaataatatttttaaaagaagtacagcacttttaaatttttttatatcttcatttcaaacccatatatctcttggttaaaaaaaagataattacagttttaagtaaaaataaatgattcaatagatgataaatataacctcaaaatactgaaatataccaaagaaatttaatgtatttattacaaactagacatacctgtaaaataatagaagttttagatcaggaagataaattaatgatatgaaaataaaataaatgaattagaaaatctacacatatgaattaatatttctctagggagagaaattcttataccctaaaaaaagaacacgtattcttttgacgttctcatggatcagtcacaaagaatgactgcttcctgtgtcacaaagaaagttgaaaataatttcagactcagtatcatacatagccatttatctgactacaagacagttaagtaaaacatttacaaaaaaataatttttaatctatatttgaaactaaattaatacatatctaaatatcacacagattaatatgaagaatctcaatgaaaactatataacagaattgaatgatatcaaagcaccttttataaaattttgataaagttacataaaggtaaggttagaggcctaaaatatatatcctcaaatataaacatagtaagcatttacttgagaagctggaaaaagtacaatagagaaaatctaatgacataatgagatctcatttgtgaccaaattatgtgtgagctattcactggcaggcagagaggatatttatgtgcatgaaacacttttggagaaaatatggaattgac

SEQ ID NO: 460117 - DNA, 977 bp, Homo sapiens
actgtaggaattttgaaagtgcaaaaggccaacccaaaattctaccaacaaaggtaacctactggcatttgggtatattttttctctgggccttgtcctccgcctttatctgatgctgcagatgtaattctgtgttccgcttgtttgcttcatgttgtgttatgaacatgtccccctcaaatctccctgggagccttccagcgatcagccccctttgactgtgtggctctggccttggggaagagctgagggtctcctgccctaacggatggtttcagggtgtgaaggtcaaaggcctcatcctcatcagcccccagaaccctctgggtgatgtatactcccctgaagagctacaggagtacctggtatttgccaagaggcacaggctgcatgtgattgtggatgaggtctacatgctgtccgtgtttgagaagtctgttgggtaccgcagtgtcctaagcctggaaaggtgaggctccctgacacagctaactcccccagtccctattatcccacggagccctggccactttctggctcagcccacagggcatggcctgcccagagcaattccatttccacccagctggtcccactggtcctcagatctaatgagaagcagggacggttgggctagattagtgattttcaagttgttctgtggaatttctgagaactccaagaagaggcctcaggatcccttaagttagggctgagtggatggcaaattggcctctttgctgtttcctttacctccagagtcgctccagttttattcattcattcatttactcattcatgctctcattcactcagcacctctggagccccttacacacagagtgtgccaaacacctctggatatttaaatgttgggctttttcattaggtttactgtaagcaaagcatttgtggccaaaatacctttgggaacacttggagcagatcatcctcaaggcacactggcccatgcctgt

SEQ ID NO: 460118 - DNA, 1485 bp, Homo sapiens
actgtaggaattttgaaagtgcaaaaggccaacccaaaattctaccaacaaaggtaacctactggcatttgggtatattttttctctgggccttgtcctccgcctttatctgatgctgcagatgtaattctgtgttccgcttgtttgcttcatgttgtgttatgaacatgtccccctcaaatctccctgggagccttccagcgatcagccccctttgactgtgtggctctggccttggggaagagctgagggtctcctgccctaacggatggtttcagggtgtgaaggtcaaaggcctcatcctcatcagcccccagaaccctctgggtgatgtatactcccctgaagagctacaggagtacctggtatttgccaagaggcacaggctgcatgtgattgtggatgaggtctacatgctgtccgtgtttgagaagtctgttgggtaccgcagtgtcctaagcctggaaaggctccctgacccccagaggacccatgtgatgtgggcaaccagcaaggacttcgggatgtctgggctccgctttggcacgctgtacacagaaaaccaggatgtggccactgccgtggcttccctctgccgctaccacggcctcagtggcttggtccagtaccagatggcacagctgctccgggaccgtgactggatcaaccaggtgtacctgccggaaaaccatgcccggctcaaggctgcccacacctatgtctcagaagagcttagggcattggggatccccttcttgagtcgtggggctggcttcttcatctgggttgacttgagaaagtacctgctcaagggcacctttgaggaggaaatgctgctctggcgccgctttttggacaacaaggtgctgctgtcctttggcaaggccttcgagtgtaaagagcctggttggtttcgctttgtcttctcagaccaggtccaccggctttgcctggggatgcagagggtccagcaggtgcttgcaggcaaatcccaagtggcagaagacccccgtccctctcagagccaggagccaagtgaccaacgcaggtgagctggtcattgtctcgtggccagagggcccagcagccactgtggacctggggcgttctggggctgcagaagactgactgtggatgtgccatttgccaggaaggtatctaacttggctttgtgcctgaagaactgtttcttgtctttcgctgtagcagtgggaaactccttaagctgtggttcagcctgggccctccctctctcctattaaacaaaactaggagagtccatatgtctccattatatgtgccattttcttcatctctcctctccctctcttaacttctctttcctatatttaattcgtttcctgtctttcagatcgatcgttgttgtttctaacctactatttaacttatgcattgacttttcaatttcaatgtttatatttagtacattttcagtctccttggtcttttaaaaatataacatct

SEQ ID NO: 460119 - DNA, 2216 bp, Homo sapiens
ggcgatgatggtcattaagttcaagatggggaggggttggggtgagggctggcctgtctgaggaggggcatttgcagtgctggagcaagccatggaggacaggaattgctccagtcagaggaacagcaaggacaaggggcccaagacggcatgtactagaggctccacgcatagaaaaagccagccatccccagcgctgtaactgagtggccagtggtgggaggtgaggtcacagacgcggagggggcatacatgggtctttgtaatagttaattttatgcatcaacttgactggatcacagtgtgcccagatatttgatcaaacattattctgagtgtttccgtgacaatgtttttggatacaatcaacatttatttaattggttgaagacctgaatagaacaaagagttcaattctctcaagtaagagaattcctcctgtctgactacttcagaattgggacattggctttttcctgcctctacactacaactacaccatcaagccttcagacatggaaaggaaccacactattggctctcctcggtcttcagcttgccaactcaatgcagatctttgcatttgtcagccttataaccatgtgagctaattccctaaaataaataacagcggtaaacatgggaagtaattatttgtgcataattaaacagttgaggaagggaccttggcccaaactgatgatgctgtttcgagtgtgcacccttctgctggcccatatctgctggcccagcctggagaccaggaagctgcccaaggtgattgagtcactcgaacagctgcccctgccagggaaggaatgtgccagattccactcccccagcatcctccagggccccagtactggaaggcaaggctgcctccagaccatactccaagtttctgagtccccctactcattctgtctgtcctgcccttcctggctctgtggtcgctggagaggagagggcacgcctcagaatgccagcaccagaggggcctgcaggatcttccagcccacaggaatcccaggccccaagaagcaaagtgaccagccagaagccccagggccagcgctgggcaggctggacccccgagtgactgggtcataacactcctctgctctccgtaccttctactgtccatgaggggagccacactggcagctgattagatggtgcccacccagattgagggtgggtctgcctctcccactccactgactcaaatgttaatctcctctggcaacaccctcacagacacacaatactttgcatccttcaatccaatcaagttgacactcatattaaccatcacaggtatattaatgtataaaatatatgtagatgctaggctatttatgtattaatcaactgtctatgttattgagaagacttctggttggcagtaggctattagtagttaagcttttgggaagtcaaaagttatatgcagatttttaactgcaagagggattggtgcccctcaccctggagttgttcaaaggtcaaccttgtatatattctgtggttatgttcctgtggagaaccctgagtaatataccagataatggtaaatgatcataaaagagcccaatgaatttggtggatgctatgtgccggacactgtcgagtcctccttactgccaccccatgcatggggaccatcattatccccattctagagagagacaggaaagcccaaagtggcaagaaacttgcccaagagcacagaagcaaagctggggtcctaacacagtcaaatgattcccttcgaggggctggctttcctgaaatcatgggggaggggctaccctggaaccgcccccaccatggcagctccgaggtcctcagaacatagtttgaaagccccccgtcctgccccaccccaccaccctccagcactgtcctgtgtcatctcaccagcttagctctgcaaaggaaaccctctctgcttgcgttttaaattctgtgtgtgacatcagatcgtgtgcattcttccaccatgaggtttttttcactcagcattgttgatgagatttatctgagttgacacgtgtagttctggttccagcatttttactgctgtatagtattccattatatgacatttccacattgtacccattctcttgggtaaaggttgatttttaaaagttgacattgataaaatccctaatagctcttttcagctccatatagggtgtctttttctcccc

SEQ ID NO: 460120 - DNA, 1570 bp, Homo sapiens
atgtaaaaatcctgctcagtagtttaattggccatcataacggccgatgtctcattgcattgctgaaaggaaagcagatccccatattcctttcttgaagaacaaagttactgtcatacatgccttctccgtcctatttatcactaccaaggacaggacactgaagaccagttttccaatcccggaaaacgtgtgcagaacattctgcctgaggttcctgcggcctgagaaatggaaacttattgagcaatgtcatgtcatcagcatccagttagccctgatgtctaatgagtgtctgcttgtttgcataatgcagaactggcctgtgtgtgccctgcatgtgggcatgggtgcctgccctggccgtgagcatcagcaggctcagggtagcgtcggggaagagacttatcatggccccacccatatccatctgctcatctagaggaacggggccctggtagggcccgtccttcccctcttgcatacccttgcccagggacaagccctttctaatggagccctgccccaaaagagcttcagaaagacctttccgcatctccccctgtaggtgtcacccccacacccactgcttccacttctttctcgggcttactctcagccccacctctcctgttggcattcatgagttgcctccaggctccctactgatggagggagcttgcttttggttggggtcggggttaaccctttagctccctgtctacccccttgtgatggacttgcgccatccgctgggttgagcagtctccacccagttacatctgtaggcgggcaacgttcgtttccacacgagcaagcagtaagatgtggagtgatgggtgaggtgaatctaactcatttggggccgacgatactactcccagcgtagatcagcagatgattggaacagattctggagatatatatcgggctcccttgccatttaccatgaagtgatgtgtgtgcacgtggcacattatctgcaattttactcagtgaaataaaactcttagcatagtgccttgtatatgataagcactcggtaaaggtgagctgctatgaatattgccattattacaactacttaggagcaaaagcaatacatcctgccgtgtaccttcggtaaaggtgagctgctatgaatattgccattattacaactacttaggagcaaaagcaatacatcctgccgtgtaccttcggtaaaggtgagctgctatgaatattgccattattacaactacttaggagcaaaagcaatacatcctgccgtgtaccttcggtaaaggtgagctgctatgaatattgccattattacaactacttaggagcaaaagcaatacatcctgccgtgtaccttcggtaaaggtgagctgctatgaatattgccattattacaactacttaggagcaaaaacaatacatcctgccgtgtaccttcggtaaaggtgagctgctatgaatattgccattattacaactacttaggagcaaaagcaatacatcctgccgtgtaccttgtaaaatgccctgttgggcattggcagaagtttgagcgttgctatgtctt

SEQ ID NO: 460121 - DNA, 3447 bp, Homo sapiens
gggtgctgtcctttctccactcaaagctacaagcaggacaggaggggacgcgtgaatgccactggcaaacacagatggcatttagagcacggttctccctaaggcttggtgggtacccatccgtggctgcaggaagcagttccgcgggttctgcctctggtgcccagcagaagcgcggaggatatgggctccaggagttcaaacattcctcacagccggctttgcagggctgccaagggcgtgacttgctgttgaagaccacagagttctttgtttccatctctgctagaagcggtgcacacagtccccctcgcactcactgctgctccctcaaagctagagaaccagagctgagaagcagaaaccctctcagtggcctggcccgtgctgcagacagacagagcggtcaaggaaggcctcaggaccagaggcagagagaggaatggagtgagagagatcaatgctggacccaagatgattaacgtgccaacctggggcactggcgctagggagatggtcagatcgatggattccaagcaaatgaagagcctggcgcattcggcagccaagctgtgaagttaaacacagcgacggggccaggcgtttggtgagcgatgagggtgatgaaacaggacacatatatcttgggaaacaacactgagaggccagatctggttctgaaaaatgtctttgctccttgtcacctttcaaaggcaaaatcacagctctgacaaataccaagaagaattcaagaattcccaggtgtgtctgcagccgtgaaaatgtgacatgagtcacagtgtcttcggaggaaatgaaagaccacaggacggggacatggcatcatgaaaaaagatgctttgtgattttcaacatatggtgacacttttcctaatttagagggggaagctgggttttgagttttcttttatcctccctctttgttaaaagcaagagaaagaagatttaaagaacatctgtgtattcaaatgatagaaatagaattatacactttcaaaaacaagttctagtatttttgtctctttcaaagatttccgaagcctatagatttctctcgtgtttgtgagagcatttcctctgagaccttagacatagtgttgaagttgaaatggtttttgtctttttcccctttctgttaacccagcccccacttcattctgttaatctcctttaattggacttaagataagactgagtatgttcaatatttttattgaattgagttttatgtttccagtctggatttatagactgttaaatagaatgttttacgtttctctctctcgcaaagaaaataacaaatacgtgtgggacagagccatcagtcaattatatcagtggattgttggcaactcacagggggaaaaaaaagagcattttcactctactcttaggggaaagcaattatatttaagagcagtagaaagccaaaactagcctggaacttcaaaacgcctttcttgactgaccaagaaaaggtacagtgactacaatgacaaaccagcccccagctcttttagaaatctaccctgcctcatgctaaagagaaagtaagtgatgtttcagcctcggcgaccaggcaggaatagaaaaatacattgacagtagttggatagaccttaaaattaagtaaaaatttcttaatatacaagatctcagttttcccacaaacctcctttctgtccagaaatttccatgccatttactgcctgatcatgtcaggaatgacgttcttccttgttcttgattttccttcctggaatgttttaatcctgcctctccagaacacttttccctacttcttctaggccctactcacagcaatgtagctgacacatagcattagcgtgcaaaacctcaaatcctttctgacttggaacttcacccaggaaagacctctagcaaaagtgctggccattgtgtcacaggacaaacccctttcaaagaacaaagccatcatcatctcaaaagccacagtcaccacctggaccttccgtcctgaggaaaggaatctccaccgaatctagggggaagacccccccaccagtctgtgcaaaagatgaagaattgagtatgcacctacctgtgcccttccatttccacctcttcccaccttccccgtttctttttccgttcatttttttttccactttaaaaacatccaactttgccttggggatgagcagaatgaaatgtcacttacctataaaaagagacagaagagaaagccatgcatcacattacacacaagttctttgaaatcaaggccagcttccgactttgaaactgtaacaatgagtgaatattattttttcatcctacctttctatatttaatgaaactcaggagttcgcaagtagcctatccccagggcccagtctcccttcgtgattttccttttgtttctttgcctcctccgtccctcttcaccaccctagccccacaccctctgtccccgcttcatggatgaaaggtcaggaaggaataaggggggaggggtgcacagacccagagatcaaggccagccctcagatgtgggcagcaaggtttcgaggcatgaggagccgcttttcacctcttttctcacaggccacagagatgggacccagggtcagtgccggctggtgcctctcgggaggagggaggaaggtcagctccctgcagggtgattttccacctggtggcttctgggctctttcaaatgactctgctctgagtcttcctcctctctccctccctcaccctcaccccctccgccctcctggtttgggtgtgaatgaattcacccaaggtctccatccccctcttcatcctgcagcatctgtctttcagacctgcttctacagaaaacctcattattgcagcaccctgaggccaacaaccacctgaatgggtcattgtgttcagtcccctgcctcaatacatgatgcaaactggcccacccgagtcctacgggacactttgagaaccctgagatactgagtccccgccttgcccggctcctggccgcagaggctccctgtcttcatgcaacaagctccttgtggccgactgattcggttctgtcggctgtaaggaagccaggctctgagcattctacttgcaagaacagcccctcacccaccacgctatgtagcggatccttcacgtgctcacatattggaaaattggcttcagggtcctgccagtgtcttcttcttcttatgcctgaataactcatttccttttagactcttcttaaaggtttcagttttccatctttcctcctccaagctcctctgagaccctccgtggaggacagctcagagctaagccctggagagaaaagcagccacgtgtcccccgattctgttgctgcatcccccaaagagatttccaaccaagatgctctgccagaaatggaattacggtcaaatattgcatccc

SEQ ID NO: 460122 - DNA, 1542 bp, Homo sapiens
cccaggggatggcagcactccgggacagcttgggggaggaagatgagagttcaagtagcatccaaggtggctgtggacagccatatggagctgttaagtcaggcggctggatggacatgtggctctggagctcggagatggcttttccctgccgcaggtccctgactgccaagactctggcctgcctcctggtgggcgtgagtttcttagcactgcagcagtggttcctccaggcgccaaggtccccgcgggaggagaggtccccgcaggaggagacgccagagggtcccaccgacgctcccgcggctgacgagccgccctcggagctcgtccccgggcccccgtgcgtggcgaacgcctcggcgaacgccacggccgacttcgagcagctgcccgcgcgcatccaggacttcctgcggtaccgccactgccgccacttcccgctgctttgggacgcaccggccaagtgcgccggcggccgaggcgtgttcctgctcctggcggtgaagtcggcgcctgagcactacgagcgacgcgagctcatccggcgcacgtgggggcaagagcgcagctacggcgggcggccagtgcgccgcctctttctattgggcaccccgggccccgaggacgaggcgcgcgcggagcggctggcggagctggtggcgctggaggcgcgcgagcacggcgacgtgctgcagtgggccttcgcggacaccttcctcaacctcacgctcaagcacctgcacttgctcgactggctggctgcacgctgcccgcacgcgcgctttctgctcagcggcgacgacgacgtgttcgtgcacaccgccaacgtagtccgcttcctgcaggcgcagccacccggccgccacctgttctccggccagctcatggagggctccgtgcccatccgcgacagctggagcaagtacttcgtgccgccgcagctcttccccgggtccgcttacccggtgtactgcagcggcggcggcttcctcctgtccggccccacggcccgggccctgcgcgcggccgcccgccacaccccgctcttccccatcgacgacgcctacatgggcatgtgtcttggagcgcgccggcctggcgcccagcggccacgagggcatcctggcccttcggcgtgcagcttgcctggcgcacagcagtcctccttcgacccctgcatgtaccgcgagttgctgctagtgcaccgcttcgcgccctacgagatgctgctcatgtggaaggcgctgcacagccccgcgctcagctgtgaccggggacaccgggtctcctgaggccagttgggcggcttcagccccgggcctccaaccatgtccatgctgagaaggcagctttcccgctctgggtaccttacgtcctgcccagctctgtgcacctgaaccccagctgcgcactgaaatcagctggggtggggggtgtggaaaatgcctacatcctggctccatctcccgaagtttcgatttgattagtctggggtggacccagacatgttaagtattttttaagttcctccagtgatgc

SEQ ID NO: 460123 - DNA, 959 bp, Homo sapiens
ctactgttctagaagcaggcttgcctctctctgcccacctgtgaccaggcaggtagtgggctgatctaggtagggaagaaccacgagatggagaagcggcagcccgatcacccccaaacctcgtcagcatccccacctggccccaacctgccagccttcaccaggctcttaacaagaggccagttctcagccagcctctctcctgtccttgagcggcaagtgggcagctgagcagaattgtagaagcagtttgtgaactacctttggagcccgtaaagtggagatgagccccatgcatgtcactgaactcagaacatggggagcctgggttacagatccacagaataaccaagaccagcgtggcaggggcctccaggggccgaaacctccaggagagaagtcagtaaatgctatagaaagcacagcctgtgtcgggaatggagatgaaatatttctttgttagacatgccatcaaaaagtcccgaagttgaggaagaacgcaggtttattttcaaataaatgctcacttggactttgtgccaaacttgcggcgtcggaagggtgggaaagcggtgtcgctctgcaggacccagaccgccagggggcaggccatgcctccaccagactgcggcgagttttgactccggaggactctccaagcttcgctccttccgaggcccagttcctggtggaggagacctcccagtcaccagcgactcaggtcccgctcaggacgagggcacagcagagggcgccttcgacaaatgcacagtgcgcgttgttaacgtggctacatttgccttcagaggcccatgtggtcaggaagcagacgaggatgagtgctgcagggcacagaagacctttgagactcttacctctgctacaccagccacaccatcagtggagcactgaggcccctgcattccaacatgcaaactctccattcagacctaaaacat

SEQ ID NO: 460124 - DNA, 2604 bp, Homo sapiens
cctgacgacagatgccccgcacgctggccgggaccgggaagggcggtcaagggtggaaaggggctggcggctgccaggcctggcggagtggagcggggcggggcgcagcggggcggggcgggcctggagctgcacctgcttctgggcggacgcacttggcgcgcggcgcgggctgcagacggctgcgaggcgctgggcacaggtcagacgtccgtacccgcagggggctcgaacctggaggagggctcgaagggagagggggccccgccaaggagcggggctgtgatggagaggaggttccgactcgcaggggacctgcgggggaggggacgcggacagggaggggctctgggacaggggtgaaggctgcgctaggggaggacgggaggggatggagggccctggtgtcgcggaagcccagctggggccccctccgggctgcggaaccggtgcgcacactactcccaccgcccccgagtgcctctgtccggctggccgcggccctggaacgaatattgctcagtcccccgcgagtcaggtctgccgcgttgcccggcgcagtgggggagaaatttgcgggggtggccctgtctagggccagagaaacaacctctgaagctttgatccagccctagagggaagaaagatgtgagtttcagccagggaaacgtagcactttaagaaatagaaaccctttcaaaatttgagggcagggtcgcatagccttccaaacaggcctgcctacagcattttacctgcaattttacactcattttaatagaaaggatggcttattgttcatgagagacgtgtactgtttttaaccagatgtgtaatatcttcagtataacctggatgttgtgcagtgggaagttatggaaagaatcaggacacgtggttaggtaggggcccaggggcgtcagacttagctctttgtgacagtgagcttcttggtttaataaggatattggctccctctgttcctggggtttctgggaaaagatatggaactgatatgaaggttttattgaatatggcccactgattttacaagtggaggtgactgagataagcagaaggccacacctgttcccatttattccatgagttcctcccacacccttctggttgatgttggttgtgatggtcgaggtaattgaatctcacatttggcaccagttatttctgtttctcatctcccccctacctgcagttaaacatcagctgctatacttaactgttcaaagtacagatgttacctgtgttgggtgtaatcaaaagattatctcttttcctcaaatgaaaaatggggtgtaatactcatcccagctttccgcatcctggattctttgtgttttaataattgtttactataatctatttcatatgttctaatgtatacaatgccaattgatgtttgcttttatgtatttgcagttttgatttcttctttgacccaaagttatttagtgacttaaaaaatgtttaagggcgagaccctgtctctaaaaataatagtaataataataaaccttatatttgacatttgctaagagagtagatcttaaggattctcattacaaaggaaaggaaagggtaccaggtaaggtgataactctgttaattagcttgatcataccaatcatttcacaatgtatacatatatcaaatcatcatgttatataccctgagtatatacaatttttatttgtcaattataccgcaataaagctgaaaaaatattaaaggacatccttcaggtcgaaagaaaatgaggttttagagttattaaaatggacagaaagaaatgaagaacgctggaaatggtaaatatgtgattaaatatcaaagaatatatatatattcatgctttgaaaaatgtaaaattgcttcaagaaataattgccacaccattagtttataacctagactttatatattcttaaatcttaaaaactttataacaagcccaaacataaatatgatatgtacatatatgtgtacacacacacgcacacgtctctgcctgtttattagagtggcttatttagtccattcatatatattaatggcttattttgtgtgtgtgtatgtatgtgtgtgtgtgtgtgtgtgtgtgtgtgtgtatgcatgaaggaaggggtaggaaatagagctattatatattggaacaaagtcactatattttatcagaattaagttactattaaaatagaccatggtaacttcaagatgcatactataatccctagactagagcatgcagtaggaaaaaaatatatatagcttaaaatatgaaaaaagtaattaaaatggtatactaaaattacttgttagacataaatgacagcaggaaatgaggcacggaggaacaaaaaaatgcatgagtgacagaaaacaaatagcaaaatgacaactataaatataaccacaccaataattacattaatatgaatggactaaataaaccgtcccaataaaaaggcagagattgtcaactatgcaaattctcaaggaatttcccttttatgcatagttttgggaatgctagacttatattaatggaaataagccaagaaagaaaaataaatggcatccaagaaa

SEQ ID NO: 460125 - DNA, 1554 bp, Homo sapiens
tggttcctgcttctgccgctgccgccgccggatcccagtggcccggcgtgctcggctcccacaggcctgcagccagcatcgcaccaaaccttcggggggccgcggctggagcgctcggccggcgtgggagcgccaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatacggaactgtggaggatttgcttgcttttgcaaaccatatatccaacactgcaaagcatttttatggacaacgaccacaggaatctggaattttattaaacatggtacgtttctttccgatcagttgggtgctatgtgctcagctttcctgctgcagcttcatttaatgcagagtggtgtttgaatttggcttagatgggctggcaggcatgattttaaaaaatgtaatcatcagtaagaagtacttccatgttaaagatgcaaaaaaaaaagtcttcattaaaatttctatttaaagattcttgatcatattttagtagtatttctacaaataggtaattaagaagaatgtattttggccgggcgcaggggctcacgcctgtaatccgtgcacttggagaggccgaggtgggtggatcacttgaggtcagcaattagagaccagtctggccaacatggtgaaaccccgtctctactaaaaatacaaaattagcctggcatggtggcgggcgcctgtaattccagctacctgggaggctgaggcacgagaatcccttgaacctgggaggtggaggttgtgatgagccgagatcacaccactgcactccagcctgtgtgactgagtgagactctgtctcaacaacaacaaagaagaatgtattttaatttaacagttcactaaaaagtttattcatcagttatgcagaaaagaaaggcttaatgagactccttcgtctgagaggggaataaacactttgtcactaattaatcttgaaggctgaattatttgttcctttcttgtcacatcttgaaatgttattaattcatttcttgcaaaaatgtagtatgtaggcagtaaatagctatccacagattcactctctttcattggcaaagtatgaatggcaagtgatatatttgctt

SEQ ID NO: 460126 - DNA, 1957 bp, Homo sapiens
cataggtcctgagtgagtccccctggcccaccccattcagctgagatctgacaacatatgtttggggacaaacagccccagcagccaggagcaggccacatcatacatagtcagcatcagccatggtcccctcccactctcctgggggaaaaaggtgctttacaggcagcgtggcatccgagcatccccatggcgatgctgaggtcagacctcactgtggtgatctcacgctggggccaccggactcaggccaggctgggagtaggctgtctagccattgctggctgtcattgtcaccaagggaaggggagaagctgtgaagagttgctctggaaaaaacaaatctgctcataggacaatgggtctgggtgaacctatcccggccctcttggctgctgggccagggcctggtttttcacagggcaccattgagaccacaggaagtggcttcctgcctctgaagacagcacacaactgccctagaaagcgctcttgtcacccctgctgctggagtgcaattgcacaatctcggctcattgcaagctccgcctcccaggttcaagtgattctcctgcctcagcctccctagttgctaagactacagggtagagaatcagaggcttgtagatgtctttgccacttccacgggatctctgggagctggaaactgagctttaagaaataactatagtgcaaagggaactaagggaaaagggttcagcccaaagcagaagggactgtgatgatcacagtgacctcctgaggccagcatggtggtagcagccagagacagcagctgagtgagaccctaagggagggatgagccaggcagtgtgtggttggagttctccctacacatctcgttttcctcacctccagatcacacacatgcacacacacatatgcacccacacaccccttacacactccggcccgaaggtttctgcaggactccttcctggcactctctccagtgctgccagcgtcgcaccacactgcaaggctttgcaaactttccttccaaagtgaaggagaccctctggccatctgaggctcggtctgaagcaacagcctcagagcgcaatctcaggcatgcaggaagtgcaggaaggccacgtgccacatacgttatctcacttaatctcattagcaggaaatgtctttaaagtcttatgttggtgcttaaaaattcctgagcagtttagcccttaataaagccaggctttttaaaatttgaaatgaggttgagaaaactgtggtcatcggaattcccttcagagacaacacttagctgagtctcttggttgtagggaggaggctgatggcggcagagggggcagtggggatggcagagagtggggggagcatgccaaggggacatttaagtgagaaaaggtgatactaaatcgctccatattatgtggagtgaggaggaaagaggccctgcagatgagagagtttccaaacccacccgcctgcagggttgtttccagtccaaccagaccaaaggcctctcacggccctcaaaccgcctgagcccctgcccctggctgcctgtgtcggagccgcctgctgtggaagccaccttcccacacagttcagtcttcatcatgcctcgcttcccaaatgccatactccaccccaatctccaaaaatgggttcagcctcttccccaagtaaccctcaagcccgcatccctggagcagcagacccaggtgagaggtcaacgccggcaaccccgggcctctcctttcctgcgaggcccagccttcagcaaaggctgtgaagctgactgcagttgcctcggcagcagcctggtgctgaggaagacgcccagcctggcacaaccttcggttctgactcccatcacctcctgttgacagcgtctggctggcatcctaatcgctcattggacaaattgccagggcagcggtagacagctggcatgtgttaactc

SEQ ID NO: 460127 - DNA, 806 bp, Homo sapiens
cataggtcctgagtgagtccccctggcccaccccattcagctgagatctgacaacatatgtttggggacaaacagccccagcagccaggagcaggccacatcatacatagtcagcatcagccatggtcccctcccactctcctgggggaaaaaggtgctttacaggcagcgtggcatccgagcatccccatggcgatgctgaggtcagacctcactgtggtgatctcacgctggggccaccggactcaggccaggctgggagtaggctgtctagccattgctggctgtcattgtcaccaagggaaggggagaagctgtgaagagttgctctggaaaaaacaaatctgctcataggacaatgggtctgggtgaacctatcccggccctcttggctgctgggccagggcctggtttttcacagggcaccattgagaccacaggaagtggcttcctgcctctgaagacagcacacaactgccctagaaagcgctcttgtcacccctgctgctggagtgcaattgcacaatctcggctcattgcaagctccgcctcccaggttcaagtgattctcctgcctcagcctccctagttgctaagactacaggtgcgtgtccactatatctggctaattttttcatttgttttttgttttttgagacagagtttcactcttgtcacccaggctggagtgcagtggtgcaatctcggctccctgcaatctccgtctcccaggttcgagctattctcctgcctcagcctcccgagtagctaggattacaggcgcccaccaccacaccatgctaatt

SEQ ID NO: 460128 - DNA, 1687 bp, Homo sapiens
tcttgcctagattgagcttgagcccttgtaaatccttgcatttatcaatagtacattccatgaatggggttcttatttccaactctgtgaccttaggcaagcagcttgaccttgctggaccatgtgtcatgaggttgttatggggcatgagtgagttagcggatgggaatataaagttcctatcgcagtccagcacagggcagaaggtgttcaggatatggaggttcccttcccctctctgctcaatgcccaggcaccgcggctgacccttggtcagtagagcgcacccagacgaatgcccaggtggacacttgtgtctttgtggttatcttagggtagagaatcagaggcttgtagatgtctttgccacttccacgggatctctgggagctggaaactgagctttaagaaataactatagtgcaaagggaactaagggaaaagggttcagcccaaagcagaagggactgtgatgatcacagtgacctcctgaggccagcatggtggtagcagccagagacagcagctgagtgagaccctaagggagggatgagccaggcagtgtgtggttggagttctccctacacatctcgttttcctcacctccagatcacacacatgcacacacacatatgcacccacacaccccttacacactccggcccgaaggtttctgcaggactccttcctggcactctctccagtgctgccagcgtcgcaccacactgcaaggctttgcaaactttccttccaaagtgaaggagaccctctggccatctgaggctcggtctgaagcaacagcctcagagcgcaatctcaggcatgcaggaagtgcaggaaggccacgtgccacatacgttatctcacttaatctcattagcaggaaatgtctttaaagtcttatgttggtgcttaaaaattcctgagcagtttagcccttaataaagccaggctttttaaaatttgaaatgaggttgagaaaactgtggtcatcggaattcccttcagagacaacacttagctgagtctcttggttgtagggaggaggctgatggcggcagagggggcagtggggatggcagagagtggggggagcatgccaaggggacatttaagtgagaaaaggtgatactaaatcgctccatattatgtggagtgaggaggaaagaggccctgcagatgagagagtttccaaacccacccgcctgcagggttgtttccagtccaaccagaccaaaggcctctcacggccctcaaaccgcctgagcccctgcccctggctgcctgtgtcggagccgcctgctgtggaagccaccttcccacacagttcagtcttcatcatgcctcgcttcccaaatgccatactccaccccaatctccaaaaatgggttcagcctcttccccaagtaaccctcaagcccgcatccctggagcagcagacccaggtgagaggtcaacgccggcaaccccgggcctctcctttcctgcgaggcccagccttcagcaaaggctgtgaagctgactgcagttgcctcggcagcagcctggtgctgaggaagacgcccagcctggcacaaccttcggttctgactcccatcacctcctgttgacagcgtctggctggcatcctaatcgctcattggacaaattgccagggcagcggtagacagctggcatgtgttaactc

SEQ ID NO: 460129 - DNA, 3208 bp, Homo sapiens
ggtatccctatcgggcactgatatggctaggatttgtgtcccctctcaaatctcctgccgaattgtaattcccagtgttggaggagccccgtgggaggtgatgtcatgcctctttgtaacccaccccttcctcaccggcccttccaggaatcttgggtgggtccttgttccactcgtcctgaagcttcttgagtgcacactatctgccaggcaccaaggaggcacagtgaaggaaactctgctgtctcaaggctcctattcctgggggaggctgagatcaggtcctgaggcgcagggcccttcatgggattgggccacaagacacaaaagtgaagctaaagacagagcaggtgtagatctgtgcctcgacctggctggcagtcgagaaggtttcccaaggagtagtatttggggtgacaccagcatagaccccggaaaacgcatgtgaggttgttggtgattctatggcctcaaattttctattttgtgcattgcttttcctcatttcttgctatctatctagggccatgttttataaactaaacatttctcatgatgcgcaatcagaatctcgtgtattgaattatgaaatacttgacacatgcaaaatattacataacatacatggaaggcatgtgaaccagccactcagccaaaattataattaaaccactcatcccgtgtgcgagagcattagttttttcctcaccactttctattttattttttaatttttaaaaatgaaggttacttattaatggtagaacccttttgctatgaataaaattattgtgactaattttataagaaaaagatgtggttcattacattttaaaaagcaagtttattgatataacaataaactgcctctacttaaagtgtaagttatgacatatgtatacacccgtaaattcatctgtgccatcaagataatgaacatgtctatctccccatggtagcccctccctcatctccttgaacctccatctgttttctgtcactaaacattagcttgcattttctagaatttaatataaaaggaattatatggtatggattcctttttggctggcttcttccatgtagcataatgattttgagattcattcctgttgcagtgtgcatcagtagttctttttattgctgagtaatattccattatatggatatatcacaatttgtctatttatctcttgatggacatttgatttgtatccagtttgggtattacaaattaaagctgctatgaacattcatgtacatctctttgtttggaaataggcttttatttttctgggtaattttattttattataactttcacctctttcatagtcagatatcgtctactgtatacccacggcttctgcacagaccaggcaggacaggaggctgagctatgaacctacccaaccagtgactaatactatgatcagtttgagctccatgaggctaaaattttactttctttttgtatccccagtgcctagtagactgtcaggcacttaatatgtatatagtccgtggttactgaataagtgataattgtgtaaatggaggttttaccttgccagaaatgataccataatatggtcaatgaattataatcgcagaattctacagtgccatagaaggagagaatctttttgtctagaacttttgatggcccattgaccatgaggacaccgtggctgggacagccagtcagttgttgggccaatgatgctcttctctatgcaggctttcttggaagctgtcttcctagagtggacaagcccacgtcttcataggaaaaagattcgtggaaagtggaatctcagctttggtattgtaccccgtccccccacacgcagccccacttttcatttttcacttcagcttcagcactgaggcaactttcccattattcaaatcctaggaactttgtccaggtctcaggcttctctgggacttacttcttgaagcatcgtagcatagtggaaaggactttgacttcaaggaagagtgttggggtttaaatcctgactcttgcaaggtaatttctgcatggccttgggcaggtcacttgcccctcagccagggctctcccctgggaagtgggaaagtgccgtgtgtctcacggggttgcttcggtggctagatgagacaaagtatatgtaagtccaaccagcaagcaacaagctgagcaggtctcttgatgtgagcacacaactgtagcccattggaatagtggcagttgtggcatctgtccttcagtgacttagctgataaggagcaaagaagccaaagtttcctcctccttatgagataactggcatggccagaatcagtgtggcgtgggactcagttcacaggtattgacaataagaacaataatgatagaaacttgcttcatacccttctccagcttcttcctgttcccaatccatagcccctcccccttcaaataaaagcagagctgctactcagccttcctgaatgaaggagaggtgaccttgtccagcgtgccctctggataccatgaaatgtcagcttccttcccaccgggttggggtggagattggctgtttagagatctgcaaacttgcttcactctcagaggagagaggaagtatgttttctcaggcattgggagatacccatcaaaattccacacaccttgtctgggctgaattttacaaagcatttgaaatgctttgtaaatttaattgtcttcagacagtgtattcagattgattaggtaatcagtgcatttggtacagtggtaactcgttttaatatctaagtagagctggtgggctttcttgtgcacaaagtgctccccaagcgtctgggggtgtgggctgttggcagctcatagttggattcttctctgagaaatgcacttggcctgcccagcccaaggtgaaatgcacatccagtgaatggtcagaaaccatcctgtgacagcagctcttcctcactcccctgcaatgagcaacttggagcccagtggggctagtgaggaagactttcctgctggggagataggaaggaagggagctgtggaacttggtcttgagctccagtgccttcctgaaggcagaggcagagctggaccactcattagaagaccttcaaggccctttgtgctctggcctccccttcacctttccggccccatctaagccagtgcctcagttctgtaccccacccatcaattctaacc

SEQ ID NO: 460130 - DNA, 1229 bp, Homo sapiens
catgtaattcataaatgaggaagctgacaggagtcaacttgccccagggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagtatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaagtagtggtttgctattcctacacaagtaccacgtcaaccccaacctctacccctgttccaagtggcagcatagcaacggttaagtctccaagacctgccagtcctgcctccaatgtagttgtcttgccaagtggaagtactgtttatgtcaaaagtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaagttccaaaatcaaatccacaaaatcaggtatgttctgagaagtctgtttatctatgactccaacagtctgttctgtcctccctgatagattcccctcacacaagcact

SEQ ID NO: 460131 - DNA, 153 bp, Homo sapiens
tcaagcttctaacgatgtacggggacatgtattttgagattcagaaaaaaatgtaaaatttgtgttctgtctttaagaaatatgaatataacatctcttaatttatttttaaaaagccaaaaaaataaaacgatgaaagattcttaccaaatt

SEQ ID NO: 460132 - DNA, 1407 bp, Homo sapiens
acctgtcgccatcttgccccttcagaggcaccgcaaacaaacccaattcctggtgtcccctagtcttggcggaggagccttttagatgagccccgaaaggccgggcagggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataaaatgaatttatccttatatttgggtgaaagaccaagttacagtatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaagtagtggtttgctattcctacacaagtaccacgtcaaccccaacctctacccctgttccaagtggcagcatagcaacggttaagtctccaagacctgccagtcctgcctccaatgtagttgtcttgccaagtggaagtactgtttatgtcaaaagtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaagttccaaaatcaaatccacaaaatcaggtatgttctgagaagtctgtttatctatgactccaacagtctgttctgtcctccctgatagattcccctcacacaagcact

SEQ ID NO: 460133 - DNA, 939 bp, Homo sapiens
acctgtcgccatcttgccccttcagaggcaccgcaaacaaacccaattcctggtgtcccctagtcttggcggaggagccttttagatgagccccgaaaggccgggcagggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataaaagtaagccattagtcgtaccatccctgattttttatgacatagtataacacagttttgaaacagtcttcctattgtgtagcagattcctgagtcttttaagtaacaatatctctatactcagggatcctgatcatagcagtaaaagtgatattaactgtttattcagttgggtttttttttgcatttggttaggcaagctttaagtactcaggtcaaatcctgttacaatgtaatctctgtctaactaaaaatcaccacaatttagcagatgattcacttacttgaggccaagttcagtaacaaagtattgtgacccctaaaattgaaagccctttagaggttctttgtaatggtatttgatatgttattaccttataaataggcgttgtaacttttttgatatctgactcattatttcatgtattttgagattcagaaaaaaatgtaaaatttgtgttctgtctttaagaaatatgaatataacatctcttaatttatttttaaaaagccaaaaaaataaaacgatgaaagattcttaccaaatt

SEQ ID NO: 460134 - DNA, 366 bp, Homo sapiens
cttcgggcacagggggatctcaccaaggaaaagaaagatcttcttggagaactatcaaaagttcttaggtaaattattgtaaatgtttgtgagactctagaaatttcattttgggggattttattacttatcactctcaaattaagtaactgtcaaattaagttgaagaacagaggtgttcaaattgttggtgctaagagactccatcccagttgtgtgctctgttacagaaaattgtataatttaccatttattgtgtaatccagaatgaatataatccagaatgaagagcgtgcaaactcttcagaaagacttgaaggcagtttatcttacttttagcccacctggataagggaggtgcttttg

SEQ ID NO: 460135 - DNA, 1365 bp, Homo sapiens
acctgtcgccatcttgccccttcagaggcaccgcaaacaaacccaattcctggtgtcccctagtcttggcggaggagccttttagatgagccccgaaaggccgggcagggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataatatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaagtagtggtttgctattcctacacaagtaccacgtcaaccccaacctctacccctgttccaagtggcagcatagcaacggttaagtctccaagacctgccagtcctgcctccaatgtagttgtcttgccaagtggaagtactgtttatgtcaaaagtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaagttccaaaatcaaatccacaaaatcaggtatgttctgagaagtctgtttatctatgactccaacagtctgttctgtcctccctgatagattcccctcacacaagcact

SEQ ID NO: 460136 - DNA, 741 bp, Homo sapiens
agcagcagttctacaccatcacctattcctaatacagttgcagtaacagctgtggtgtcctctacaccatctgtggtcatgtcaacagtagcacaaggtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaagttccaaaatcaaatccacaaaatcaggtatgttctgagaagtctgtttatctatgactccaacagtctgttctgtcctccctgatagattcccctcacacaagcact

SEQ ID NO: 460137 - DNA, 1342 bp, Homo sapiens
ttaaaggaaaaatcgacaggattttctctaaaatgattgaaaaatctctggatgctgcagagcagccagaggattccgctgaaggagaggggaggctgctgacccaccccggaaaccagaggaaagtgaggtggcggcaggaggccacggccacgggcaggccacgggcaatcactagctaccttctcctaacctttttctcccacacactttcatttttaacaaactgagccacagaacaaggaaattccaacttctgcaggaacctctgggagcagagaactaggaaggaagaaggaaaccctcctttggaatgacactgttctctcgcctggtggtgctcaggcttcagcaggatcagaatcagagaggagcccagatagctgagactgactcaagttctgattccgcaggccagagtgaggcccgagaatctgcctttaacaggttcccaggtgatgctgatgttgctggtcctaaaatgaccttgggagccactgatcttatctacctcatccgtcagttgggtggtgctactgacctgggccagacctgtagggtctcagccgggctgactcagctcctgtggctgcagccacttgccacgtgggtggagggctgcctggtacaggctgttatcagcttagaccacctgtctctgctctacgcggtctctcatcttccagtagagaactgcgcttgccctcatgacatgagagggttctaagggtgggaatggaagcttgcaaggcctcctgagaactgaattcagaacggtcacttctgctgcattctgttagacattttgaggaaaggcagaggtggggtactactcaaggactctttaaacaaacatgaagtttaattcaattgtttcctgagaggttgacttcttccaaaagccaaagaaaatctcttactaatccaaaagctgtctaaaccactaaggccacatgttggacggaggcactttcctgctggaatccgataaatcaccacacccaaatatagaaagaaaaagggacacagatcatccacaccgtggccgaatgtgtgacatctttgctgaactctctccgttccaccttgtggtggaggcctccagtccaccaaacacagccctaggcgtgtgaaccctgccacaaacatcggtgctcttcctgcacagggcctgggaccaaccgtggccaggacatcagctgctggaagccgagagagttcatctgagtggcgattttatgatctgcagagtggaaagtaatcataatcccttgagaagtttgcagaatcgaaccgaatgttgaatgccaaagatcttcacaaagcaagttgagtttcttcc

SEQ ID NO: 460138 - DNA, 1178 bp, Homo sapiens
gtttatggtctgatttccggcctctcgcctgctcgccccgccgcccgcctgagaggggaccatgccggaacccgggccggacgctgccggcaccgccagcgcacagccccaaccgccgccgccccccccacccgctcccaaggagtccccgttctccatcaagaacctgctcaacggagaccaccaccggccgccccctaagcctcagccgcccccacggacgctcttcgcgccagcctcggctgccgccgccgccgccgctgccgctgccgcggcggccaagggggccctggagggcgccgcgggcttcgcgctctcgcaggtgggcgacctggctttccctcgctttgagatcccggcgcagaggtttgccctgcccgcgcactacctggagcgctccccagcctggtggtacccctacaccctgacccccgccggcggccacctcccgcgacctgaagcctcggagaaggccttgctgagagactcctcccccgcctccggcacagaccgcgactctccggagccactgctcaaggccgaccccgatcacaaggagctggactccaagagcccggacgagatcattctggaggagagcgactccgaggaaagcaaaaaggaaggcgaagcggcgccaggcgcggccggggcgagcgtaggggcggcggcggccactccgggcgcagaagactggaagaagggcgctgaaagtccagagaagaagccggcgtgccgcaagaagaagacgcgcacagtcttctcgcgcagccaggtcttccagctcgagtccaccttcgacatgaagcgctatctgagcagctcggagcgagccggcctggccgcgtccctgcacctcaccgagacgcaggtcaagatctggttccagaaccgccgcaacaagtggaagcggcagctggcggcggagctggaggcggccaacctgagccatgccgcggcgcagcgcatcgtgcgggtgcccatcctctaccacgagaactcggcggccgagggcgcggcggctgcagccgcgggggccccggtgccagtcagccagccgctgctcaccttcccgcaccccgtctactactcgcacccggtggtctcttccgtgccgctgctacggccggtctgaggccccagaggggtgggggagggagcgcccggcctccttgtcc

SEQ ID NO: 460139 - DNA, 4021 bp, Homo sapiens
tgaccttgttggatgctgcacctgaaggtggaggaagaggaagagccttgggggctaccattctggctggagaagcggcacgaggctccctcttgtggatgcagcaaggactgttaaaaaactcccaaagcagggactttcaggcccacatgcacttagcctcctcttcccacctcctgttcctctccgtgtctaatgttccactgccatcgctgccaggaagttctgcagagaagagtgaagaagaaccgtgtgatcctaaacatgttctctgaagatattatcaacccaccattggccttatttactggaatgtttttataaccttcatttgacacctcttcccatcatttaaaataaatctgaacgttcggcagatggcgctgtttccacacgagcgtaacggcggccacaagcgttctgccgccagggggcgccgcgttccgccggggaagcgtggctcccgggcgcgcggccgccgcctgcccagcaccggcgcagggcccacgcctccgtcgcggtgcgtcctttccctccaggtgggacgctgcaggcccagccgctccctgtgcctccagacagccagggctctcacgtggataggctgctggaccaagctcagtccaggaggccggcttcaacagcttctgctcagctctcccgggcagcacaggactggaggggcaggggcctcagaacagggaggccgcagggcggcctcggcagaaggtgagtgctggcagcccgtggcccgagacgttaagcactgcggggagaaaaggagaaagaagctcctcgaactttaggcccactctggtgtgtgaggagcccggccgagagctgagagcagcctggtcttcccttctcgtctccgctagcacaggaaggagttattcaaaagtatttactgagatcctattacttgccttcagtcattctgcacactgggaattgcaggcaatgcaaaggccggaaataaggcaggctgggtgggtgtgctcgggcatagacagccatggactgccctggagtttgctgggagcacaggacggtgcagaggggcagtggccatggttagtgccctggtggctgcagaaaatgattgagattttattctaattgcaatgggaattcgctgaagaatttttaagcaggagagcaatatagcttgatttatatgaccatggctgcagagaaataagtatactttcatttatatattaaaaattagagagaaatgtaagaaattgttaattaattaaaaataacatcgataaacctattatatgttaacactatattttatgaaaactattttccaaagcaaagaaattttagtgagaaaagtagtatcgctttacctttttgcaactcttgctaatgtttggcttaaaagaagatagttgaattctcatgtttgcttctgaataaaatgtgatgtgttattttagctaaaatatatgaagaaaatctggcttcatacagagatgtagttgtaaaggggagaggtgcttagtacataaatgtggatatttttctacatgaaaaattgacaagtagtttcttaaaggtgaatttcaatatggattctgaaaccacatcaatgcactccatacttacttacattaaaatccattgaccaatcttgcatttgaatggatctttcactcatgtatgatcttataacatcagcattggtcatttggaaaataatgacccgctaaattatgcagatctccaaatgctgacaaatatcattatacaagagaaaaataatcacatttgttagtaacagcactgatcgcactggaaagtctttaagggttggggagctgtcaagttttcagtgatggaaacaagttttccaagattataatttttgcttgaaagatcaaattttaccattggtgacaaatattgccagttgttttcattgaagtggcaggctcattttatttgtttttgtgaaaatgtctctaaatatccatatctaagtaaacagtttgcgtgtcagtccctcaagtaataatagcattccatgaaaaagtgtctagtttagctggcaattcaaataatcacacaatcattttatcctctagacagctgttgtacttcagtacacagcaaagtgttttgcatgcggtgtgtaacatttttagaaagtatgtactcaaggactgagatttaatagaattttttttactgtttcgtgaagaacattcttaagtgaaactgatacttttgtattttagttatgagtgcatgtaaaggaagaacacgatgactactagtaaagtgtattaggccgttcttgcattgctataaagaaatatcggagactgggtaatttataggaaaagaggtttaattggttctgcaggccgtatgggaaacttagtgctggcatctgcttctggggaggcctcaggaagcttatactcatgaagtgggagcaggcatgtctcatggcagaagcaggagcaagtgagagagagtgtggggggaggtgtcccacacttttaaatgaccagatcttgcaaaaactcaccatcatgaagacagcaccaaaccatgagagatctgtctccatgatcaaaacacttcccaccagtccccacctccagcaagataattcaacatgagattggagtgggacaagtatccaaactatcatcaggtttgctgctacagccttgatttgtgttaggcgccaacagttttactcatcactgcttttgcctcatcagtataaacacgaacacagtgaaaaagacaaataatgtcttagtgttattttgaaaatagagttgaccttgcagatccctgaaagaattttagagattccttagtggatcttacggacattggagggccctagacctgttctgactatgggtcccccgtcagaaagcatgagagagatgttggtattttatggaaagcccatgggattttgaaaggccattcatgtttcccagcagaactagggcgtccaattgagttcagacttgctccatgcaaccattgtcaggtcacatgacatctttaggtctcagcttttcatctgtaaatgcaggccgctgggctaggggatgcctaacacttcttccagatgcactggcactgaatgccaggaagtctggcgattgagggctggcaccaggaagaggcccagatgattttatgaaggtattaaatgccacctttagggggtgtgcgaggcctccccgcagtcctgaaaagttacgtagccaattcttcagcatttccaatgtttctgggaatctgagttcttaggtggaatggaattttctgtctagggaaccaatctgtggtggagctaatacagagatcaggaaaagtggccacagcagacattccacaggggaaagagcagaatagctaaactagtctagtgagattgaacaaaaggagggtgccaggtgctggacatgctgcttaccgcattgctggagtgcaagattagctggtctatgctcagagtgcctggggcctgagtttgctggagatgtggtcttaggattctccggggaggtgctctagcaagttcacaaggacaccaagcaatctcccagacttagactgtacactggctgctctggtactgttgctggagccttctcctctctcctccccttcccaatagttcccactgcaataggtgtagcagtgatacagacaggaaatggaggtgctgttgatgctgctgctgcacccttaaaattctatagaacttacagggtgtactctggaaaaatgattgccataaccttattcattgacttattggatgaaatatgtactgagtgtctactaggtgccaggcactgtaataggttcacggaataaatctgttaataaaataaagagcccttctcttgcggaggtttcattatagtgagagctgacaaacaataaatgtaatattttgactcttttgaaggacttcacccccaaatttagcccaatccattcgggaggacgcatccctctctcttga

SEQ ID NO: 460140 - DNA, 1580 bp, Homo sapiens
tggggctgggggctcgggcgaattcttccaccgaaacaagacagagcagcgggacagatggtgacaggtttttaagtgtggtgagaggtggaggcagttccctcgcagcaggttgcacctttttgtaagcagtccaacatcctctgagggccaaggaggaggaaacaagggcgagtttgatatgccttagaaagatgagcaaggagcctggcacaggaaagaaccacccaccccaatcttccccactttcaaagccatgctcgtgtgggggcagcggcttccaagggaaggcgtcagcaatggagagcatgtttcggagtcaacggcttccatgaaaaagcatcacaatgaagagcatgtttcggagtcaatggcttccatgggaaagcattgcaatgaagagcatgtttcagagtcaacggcttccatgagaaggcatcacaatgaagagcatgtttcggagtcaacggcttccatgagaaagcatcacaatgaagagcatgttttggagtcaatggcttccatgagaaagcatcacaatgaagagcatgtttcggagtcaacagcttccatgggaaagcatcgcaatgaagagcatgtttcagagtcaacggcttccatgagaaggtatcacaatgaagagcatgtttcggagtcaacggcttccatgagaaagcatcacaatgaagagcatgtttcggagtcaacggcttccatgggaaagcatcacaatgaagagcatgtttcggagtcaacggcttccatgggaaagcatcacaatgaagagcatgtttcggagtcaacggcttccatgggaaagcatcgcaatgaagagcatgtttcggaatcaatggcttccatgggaaagcatcacaatgaagagcatgtttcggaatcaatggcttccatgggaaagcatcacaatgaagagcatgtttcagagtcaacggcttccatgggaaagcatcacaatgaagagcatgttttggaatcaatggcttccatgggaaagcatcacaatgaagagcatgttttggaatcaatggcttccatgggaaagcatcacaatgaagaccatgttttggaatcaatggcttccatgggaaagcatcacaatgaagagcatgtttcagagtccactgcttccatgggaaagcatcacaatgaagagcatgtttcagagtcaacagcttccatgggaaagcatcacaatgaagagcatgttttggaatcaatggcttccgtgggaaagcatcacaatgaagagcatgttttggaatcaatggcttccatgggaaagcatcacaacgaagagcatgtttcggagtcaacggcttccatgggaaagcatcacaacgaagagcatgcttcccatgccatcatggccccattccttctttgagaaactagaactgtacaattgccaaggctgtcatttccaaaacaccttgtaaaaatatggcaaattctatcaaagttaaaaatgcacaaacgtttccagaagttaatcatttagctgtatgtgcacagttgcacagctgtatacataaggatattcagtagagcatttctgcaatagc

SEQ ID NO: 460141 - DNA, 978 bp, Homo sapiens
  misc_feature (1)..(1): n is a, c, g, or t
  misc_feature (3)..(3): n is a, c, g, or t
  misc_feature (6)..(6): n is a, c, g, or t
  misc_feature (8)..(8): n is a, c, g, or t
ncnccntngatttcctccccgcccctccccactgcctgcctgctgcaccaccttccacccagatcacccagatcgtctctaaagggagttcttggtttccttcgatttcttatgaacccaggatgggcagcaaagaagatgcgggcaaggggtgtccggcggccggtggcgtctccagcttcaccatccagtccatcctgggcgggggcccctcggaggcaccgcgggagcccgtcggctggccagccaggaagcgcagcctgtccgtgtcctcggaggaggaggagccggacgacggctggaaggcgcccgcctgcttctgcccagaccagcacggccctaaggagcagggccccaagcaccatccccccatcccttttccttgcctgggtacccccaagggcagcggaggctcgggcccgggcggcttggagcgcacgcctttcctctctccttcgcactcggactttaaagaagagaaagagaggctcctgcccgcgggctcgccctcgccggggtccgagcggccgcgggacggcggcgctgagcggcaggccggcgcggccaagaagaagacgcgcaccgtcttttcgcgcagccaggtgtaccagctcgagtccaccttcgacatgaagcgctacctgagcagctcggagcgcgcctgcctcgcctccagcctgcagctcacggagacccaggtaaagacttggttccagaaccgccgcaacaagtggaagcggcagctctcggctgagctggaggcggccaacatggcgcacgcgtcggcgcagactctggtgagcatgccgctggtgttccgggacagttcgctgctgcgcgtgccggtgccgcgctcgctcgcctttcccgcgccgctctactacccgggaagcaacctctcggccttacctctctacaacctatacaacaagctcgactactgaccggcccgccgccccgcgccgcccccagctgccc

SEQ ID NO: 460142 - DNA, 565 bp, Homo sapiens
tgatatctgtacaccagtgttcatagcggcattattcacaatagccaaaaggcggaaacaacccaaatgtccattgacgcatgaccagtgtgatagttaatttcatgtgtcaacttgaccagcccagggaatacccggatagctggtagaaaattatttctgggtatgtctgtgagagtgtttctggaagaggttagtatttgaatcagactgagtaaaaggatccaccctatccaacataggtggccatcatcgaatccactgagggcgcaaatagaacaaaaaggtgaagaaaaggtgaattctctcctttcttgagctgggacatccaacttctcagacatcagagctcctggaggccttcagactccgagacattacaccattggctcacctggtcctcaggtctttggacttggaatgaattacaccattggctttccaggtcttccagcttgcagatggcagattgtgggacttttcagcctccataactttgtcatccaattcccataataaatcgcctcttatatctgtaaaagtttggttctgttctggagatccc

SEQ ID NO: 460143 - DNA, 578 bp, Homo sapiens
aggtgttcaaaaaaaggtcctccaaggtaccagtattttcaagccactcaattattcctaacctggaggtcatgggcacaccgctataggtcctcagctgcagggccctctgcctcccaggttcaagtgattctcctgccttagcctcctgagtagctaggattacagatttataggagcattgtgactggaccaaggacaaagaagttcccaacctcctcagaccctcgctgctgcccagatgtctgccatggggtggccatcatcgaatccactgagggcgcaaatagaacaaaaaggtgaagaaaaggtgaattctctcctttcttgagctgggacatccaacttctcagacatcagagctcctggaggccttcagactccgagacattacaccattggctcacctggtcctcaggtctttggacttggaatgaattacaccattggctttccaggtcttccagcttgcagatggcagattgtgggacttttcagcctccataactttgtcatccaattcccataataaatcgcctcttatatctgtaaaagtttggttctgttctggagatccc

SEQ ID NO: 460144 - DNA, 535 bp, Homo sapiens
gagatggagtctcgctctgtcacccaggctggagtgcaatggtggaatctcagctcactgcaacctctgccttccgggttcaagagattctcctgcctcagcctcctgagtagctgggattacagatttataggagcattgtgactggaccaaggacaaagaagttcccaacctcctcagaccctcgctgctgcccagatgtctgccatggggtggccatcatcgaatccactgagggcgcaaatagaacaaaaaggtgaagaaaaggtgaattctctcctttcttgagctgggacatccaacttctcagacatcagagctcctggaggccttcagactccgagacattacaccattggctcacctggtcctcaggtctttggacttggaatgaattacaccattggctttccaggtcttccagcttgcagatggcagattgtgggacttttcagcctccataactttgtcatccaattcccataataaatcgcctcttatatctgtaaaagtttggttctgttctggagatccc

SEQ ID NO: 460145 - DNA, 515 bp, Homo sapiens
tgttgtgtaaatataccacagtttgtttattcatcctgaagataggcatttttatttttatttttttgagatggagttcctctcttgtggcccaggctggatgcaatagcaccatctcggctcactgcaacctctgcctcccaggttcaagtgattctcctgccttagcctcctgagtagctaggattacaggtggccatcatcgaatccactgagggcgcaaatagaacaaaaaggtgaagaaaaggtgaattctctcctttcttgagctgggacatccaacttctcagacatcagagctcctggaggccttcagactccgagacattacaccattggctcacctggtcctcaggtctttggacttggaatgaattacaccattggctttccaggtcttccagcttgcagatggcagattgtgggacttttcagcctccataactttgtcatccaattcccataataaatcgcctcttatatctgtaaaagtttggttctgttctggagatccc

SEQ ID NO: 460146 - DNA, 378 bp, Homo sapiens
aggctggcgtgccggtggctcggctagctcccgggtcccggccccgcctggaagggtggccatcatcgaatccactgagggcgcaaatagaacaaaaaggtgaagaaaaggtgaattctctcctttcttgagctgggacatccaacttctcagacatcagagctcctggaggccttcagactccgagacattacaccattggctcacctggtcctcaggtctttggacttggaatgaattacaccattggctttccaggtcttccagcttgcagatggcagattgtgggacttttcagcctccataactttgtcatccaattcccataataaatcgcctcttatatctgtaaaagtttggttctgttctggagatccc

SEQ ID NO: 460147 - DNA, 997 bp, Homo sapiens
cgttaaaatgtcctacccaccccaatctagatgcggctgtgggggaatgggagcggccggacctcccagcctgacagtgcatcaagagctttgcggagcctacagcccggatgggacgactgaggccctcccgctggcgagctggccgagggctcgtccctctccagctaaagcgccagcttacgatacagccaaactgccggctctcatcggctgtgggagcaggaggcccccaggggtaaatcccggagcctcgtctctgaagcctggcgcttgtgtctcagaaggtgcgggacccacaggacacttgaatcagcaggctcacgaccccccacccccctgcccccgcctcgtgtttgccctggacctccagctagggctgaccactaattctgtcatgtgaccccacagtgcagtttgtttattcatcctgaagataggcatttttatttttatttttttgagatggagttcctctcttgtggcccaggctggatgcaatagcaccatctcggctcactgcaacctctgcctcccaggttcaagtgattctcctgccttagcctcctgagtagctaggattacagatttataggagcattgtgactggaccaaggacaaagaagttcccaacctcctcagaccctcgctgctgcccagatgtctgccatggggtggccatcatcgaatccactgagggcgcaaatagaacaaaaaggtgaagaaaaggtgaattctctcctttcttgagctgggacatccaacttctcagacatcagagctcctggaggccttcagactccgagacattacaccattggctcacctggtcctcaggtctttggacttggaatgaattacaccattggctttccaggtcttccagcttgcagatggcagattgtgggacttttcagcctccataactttgtcatccaattcccataataaatcgcctcttatatctgtaaaagtttggttctgttctggagatccc

SEQ ID NO: 460148 - DNA, 713 bp, Homo sapiens
  misc_feature (2)..(3): n is a, c, g, or t
  misc_feature (683)..(683): n is a, c, g, or t
cnncccggctgcaggaattcggcacgatgttctctacttctgtgaatgtttgcaaaataaaaagttaaaaaaaaaatacataacatctacccatgaaacggaagtttgtctagttgtattttgtaaccggtttactattgtgaatccctcatcagtgctgcttctccccattcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcgtgactcctgacctcaagccaacagaagcctcaagttcggcttttcgcttgatgccagctcttggcgtgagtgtggctgaccagaagggacagggctctcagaacatacattacccgtgacctacgcagcaggagcctcgtgcantggtctgactgcatactacgttgctaccgt

SEQ ID NO: 460149 - DNA, 2200 bp, Homo sapiens
gttatttattacatttattcagcttctgggtgtcaggcactgttaggtgctgggggacacaatggcttctgagacagtgtgctcctctcgtagggcctaaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttgttcgggacgctgcggctcgactgcctaatggagaaggcacacgggcagagatctgtgaactgcttaaggactcccagtttcttgcaccagatgtcaccagcactcaggtaaatacagtagtgagtggtgcactggatcggctacattacgaaaaagatccctgtgtgaaatacgacattggacgaaagctgtggatctacctgcatcgtgaccggagtgaagaagagtttgagcggattcaccaagcacaagcagctgcagctaaagccagaaaagctcttcagcaaaaacccaagcccccatccaaggtggtgcgagtggtggcccagcctagccttcctgctgttccccagcagtcgggagggccggcacagacattgccacagatgccagcaggaccgcagatccgggttccagccactgccacacagaccaaagtagtgccccagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaacatcatcaagcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcgtgactcctgacctcaagccaacagaagcctcaagttcggcttttcgcttgatgccagctcttggcgtgagtgtggctgaccagaagggaaaaagcacagtggcctcttcagaagcaaaccagctgcacgatcgcatcgtgcagggactgggagtgatgcctcccaaagcaggccagaccatcaccgttgcaacccacgccaagcaaggggcctcggtggccagtgggtctgggaactgtccatacttcagcggtgtccttacccacatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacagaagtgtaacttcggcactatccagcctgtgggtggaatggcaatagcggagaatgggaacttcctattggagctgtttacggtgacagcccaggatttgtgccacacttgcttccttcatatgctggcttcaggtttctgatagatgaatggcacagctatgtttatactttaataccacatctaacaatgtttatgatagggttgatcacttccatgaaggcatcacaagccttgctgtgtgaagggcatctgaatacattttaatattttatatctgttcttcacaccttagcccctcactctggagaaaatagtaca

SEQ ID NO: 460150 - DNA, 1100 bp, Homo sapiens
  misc_feature (2)..(4): n is a, c, g, or t
  misc_feature (13)..(14): n is a, c, g, or t
cnnnttcattttnnagatgctgaatctgagcatcagagaagttaaggcactcgataaagacttcagtgatttttccagataatacaggggaagaattggaacttaaagccaggtcttctgtctccaaatcccatgacctttagagcatgtttgaaggagaaagttcacacattttcatctgagatacctactactctttctaaaactaaatgcggagtctcagctgcttctatgagctgggaggtcagtgctcctaacccccacattgttcaagagtcaactgtatcaggaaatacagagagaggcacgatgagaaggtggccatctgcagccaggaagaaaggcctcaggagaaaccaaacctgccgacaccctggtttcagactttcggcctccagaacttcaggaaaataaacttatgttctttaagccacttagtttggggtacatcttcggggtctgttatataggtaaactcatgtcacacgggtttgttgtacagattatgtcatcacccaggaagttcactgtgattaaaacaaatggccaaggactaagatggcccctgggggcaattaactgctttttggaagctttcaaactaatgaattatgagatgcaaaaatcaatggagacttactttaaaaaagaaacagcatccatcattagtgatgttagaaccagtctctggagtagaaggctgtgtttggaggcagcgcagcccagtggtggaggccgaagtctgcaagctcagattccctcgactgacatcccagatcttctactcactggctctgtgcatggagctaagctgactcctctttcaacagattccctcgccgctgaagtagggatgacaacagcatacctcttcagtttgttctgcagattagcaaacctgaagcaaagaaaaactgctgatttcagctgcattgccttggtccccaaaattccaactgcacagccctttgcgctacatggtgaagaaaacctcactcaaataccccgtaaagatgagctaggtcctctatttcattatttgtttgaaaatatctgagcctctgcctcacacaggagttactaggcacattctcagaaac

SEQ ID NO: 460151 - DNA, 1085 bp, Homo sapiens
gatgaggtcacacagtagagctaggatcttagcgaccatggggagctcagtgtccactctggctggggccagctggaggccttcagtacagccccagccaactctcactgaacagctggagcaccgacaccctgggcactcatttcaaatcatgaaatgctacttcacagatcacaggggagaacagtcacccaccgatgggaccaccctcagcttgaccagccctgagtccactgaggagagtgtggaagtgttctggccagggactatacagagagaagggtcgtccccacggccggggcctgccattccccgggaggagggcctctacttcgctgccagggaccgggggatgcgggactggagcagctccccatcctcagagtcctccgagtaccagtcctactcccagtaccagtcgtgctgctcctgcatgtgcgatgaggacaatgctgctccgcagagtgtgtgtgccttctacacgcacgtgcagactgtgcggggtgtggctgtggcctgggagacggaggccggcttcgagccggtcaccaggaagccccgcatccatgaagcccagttcatcaagaggcagaggtggaacggctcctccttcgaaatggcttccaacaccgatatgcgctgggacctggaagcctgcaagagcaactgcagccccgagcccgaggacatagacctgctggagtgctgcctgcaggagctgcgggagccgccggactggctggtcaccaccaactacggggtgcgctgcgtggcctgctgcagggtcttgccctccctggacgctctgctggagcacgcccagcatggcatccgggagggcttcagctgtcagatcttttttgaggagatgctggagagaaggcgggctcagggccaagcacatgaccaacagctggaggaggagcagagtccttcagacaacagcgaatgttcccggccccagggtgaggtgctctcagcacagcagcaggagaagcagtgagccagaggggagatacccaaccctgccctcacctccagggcctgggactgctccttccccagccagcagtatcagagccact

SEQ ID NO: 460152 - DNA, 988 bp, Homo sapiens
gacaaataggatcattatatccatgtcacagatagggaagcagaggcatgaatgtgacctgctcatggtcacatgggttgacaatcaaatctaggtcctctgactcctgtttttatatttcttttgcgtcaccgtaatttgtgtttttgtctttttaaagtaagaccgatagcccccctgggtggaaatggaggggagagctgccgccccgcgaggaatgccaagggctcctgagcgcgcagcacatgatccccgcctgccttcgttccccgggcactgctccgcagcgggcggggcgggcgggctgccaggacggcctggccagggagccgcttcatgatggctccgctgcagcggcacgcgggctccggcggtcaacgcagcgctgggcaggccccggccggggctagctgttgcggagccgctctgcctggttggcttggcttttcacaggcttacagcttcctagctcctcgagcacagcctgctagcacccctcgtcagcggcgccagcggcacctgggtgcccgcgcggtgccccagcatgttctagctcagtgcccttccggagccacgcatccgagcgcgtcgccccgggccttctgggcagaggctggggcgagcgctccgctagggagagggctgtctgctggcgaccgtcggcacgccagcctgcccgttctcggatcggtccaacccatttctttcctctgcccttctctcctgtcacctgcgcactttgctctcagagagaaagtctttcacttagttctggtttccccaagcaccgggctgtgggagatgttggaaattctggcaatagtttcctaggcacacagtcagcgtgattttctttaaaaaaaaaaaaaaattaaaagcgggagaggaaatctcctcctctccccacctctttaattaggcaaacaaggtactcaagcctgggtaacatagagagaccttgtctcttaaaaaaaaaaaaattacctga

SEQ ID NO: 460153 - DNA, 1383 bp, Homo sapiens
  misc_feature (2)..(2): n is a, c, g, or t
  misc_feature (5)..(6): n is a, c, g, or t
  misc_feature (12)..(16): n is a, c, g, or t
tnctnnacattnnnnnagctggaacagctggtacccttcaccatggggctgcacatgctcgtggcccagaactcacagaagagccctgtgctatcagccatggtcaaccccaccgtgttctttgacacggagcccttgggccgcatctcctttgagctgtttgcagacaagtttccaaagacagcaggaaactttcatgctctgagcactggagagaaaggatttggctataagggttcctgctttcacagaattgttccagggtttatgtgtcagggtggagacttcacatgccatgatggcactggtggcaagtccatctacagggagaaatttgatgacaagaacttcatccggaagcatacagtttctggcatcttgtccatggcaaatgctggacccaacgcaaacagttcccagtttttcatctgtgctgccaagactgagtggttggatggcaagcatgtggtcttcagcaaggtgaaagaaggcatgaatattgtggagaccatggagtgctttgggtccaggaatggcaagaccagtaagaagatcaccattgctgactgtgggcaactctaataagtttgacttgtgttttatcttaaccaccagaccattccttctgtagctcaggagagcaccctccaccccatttgctcgcagtatcctagaatctttgtgctctcactgcagttccctttgggttctatgttttccttgttcctttccatgcctagctagattgcagagttaagtttatgattatgaaataaaaactaattaacaacagcaacaaaaaaagtaccagagtctatcggttgtcaacatggcatcaatgaacacctcttgtaatcatatttaacttccagacaaaaactaaagagcaaaatcagacttctacctaacatgaagcagctgtcccttggacaattgtgaacaagctaattctacccaaaagaggatacaaaatccttttatccgtctttaggtgatgttattgcagcagggtaattggaaaagaagttagagacgtgttttgactgttaagatgtttaatgtagcatgattattaaaatatgtaaatatgtctaggaaaaatagaagcaagacagtctttagatttcaataattaaaaacccaatgtattagccaggttaacctgggctatctatttaaaattacttaatatttactgaacatctagttgagagtactgtgaatattttcaaagttctctttgacctctctttttttacattctcttcccagtaatctcctttactcccataggatcagctttcatccttaatgggaaaattctcaatcttttatttttcatattttagggtttcatttatttatttatttatttttattgac

SEQ ID NO: 460154 - DNA, 3667 bp, Homo sapiens
ctttcagcagtttttcatgatttttcctcacactgatcactatccaatcagaacaataaacttctaacactcccttactaaaagaacatggttaagggtgagaaaggccccaagggcaagaagatcaccctcaaggtggccaggaattgcatcaaaatcacttttgatgggaaaaagcgccttgacttgagcaagatgggaattaccaccttccccaagtgtattctgcgccttagtgacatggacgagctggaccttagccggaatcttatcaggaagatccctgactccatctccaagttccagaacctccggtggctggacctgcacagcaactacatagacaagctgcctgagtccattggccagatgaccagcctgctctacctcaacgtcagcaacaaccggctgaccagcaacgggctgcccgtggagctgaagcaactcaagaacatccgcgctgtgaacctaggcttgaaccacctggacagcgtgcccaccacactgggggccctgaaggagctccacgaggtagggctccatgacaacctactgaacaacatccccgtgagcatctccaagctccccaagctgaaaaagctcaacataaagcggaacccctttccaaagccaggtgagtcggaaatattcatagactccatcaggaggctggagaacttgtatgttgtggaggagaaggatctgtgtgcggcttgcctgagaaaatgccaaaacgcccgggacaacctgaatagaatcaagaacatggccacgacgacaccgagaaagaccatctttcccaatctgatctcacccaattccatggccaaggactcctgggaagactggaggtgacttggaacctgaccctgaggcagaagggaaagagagagggagggaagagggcagtgggctacctccacaggaaaccaagggctcccctgtggctgcagcagctctttcagccaagcccataaaactcctttccttactttctcggcgtgtgattgtgttgattgaagggcttttgattccttgccattccacacatttctctgtcctctgcacacacactcacaagtacaggcacagtgagtcaggaagggcctgtccatgtccatcctactcttgcccccagatctctcttgtctaccactgtggcctaagcagctaatgccgccacacactcactatcactggcatttcagagcccactgccagatcccaaatgtgaagttatttaatggaaatgttttgggtctgggcttcaaaggcaaggaatctcagagcatgagtttgtaagaaagtagatgagcacttggtgttgggtaggggacagagctggaccacagaaatgggcaggttttattattaaggcatcaataggcagatagcttcttaggcccaaagcaatgttttctctctgaactgagcttgcataacttgctctatgagctttcttggctaaacctgcagacctctgactggctgtgaatgaatgaagttgcactcccatcctattacattcagtgtttttccagatcctcataggagaaacgaaataatggtggcaagtatggattggtgcattcaataaatcaacaccttactcagcaccatgctaggtgcaggggccgtgtccctttggggaaagcttggcttgcctggtgcaagctggaggagagagcaactgaaatgagatggggcagagcaccactgtctgaggcattcaggagatcccagtcgtggatgtgcagggctggcctggcaaagagaaaagccaaagattctgaggttggacaggtctaggtccatggcagctctgcttctgacttggcatccccttgggcacctaacatagcttaggttccctcactcgtgaagtgggaataatgccacactgaactccaagtgttctgtgcctctaaaacaggcagcacatggagaacgtactcagcagaagccagttttcttccagaaccataacttagttcattgcaaagctgaaatactactttgaacagtggtgccagttacgctagatcttttggtagaaaatgacagcaaccaagtcaatcctcacaatagctgagaaccttctctggcctccctgtgtaccacactctcacaccttcatgtgggtaaaagaaaagatcaagaatgataccttgagggaggcttttttcccccaggactttcctatgttgttggcaagtttgctgagtggatgatgagaagcaccaagaggcatccatcagtgaagtggtattaacttattttctcctcacattgtcaaccacagcacacagcacatttcatttcttcaccccttgctgcttacttcctcttgtaatgcttagctatgacaaccctatcatatttctaaaaccttgggagatctagattcaaaattttcattttagtttttccctttattaagtgtttttcattgtagaagtaacagaaccacaacatactactaaatatagtagcttaaagcattcatcattctacagtatgtcagctgcaatgctggcagagttccttactagttatttttctgtatatatttttatacatagttaaaattatagcattcctgtcatttctgtcctgctttgaaacccatgctgttacctggtattaataaacacactttaaaacatctgcaagatagttattcttgtggatatacataactataagttactgttgtacctttaagttattttcagttttcactaatgggaatagtcttgtgatgagagcctatataactaaaacattttaaaatatttttaattatttccttggcatagcctcattattggaaatattgtgttaaagggtgtcttttaacaataatgttgatacatgccatcaaaatacgcttgacatcttcctagagtagctgtggcaaaatcttgaagactactcagctaacagaataaacgactctgaagaggagaagcccccagttaggagaagacagagtggcaagtgagatgttctggaaaccaggctcgccggagctggccaagccaccgacttgcttctcaaattcacttcacctcccttagctttagcccacctgtgtgtgaaaatgactttgggaaatatttgatgtggtttttaaaatgtatatagaaaaaaatttaagaaaattacagattatatattatagacaactaaatatttaagactttaagacttaaaaggcttactgcctctacatttcactcagactagtacatctcaatgccagtagtctgtgataaatttatgtaggtataatgagatactgatatggtttgggcatttgtctcctccaaacctcatgttgagatttgatccccagtgttggaggtggggcctaatggaaggtcatgggggtgggtccctcatgaatggcctggtgccatccttttggtaatgagtgagttctcactgtattagatcctgttgaaaattgattgttaaaaagaccttggcacctccctctcctctctctctcttcctctcactatgtgatgcctgctccccttcaccttccaccatgagtggaagcacctataccccaaagccctcaccagaaggaggtgccggcacctgtacagcttgtaagaaccatgactcaaataaacttcttttctttataaattaccta

SEQ ID NO: 460155 - DNA, 1696 bp, Homo sapiens
ccgccattgtcatcatggcccgttctcaatgagctgttgggtacacctcccagacagggtggtggccgggcagaggggctcctcacttcccagtaggggcggccgggcagaggcgcccctcacctcccggacggggcggctggccgggcggggagctgacccctcacctccctccgggacggggtggctgccgggcggagacgctcctcacttcccagacggggtggctgctgggcggaggggctcctcacttctcagacggggcggctgctgggcggaggggctcctcacttctcagatggggtggctgccgggcagaggtctcctcatttctcagacggggcggctgggcagagacggtcctcacctcccagacggggtcgcggccgggcagaggcgctcctcacatcccagacggggcggcggggcagaggcgctccccacatctcagacgatggaaacaggtctcgctttgtcgctgaagctggaatacggtggtgtaatcctagctcattgtatccttgaactcctgggctcaagtaatcctcctgcctcagtctcctgagtagctaggactacagtcatatgccaccatacctagctaatcttttttatttttattttttgtagagatgggggtttcactatgtagtccaggctggtctcaaactcctggcctcaaatgaccctactgcctcagcctcccaaaatgttgggattacaccatgagccaccgtgcctggtcccaacttctttttttctgcatggggctatccagttgttccagcaccatttgttgaaaatactatttgttgccccattgattggtcttcacagccttgtctaactcatattagttgaccacagacagatgggtttttttctaaactatcaactctattccattgatttatatgtctatccttatgccagtatcacactgacttgattagtgttgttctgtagtaagctttaaaattggaaagtgtgagtcctactttcttttttttcaagattgttttggctgttctgggtcccctgcaatttcctatgaatttgagaaacagcttgtcaatttccacaaagaagtcagctgggattctgatattgtgttgaaagataaacataggattttttccatgtatttaaatcttctttatttcaacaatgttttatagtttttgattttttatttttttgagacaagatctcactatgtcacccagactggagtgtagtaatcatggctcactgttgctcaagggattctcctgcctcagcctcccaagtagctgggactacaagcgtgtgccatcatgactggctgtttttctgcatctcttgagataatcatgtggtttttgttttttattctattgatatggtgaggccaggtgcggtggctcacgcctgtaatcccagctacttgggaggctagggcaggagaatcacttgaacccaggaggcagaggtttcaagcaattctcctgcctcagcctcctgagtagctgcaccaccacgcctggctcatttttgtactgttagtagagacagggtttcaccctgttggccaggctggtctcgaactcctgaactctggtgatccgcccaccttggcctcccaaagtgctgggattataggcgtgagcttttggagcctttgaaacacatgttctcccataacctttaaaacttc

SEQ ID NO: 460156 - DNA, 1993 bp, Homo sapiens
tgactgctgaggactgcgctgctgctgtgggttgagccatgcctgtaagcatcaacttatgggttcccgctcggggtcaaagtcgggattcctgtgaccattataaagtgatgaagaagctgcatttgaagagtttaagtgacttgcctggacttggatacattagcagaaaattcagggaagtttatggctatagaataacatcaacacagaatatccgccctcctaagcaaaagcttccagggtttaaacattttgcaattgatcattctgaggaaccagaagatgcagctccacctcatcacttcctgatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatggtaagtggtgcataggtagtaaatgtttgagttctgtcagcaagccctgcctctaagtgatattgaccatcttgaaaacattcataccagatgctttactccaggggattatattaataaactcacagctatttccaagtagctgtgttctgcttttctgacatttgttggcatttattgaaaaatggctatgatttttatgtagattgtgagacagttaaagtgaaatattgtccttgttcttagacacaaattatgcagaactggtacaaacatatacatgtttagtacttgaactgctgtggctcgttctgcttcctcaaagacccacatcaatatgtgtttgtgtatggagctgaggcacggatgaagtgatggtatcttactaatcagaaactggagcatgtggtcagattgcctttaaaggttggaatgatgtgaaatcagaactgtgacaggaaatgtgaaatgtgcagtcacatctgaagcttttcaacataacctttgcaagtgatattctctctggcatgatgcatttaagttctgatattatagctttatacataacccccaaaactaatcttttaaaaatctgttctttttcttattgcatgtcctgcacataatctttgaattaaaatttatcgtcattgttgagttcagaaaacattggcttagtttttcacttcaaaacaaatttcaagcatgaatatttacaaaaaaaagtatattttcagagtctgttaagataacactaataacctatttaaaacatgaaggtggcaacttaaggacaactattttttgctggatgttcatttgcttccagaaatctaaaaaaaaaaaaaaaaaagcttaatttgcttctgtaaccccatcctacctcctttgagtaggcacagtttgataggtctcatttcagaataaaccaaagtgattggcattccttgggcttactgtttagttttctgaattgttatcccagtgacttgggcaaataggcagccattttagttggctttttttaatgcacattttgaatataaagatgtcagtgtatgtatggaaggggagtcattttccagtttatattctgaaacaagtttttgttgttgttgttccactgaaggttttctttctttttgatccaaagaccaaccacttcttacataggaaagtccccaggctgacatctcatggctgctttgacttttggaaaagctgggctgctatttttgctgcagctactgcagctgtctagggtattaataattgagaaaatttggatgatagaagacttaattttagtgcaggcatgctgcacatgtagtcctatcttcatatgaaacagatgcattatttccctccaggatagatactgatgcaattgccccaggccattataatgtgtgtgtagaactggtatgtggaaattgtcaaccttttattctatttggtgcacctctattctaagcaccttctattggaggttttgcgtgttgttagagtct

SEQ ID NO: 460157 - DNA, 1042 bp, Homo sapiens
tccctggggtcctgaaattcactgccaagacttatagtagatagtaacttatggcatatatgttgctaatggtggatgaggtcatttcaagagctggaattgggaagaaggataaatacatacatggaggagcaatagaagtctaccttatggagcatgtggaagttcacattggttcatttcttgatggtggcaaaagggctatggcaattccaggcttcatgtcagctccttctagaaggagagagagagaggaaaagtttgcacaagtgagctactttcctacacccccagaaaacttcttattggctctcaagcagagccgagatctcagagacccaggagggcatcagacatatgaccacacaggttactgctgggatgtcactgtctctccctgtgtggtctttaagaggctcccctctcctgcctttgtgctagcctctggagtatgagaactgttgtgatgggttagataaaatccatcaactcacaatgtttttcctgtttccattcactagtgagtaacaaggttaaaagaaggaatgttctataaaataagatatagaatttgggttaggtttacaagtgaagagttcctctttgccctgcccccaaattatttttaggccccaggcctctgaagccaaggtaatctgcagggcagctttcacattttatcacaagtcagtggtctctcctcttccttgtccctcctatcttgccggcaaatggctctgtgggaaacccattctgcttcctgtttaaactgtagaaacaattcatttaattcaatatctagcttttgattctatttgcaaaaatacagttgtaaatagttccattcattagccaattttttttttggtctgttaagcatatttgggtcattttatagttaaccttggctgagggagagaagttctttgaagctcttacttacttacttgtgaatttttgggtctgatatggaggctttgcaggtcagaagcatggcttgactgacccaatgcccatttctggctctcttcatcctcgctga

SEQ ID NO: 460158 - DNA, 2608 bp, Homo sapiens
ttcttgagagtgatcttcaagttcaaaagatgttcgtgcagtttctgctttctcaccttctgagactctgagctctctagataacccttcctgctccctgagcttgcaggggacggtatggaggatcgtgtggcccgggaggatacagaggactgtggggcccgtcgctgtgtgtccagtgtctgcagtgtctcacacagagcaggtgcctgtgactgttcagtgaattcccaaatgcagctgtccatgatgttgctcaatatttgcagtgactctcagggcctggagggactcctctcaggaagtgagctgcagtctctgctgattgccacgacctgccttcgggagcacagctgctgcttctggaaggaacccaccttctgcgtgctaagggcaatctccaaggcccagaacctcagcatcatccagtacctgcaggccacagactgtgtcaggctctccctccagaacctctccaggctcacggacactctccctgcccctgaagtgagcgaggctgtaagcctgatcttgggattcgtgaaggactcctaccccgtctcctcggctctgttcctggagtttgagaattcagagggctatcctctgctgctcaaagtgttacttcggtatgatgggctgacccagagcgaagtggacccgcatctggaggagctccttgggctggtggtgtggctgacaacctgtgggaggtcagagctgaaggtgtttgacagcatcacttaccctcagcttgaaggcttcaagttccatcatgaggcatctggggtgactgttaagaatcttcaggccttccaggtcctacagaatgttttccacaaagccagtgactctgtcctctgcatacaagtcttgtcagtcatcaggaccatgtgggcctggaatgctcgaaacttcttcctgctggagtggaccctgcagcccatctcgcagtttgtagagatcatgcccctgaagccggccccagtgcaggaacacttcttccagcttctagaggccctggtgttcgagctgcactacgtgcctcatgagatcctgcgaaaggtacagcatctgatcaaggagagccctgggccatcctgcaccctcatggccctgcagagcatcctcagcatcgctggtggggaccccctcttcaccgacatcttccgggactcagggctcctgggcctgctactggcacagcttcggaagcaagccaagatcatgaggaagtcaggaaacaaagtgtccactcctggtgttcaggatccagaaagagaactcacctgtgtgatgctgaggattgtagtcacacttctgaaaggctcggtgaggaatgcagttgtcctgaaggaccacggcatggtgcccttcatcaagatcttcctggatgacgagtgctaccgggaggcctcgctcagcatcttggagcagctctcagccatcaacgccgaggagtacatgagcatcattgtgggtgctctatgctcatccactcaaggggagctgcagctgaaactggatctcctgaagtctctgctccggatcctggtgacccccaagggtcgtgctgccttcagagtctccagcgggttcaacgggctgctgtctctgctctctgacctggaaggctccctccaggagcccccgctgcaggcatggggagcagtatcccccagacagaccctggagctggttttgtacactctctgtgctgtgtccgcagcgctgcactgggaccctgtcaatggctacttcttcaggaggaatgggctctttgagaagctggccgaggacctctgcctgctgggctgttttggagccctggaggaagagggcaacctgctgcgctcttggcggctcactcccaccccggatacagagctgcctccagatccttggctttctggacagcatggccagcggcaccctccacttgcgtggggacctgaaggagtccctgaggaccaagcaggggccggttgtggatgttcagaagggagaaactggcagtgacccccaacgcaacttcaagcagtggccagacctggaggagaggtagcttcttctgccagtgtgtcatcagtgcatctctgtctcccattctcactctaacgtcttgcgcatgtgtactcagtaggaaggctcagctacagaatgggtgtgcagaaatgtcatgtgacctcaacttcctcaaatcaagttagctctgactccacactcttctaccttgggagctgatggaaaattcaatctgagtcagtactgggttggaggatgctgtcgagtcacataagaaccagggagggcaggaccctgctgctacactcaccttctcctttgggatctttactgtcctagggagccctggtgcctgggcctggcatccctgggtgtgccaggcagcctcggtcttctcaggttttatctcctccccaggatgctgccaggggtggggtgagatcctttgatctgcaggacacaaaccacagtgtccaccccaattatggaactctttctgttctttcttgctgcttctacaccccctaacaaagacaattgctctccttacttccgcaggccaaacacctcaatgagttcagac

SEQ ID NO: 460159 - DNA, 1767 bp, Homo sapiens
tttgtcagtgatggttcaagttttcctacccgagcactggtttccttagtggtttccatttgttaggctcattctgagattttttggttgccagctcatgataggcaatacgtcaggtccgtggctcctggttttcagcatagattataaagcagctaacatccatatcaacgtatacaccgtcaatgagccttggcttttctcactggcctggtgctccaggattaactcagtgaccacagacaacattgggctcctgagtcagcttgatcaccctcacttcttcatgggtcaggaccaggggaaaagggatccagagtcaaggcacagtcttacagggccagtaactgcatctaggccctctggtagacaggagaaatcgctgacttcttactatggtggcttggtcagcttcctggagatgaccctgaagggagctttggatggcaggtcactcagcacaggtggagcctttccacccacctagccccctgcatgtataagggtgactgttaggacacttgcagggactgtctgtgtttgagaatgccacatcaatcaaggttccttggcctgtctatcccctcttcctctcctcctccagccctggcagcagagcaagggacttagaccgtatgatccaaaatcccttctaactgtaaagttctttcactgtggtttatgtttttcagacaccaaagttctatgtgttcatgtggctccttgcagatatcatttctgtgctttttattgttgccatattttgttttcactgtctgctatgatgaagtctgtgtaatctatgatgaagtctatgtaatgtaatgtaatgtaaatcattggagtaattatcccagaacctttgtcatatagcataacctaatcaagagaggtaactatcctgaggtctgttccaagatgactgaatagaaacagctccggtctgcagctcccagcgtgattgacgcagaagacgggtgatttctgcatttccaactgagatactcagagtggaagtaagaatgaggaagatagatagatagatagatttgcacatagccatgaaacctcctgtccgagttgtggaaggtccttggactctagcagccctctacccggctctacccaagagtggaaaggaacaccaaggccatttcaattttgcagcaccatccaagaaactactacctatcaagaatgctgtcacacctttgaagcctggcaagcatgagattcaaccaccgatgcccaccgtggtctttgaactcacccaagcacccaccaggcaggctacaagtgaggctacctttcaaactacattgcccaccctgaaggtggataagccaaccatgccctccatagaggtcccctatccttaaataagagacctctaagagatccccatggctgaatactccaaataatcctatgtcacaatatattccattgcatctgacatagccttctgtgtttccaaagaagaattagccacatctcccctgcttcttcctctctctgcctaagggtggtgatggtggggagtggttgataaaggcacacagaagggccacggaggctctcaggggaaccattgtgctctcgctatcaagaatgcatctcaaggggctaggcaaggggaaaactgctgtgtgtggtcttggaactggttgctgtcaggtttatctcatcctaacacctccataatattttctgctaaaggagtgactgtgcatataagtaaaggcaacctctcaggaagccagaggt

SEQ ID NO: 460160 - DNA, 821 bp, Homo sapiens
aaagaagctcaccctttacagatgccccagagaggcccccatcctgccctgcagccagcttcctgggcaagtgggatcagcaggccgctggggacctgggagacatcctgctgctgcaggagtcctgtgcagagcagaggagagagcagtttggcaagtgcaggggtcccactcttcttttggttggtggcagggagcaggtggggcctaacctgggtggacagtgtctacctcccttctgtgcattttgcattggccttaattggttctcccgggatagtcacgaaagcccgacctttgttccagaaaagaacactgagcctcagagaggtcaagcaattggcccaagatcacacagcctgcaagaaacagagatgggactcagaccctggtctatttggctcccatgtgccttactactatgttatacccacccctccagtctccttctaggtcaccagctgggatgggaggccaactctccaaatcagaagagctttattgaaaaacaaatgacaaataaaagttgtatatattcaaggtatacaatgtgatgctttgatacattgtgaaatgatgacctcagtcaagctaattaagatatccatcacttcctggaggtacctttgtgtctatatgtgctccgagcccctggaacaatgttgttcattctgcggatgctcagcaagcccttgctgactgtctttatttcttcacctgcaataagatccccccaggcccatatggaaacgtaaatgttcttgagggactaattcagtgagactcttccaggggaagttcagtcctcctgggaagtgatt

SEQ ID NO: 460161 - DNA, 464 bp, Homo sapiens
cgggcttttccatagggatataagtgaaggagatacccacagaggagcaggcaggctgggactggtgcgccacaggggacacacagagataaatgcacgagagctggaggctagtctggccccagggtgaatgggagtggatctgaaccaagacccagggactgagggagagcctggacctccaggaataggtcctaggctcagagaacctgggaggggcataagcaaatgaattgcttatgaacttgctgcagaactttcagcaaattgctttgctgttttcagatttgggtcacagttcaagcaatgtagtcctgtaacaatgctgtccttatacctgcataaccaaagcttccagacacagagcacatttccatcatgtgctccaacacacctagccatcatgcctcctcatgcaggtttgcctacctgcagtgccctgcccacttgacccctgcaactga

SEQ ID NO: 460162 - DNA, 830 bp, Homo sapiens
aaatgtatccagggtgactctgtttctgctccccagaggcgaaaatgtggcaacatcaaggcagccaacgcctgggccaggatccaggagcagctttttggggagctgggcttgtggagccagggggaagaaaccaagccctgttccccatgggaactcgactggagagaaggaccagctcgaatgaggaaacgcatcaaacgcttgtctcctttggaggccctgagctcaggaaggcacaaggtggctcctgtcaacaccacgtgtccctttatgctgctgcagatgaactgacactgagggaggctgagggcgagccggacgaggtgggggtggactgcacccagctgaccttcttcccagccttacacgaaagtctgcactcagaagacttcttggaactgtgtcgggaaagacaagttattttacaagagcttcttgataaagaaaagagtagaaccgacctcagttctagtcccaacttggccacatattaaaccgcatgtcacctaaccgttgtcagcctcagttttctcatctttaatgtggagttctggccaccatctgataacattctgctcaggcttaaatgggccaatggaagtacagggactacttcagagctgggcataagagaggtgctcatcaaagatttgggtcacagttcaagcaatgtagtcctgtaacaatgctgtccttatacctgcataaccaaagcttccagacacagagcacatttccatcatgtgctccaacacacctagccatcatgcctcctcatgcaggtttgcctacctgcagtgccctgcccacttgacccctgcaactga

SEQ ID NO: 460163 - DNA, 1179 bp, Homo sapiens
ctttggcacagcgtagtttgtgtttatagagctgcctcccaggacctcgtgagagacagctcttttcaaaccagcgcagtcttaaaacgcaagctcagtctcgcagactgtgtggccatggaagaaagcccagagaagggagccagaccccgaactgctacactgtgggtatcagtgttgctcattcattcattgccattgccagttggcgattggtactgtgttcctagagtagatcataatgttgtgtttctgtcctttgcttcagtgcccatctacgtgccgttcctcattgttggctccgtgtttgtcgcctttatcatcttggggtccctggtggcagcctgttgctgcagatgtctccggcctaagcaggatccccagcagagccgagccccagggggtaaccgcttgatggagaccatccccatgatccccagtgccagcacctcccgggggtcgtcctcacgccagtccagcacagctgccagttccagctccagcgccaactcaggggcccgggcgcccccaacaaggtcacagaccaactgttgcttgccggaagggaccatgaacaacgtgtatgtcaacatgcccacgaatttctctgtgctgaactgtcagcaggccacccagattgtgccacatcaagggcagtatctgcatcccccatacgtggggtacacggtgcagcacgactctgtgcccatgacagctgtgccacctttcatggacggcctgcagcctggctacaggcagattcagtcccccttccctcacaccaacagtgaacagaagatgtacccagcggtgactgtataaccgagagtcactggtgggttcctttactgaagggagacgaaggcaggggtggattctcgaggtggaagtccgcacatgaccttttgtttgtgcagatgatacttgctgcttctttctagattttagttgctgtttagcaacaaacatttggtctaacagaaccaagtgaggatggcaaaggtttaaaatcaccagagctatcctaaaacaatttctttcactagtaaattgtaaagctaagcatgacccagagtggattttttctagcttttattcttaatgaattttcattttttgaccagggtaatatttctatattagttttagttttaagaaactttgtatctaatgaaaggc

SEQ ID NO: 460164 - DNA, 4479 bp, Homo sapiens
ggtgccttttctaagcactgacgctaccgctagaccatggtccgcttggcaacgggcgtcttcccaggcgctggcttcaccgctagacccaggagccctctggtggccctgtccgggcataacaggaggctcgcacttgtcttctggtcacttctcactgtgtcccctcggctcctatctctgtatggcctggtttttcctagagcccccgcctgaggcccgccttccgcgcatgcgcccaggccggtccgcaggactttctcgccccagccggcagccagctcgttcgcgctggggtcaccgcgagccggtccgcagcggggtcaccgcgatccccggcgcagacacagaggccgcccccagccccgccgcctcgtgggcccgcccccgctgcacgctcccttacccctcggacctcgcagggccgcggcggacacggcccgataggggacgtgaacgcgcagaactacatttcccagcgtcccgctcgcgctggaactacactttccggggggctcggaggagcacccgacggggactcggattgaaggttccggatggaaaaaccgcttggttctctcacagacatgttgggccagcagtgctggctccatcctagatttcttccagtcctccccagttagccgccaaggggcttttccaaccggaaacctccaatccgcgaccccggcgggtgcaccgccgagccccccgggaagtgtagttccagcgcgagcgggacgctgggaaatgtagttctgcgcgttcacgtccccgatcgggccgtgtccgccgcggccctgcgaggtccgaggggcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggaaaatgatccagtcacaggacctaagtgtgaaacaggctacctcatcatggaccccaataggtcagactttgacgggccgtgacaataaccaggtaaatcgtctgaggcaacagcagaccatggctatgacgccactccaagcaggatggtcgggcccggaggactgaacatggcctcagcagtcacctcggcagttgccatgccaggaaagacgccccacagcccactggagagacagaagaatctgtgtgaatcttctttacctggcctgaggcatcaattcaggcacagcagaacactggccaggaaactgaacgtgacctgaatgtcttccaggctgagacaggtcctgagtgcaatcccagagggcacacgtggtcccctagaaacaacgaattcacaaggtcaggtgccccagccgggcacgcacgcctcaggttgtgaggttaacagggatccaaggtggcttcccattgtcgggcctctgtccagtctggatcattgggtttaggccttgacttcagagggcctgcctgggactgagttccaaaccattctgtttatccatgacatgagtttgttagtcccaccttatcaagtgtggacagtctctggaggagttctgcacagagcccaggagccaaggcagtcctctgcctctcctcgtcagcaccgtgaggaagccgaggtgtgggctcagcagacggtccaagtccacagccgccacagtccatggaaaggcagcaagaggacctcttgtgtttggttttttaggaggaggagaaagcttttaggagcaggtctgaaaaataaagatcattattattttttccctttccctgagcctcccagatgccagttttgttttgtttttctgttacctgtgtgtcccatgtaaaaggggatgaaagggccttgcaccgtgccccgtggagtctgaggtgtctgtaactggagaagaagagtgcgtgatggagggcagcctggagaagaaggacgcgtgatggagggcagcctcgagaaggagcgtgacagagggcagcctggaaaagggcgcgtgacggagggcagcccggagaagagggacgcgtgacggagggcagcctggaggtacccgtgggaagtgccctgcggggaacggctgcgtgaggcctgaggtcgcttgcctgagctgcgtagtccaggctgcggttatctcgtcccctcccagcagccaccgaagctgtccgttacaacagtcagttaccctgttgctcgtgagcgatacggttcctcagacgccccatgattgggcctattgatgtgtagtttggactggggctgttctcagaagcactgcgctcaggaaacctgaacgggaagcagatctggtcatgtcgggcctggatagtgtggcccaagtcagtggaatgtgtggggttggctgggccaaaccacaaggaaacagcgaaacattgatctacctgccgagaatgtcatggccgattgacctggcaatctacctttgggcgctgctagccttgaccagagtctggaaagcaggacagctgtttcccgtggttcaccgtcttctgagagcagaagcagcacacgcggaggctcggtctaggccatctgtgttcggagtttcttccttctggtgggttcgtggtctcgctggctcaggagtgaagctgcagaccttcgcggtgagtgttacagctcttaagatatcatttgaggatgtggctgtggatttcacgctggaggaatggcagctacttaatcctactcagaagaacttgtacagagatgtgatgttggagaactatagcaatctggttttcttgggttttcaaattctcaaacctgatgcaatgttcaaactggaacaacaagatccatggataataggtcaagaaatcctaaatcagaacttttcaggagagaagccctatcaatgcagtgagtgtggaaaagccttttcacagaagtcactgctcacggttcatcaaagaactcactcaggagaaaaaccgcatgggtgcagcgaatgtcagaaagcttttagtaggaagtcactcctcattttacatcagagaattcatactggagagaagccgtatggatgcagtgaatgtggaaaagccttcagtaggaagtcgcagcttaaaagacatcagataacgcacacaatagagaaaccctacagttgcagtgagtgtgggaaagcattctcccagaaattaaaactcatcacacatcagagagcgcacacaggagagaaaccctatccatgtagtcactgtggaaaagccttcttttggaagtcgcagctgattactcatcagaggacccacacagggaagaaaccttacggatgtggtgagtgtcaaaaagccttcagcaggaactcacttctcattaggcatcagaggattcatacaggagagaagccctacgaatgcaacgaatgtggtgaagccttcatcagaaaaccacagctgattaaacatcagataactcacacaggagagaagaactatcgatgcagtgattgtgaggaggccttctttaagaagtcagagttaataagacatcaaaaaattcacttaggagagaaaccatatggatgcattcaatgtgggaaaaccttctttgggaagtcccagctcctaacgcatcacagaacacacactggggagaagccttatgaatgcagtgagtgtgggaaggccttcacccagaagtcaagcctgatatcacatcagagaacacatacaggtgagaaaccctatgaatgcagtgaatgcaggaaaaccttcagtgagaagtcaagtctcattcatcatcagagaacccatactggagaaaagccctttgaatgtagtgaatgtaggaaagcttttgcctggaagccacagcttcttaggcatcagagaattcatacaggggagaaaccctatgaatgcagtgaatgtgggaaagcatttgttcagaaagtgcagctcattaagcatcaaagaaatcacacaggagagaaaacctatggatgcagcgattgtgcaaaagctttctttgagaaggcacagctgattatacatcagagaattcatacaggagagagaccatataaatgtggtgaatgtgggaaatctttcacaagaaagtcacaccttatgaggcatcagaggattcatacaggagataaatactatggatgcaatgagtgtgggaccaccttcaacaggaagtcgcagcttatgatacatcagagaaatcatataatataaaaatcatgactttggcgaatgcagaaaggttgctatcaagtgtcatactttctgacacttttgaggatgcatgtgggagagaaaccctattgaggcagtgactgttgaaaaagcttgaattgaggagtcaagagtcactaagcagaatttagaaagagaagtttttaaaaagcaaacagtgtaaaaaaagtcatctcccagaagacactactcgttacatattggatgact

SEQ ID NO: 460165 - DNA, 905 bp, Homo sapiens
ctgtctttggaacgatgtgcacacacccgtatgcaaacttttcagacctgatgctaaagaacttccttccagacagtatcctcgcccaggtgttcctcgccaaaagttccattgtttataggggctacgtgctttgggttaaattatcatgtcctctccaggtggccttttcaaaggcagatatttggtggctaggtagcccagtcagtctggaagaagccctagaggggtcatgggtccttcctccaccagaccctaggggcctggagcccggcagctcagggagccaactatgcttgggcactagcgctttcacttccagagctccttcccatgctgaagaagaaggggctcagagacataataatctgaccatgcctccacagtggcagaggcaggagcctggaagcacatctcttctgaggggagaaggcaaggcattgctcgtcagtgggggatgaggctgctggaggagccacagcctcaaagttggctactcaacatgccagacatagagagaggagagtagaggcatgccttgactcctggagctaccacttggaagtggaatccctgtcttctgttctcacttcagtggccaaggaagagggcatgaggatgcacagtcctatcacacgccctgatggcagagaggcagagtgctcgcctctgctgatgaccaccagacattgtaaatggggacctctattttatggtatcttacactgtgagatgatgttatgtcaccacatctgtgagcacagggtgcacactatttctgattcatctttgcagctgacacatagcatgaaataaaaaatgtttgctttacagactaagttaattaattggtggacaataaaggagggaagccacaggactttgtacaatgacatgatgaggga

SEQ ID NO: 460166 - DNA, 1904 bp, Homo sapiens
gactacacattaggctggggcttcctgtcctgctgtcgtcatgccaggaggcagaaggcttgtctgctttcaggcatactgggagagtgggtttgcctacgagtccccaagcagcgatggtctattcggagctgtgggcaagggcatgcagacctgggcccaaaccctgactctggccctttccagacacatacaaggtcctggctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcggaagagacgacagcgtgggtgaccctcctgggcccttgagactcgtctgggacccatgcaaattaaaccaacctggtagtagctccatagtggactcactcactgttgtttcctctgtaattcaagaagtgcctggaagagagggtgcattgtgaggcaggtcccaaaagggaaggctggaggctgaggctgttttcttttctttgttcccatttatccaaataacttggacagagcagcagagaaaagctgatgggagtgagagaactcagcaagccaacctgggaatcagagagagaaggagaaggaggggagcctgtccgttcagagcctctggctgcatagaaaaggattctggtgcttcccctgtttgcgtggcagcaagggttccacgtgcatttgcaatttgcacagctaaaattgcagcatttccccagctgggctgtcccaaatgttaccatttgagatgctcccaggcgtcctaagagaatccaccctctctggccctgggacattgcaagctgctacaaataaattctgtgttcttttgacaatagcgtcattgccaagtgcacatcagtgagcctcttgaatctgtttagtctcctttttcaacaaaggagtgtgttcagaaaaggagagagaggctgagatcattcaggagtttgttgggcagcaagcatggagcttcttgcacaaattctgggtccataaacaacccccaaagtccctgctgatccagtagccctggaggttccccaggtagggagagccagaggtgccagccttcctgaagggccagaaaatttagcctggatctcctcttttacctgctaggactggaaagagccagaagtggggtggcctgaagccctctctctgcttgaggtattgcccctgtgtggaattgagtgctcatgggttggcctcatatcagcctgggagttatttttgatatgtagaatgccagatcttccagattaggctaaatgtaatgaaaacctcttaggattatctgtggagcatcagtttgggaagaattattgaattatcttgcaagaaaaaagtatgtctcactttttgttaatgttgctgcctcattgacctgggaaaaatgaaaaaaaaaaataaagcaaatggtaagacccttctggtgtgtgtgacttttctgggtaggcttgcagccaccccactacctctttctgaggttggtcagcctagacaaggtgcctgcttaggggtgg

SEQ ID NO: 460167 - DNA, 1878 bp, Homo sapiens
gactacacattaggctggggcttcctgtcctgctgtcgtcatgccaggaggcagaaggcttgtctgctttcaggcatactgggagagtgggtttgcctacgagtccccaagcagcgatggtctattcggagctgtgggcaagggcatgcagacctgggcccaaaccctgactctggccctttccagacacatacaaggtcctggctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcggaagagacgacagcgtgggtgaccctcctgggcccttgagactcgtctgggacccatgcaaattaaaccaacctggtagtagctccatagtggactcactcactgttgtttcctctgtaattcaagaagtgcctggaagagagggtgcattgtgaggcaggtcccaaaagggaaggctggaggctgaggctgttttcttttctttgttcccatttatccaaataacttggacagagcagcagagaaaagctgatgggagtgagagaactcagcaagccaacctgggaatcagagagagaaggagaaggaggggagcctgtccgttcagagcctctggctgcatagaaaaggattctggtgcttcccctgtttgcgtggcagcaagggttccacgtgcatttgcaatttgcacagctaaaattgcagcatttccccagctgggctgtcccaaatgttaccatttgagatgctcccaggcgtcctaagagaatccaccctctctggccctgggacattgcaagctgctacaaataaattctgtgttcttttgacaatagcgtcattgccaagtgcacatcagtgagcctcttgaatctgtttagtctcctttttcaacaaaggagtgtgttcagaaaaggagagagaggctgagatcattcaggagtttgttgggcagcaagcatggagcttcttgcacaaattctgggtccataaacaacccccaaagtccctgctgatccagtagccctggaggttccccaggtagggagagccagaggtgccagcctggatctcctcttttacctgctaggactggaaagagccagaagtggggtggcctgaagccctctctctgcttgaggtattgcccctgtgtggaattgagtgctcatgggttggcctcatatcagcctgggagttatttttgatatgtagaatgccagatcttccagattaggctaaatgtaatgaaaacctcttaggattatctgtggagcatcagtttgggaagaattattgaattatcttgcaagaaaaaagtatgtctcactttttgttaatgttgctgcctcattgacctgggaaaaatgaaaaaaaaaaataaagcaaatggtaagacccttctggtgtgtgtgacttttctgggtaggcttgcagccaccccactacctctttctgaggttggtcagcctagacaaggtgcctgcttaggggtgg

SEQ ID NO: 460168 - DNA, 847 bp, Homo sapiens
gactacacattaggctggggcttcctgtcctgctgtcgtcatgccaggaggcagaaggcttgtctgctttcaggcatactgggagagtgggtttgcctacgagtccccaagcagcgatggtctattcggagctgtgggcaagggcatgcagacctgggcccaaaccctgactctggccctttccagacacatacaaggtcctggctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcggaagagacgacagcgtgggtgaccctcctgggcccttgagactcgtctgggacccatgcaaattaaaccaacctggtagtagctccatagtggactcactcactgttgtttcctctgtaattcaagaagtgcctggaagagagggtgcagaagctacagaagaaaagtttgaagcctgcagcaaggt

SEQ ID NO: 460169 - DNA, 747 bp, Homo sapiens
gactacacattaggctggggcttcctgtcctgctgtcgtcatgccaggaggcagaaggcttgtctgctttcaggcatactgggagagtgggtttgcctacgagtccccaagcagcgatggtctattcggagctgtgggcaagggcatgcagacctgggcccaaaccctgactctggccctttccagacacatacaaggtcctggctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcggaagagacgacagcgtgggtgaccctcctgggcccttgagactcgtctgggacccatgcaaattaaaccaacctggtagtagctcca

SEQ ID NO: 460170 - DNA, 1805 bp, Homo sapiens
gactacacattaggctggggcttcctgtcctgctgtcgtcatgccaggaggcagaaggcttgtctgctttcaggcatactgggagagtgggtttgcctacgagtccccaagcagcgatggtctattcggagctgtgggcaagggcatgcagacctgggcccaaaccctgactctggccctttccagacacatacaaggtcctggctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcggaagagacgacagcgtgggtgaccctcctgggcccttgagactcgtctgggacccatgcaaattaaaccaacctggtagtagctccatagtggactcactcactgttgtttcctctgtaattcaagaagtgcctggaagagagggtgcattgtgaggcaggtcccaaaagggaaggctggaggctgaggctgttttcttttctttgttcccatttatccaaataacttggacagagcagcagagaaaagctgatgggagtgagagaactcagcaagccaacctgggaatcagagagagaaggagaaggaggggagcctgtccgttcagagcctctggctgcatagaaaaggattctggtgcttcccctgtttgcgtggcagcaagggttccacgtgcatttgcaatttgcacagctaaaattgcagcatttccccagctgggctgtcccaaatgttaccatttgagatgctcccaggcgtcctaagagaatccaccctctctggccctgggacattgcaagctgctacaaataaattctgtgttcttttgacaatagcgtcattgccaagtgcacatcagtgagcctcttgaatctgtttagtctcctttttcaacaaaggagtgtgttcagaaaaggagagagaggctgagatcattcaggagtttgttgggcagcaagcatggagcttcttgcacaaattctgggtccataaacaacccccaaagtccctgctgatccagtagccctggaggttccccaggtagggagagccagaggtgccagccttcctgaagggccagaaaatttagcctggatctcctcttttacctgctaggactggaaagagccagaagtggggtggcctgaagccctctctctgcttgaggtattgcccctgtgtggaattgagtgctcatgggttggcctcatatcagcctgggagttatttttgatatgtagaatgccagatcttccagattaggctaaatgtaatgaaaacctcttaggattatctgtggagcatcagtttgggaagaattattgaattatcttgcaagaaaaaagtatgtctcactttttgttaatgttgctgcctcattgacctggaaagtgctactctggaaagtgctactctggaaagtg

SEQ ID NO: 460171 - DNA, 1126 bp, Homo sapiens
ggctgctgagggtgtgctgggtcccccagcagtgccagcccaccggcgctgcgctcgatttctcgccgggccttagctgccttcccgtggggcagggctcgggacctgcagcccgccatgcctgagcctcccaccccctccgtgggctcctgtgcggcccaagcctcctccacgagccccaccccctgctccatggtgtccagtcccatcaacgacccaagggttgaggagtgcaggcacagggcacgggactggcaggcagctccatctgcagccccggtgcgggatccactgggtgaagccagctgggctcctgagtctgctggggacctcaaggtttgtgaacacaccaatcagcaccctgtgtctagctcagggtttgtgaatgcaccaatcgacattctgtatctagctactctggtggggccttggagaacctttgtctgcagcttcactcctgaagctagggagaccaggagcccaccaggaggaacgagcaactccagacgcgccgccttaagagctgtaacactcaccacgaaggtctgcagcttcactcctgagccagcgagatcacgaacccaccagaaggaagaaactccgaacacatctgaacatcagaaggaacaaactctggacacgccacctttaagaactgtaacactcaccgcgagggtccgcggcttcattcttgaagaagagctggtagtgtttaagagtctagtccagaacactgtctcaacagcatcattagatcagggctcctaatccctagaaccctgtgtaacactgcaaccctggccaggcatagtggttcaagcctgtaattccagcacttttggaggccaaggtgagaggattgcttgagcccaggagttcgagaccagcctaggcaacatagtaagaacctatctttacaaaaaacaaaaaattagccaggcatggtggtgagcacctgtagtcccagctcctggggaggctgaggcgggaagattaattgagcccgggagtagaggttgcagtgagcccagatcatgccactgcactcccacctgggcaacagagtgaaattccatctcaaaaaaaaaaaaaaaaaaaaaaaaaaaaaaggccaggtgtggtggtg

SEQ ID NO: 460172 - DNA, 1540 bp, Homo sapiens
gagagacagcaggtagttgagacatggctttattcagcagcccctcacagggcaagggagtactacctgtgctgttcaaattacgtcttgtgggtggccaactacctcatctgaatgcagaatcttcagaaaaatacacaaaatcccatgaaactttgatggtggttgtggatttatctgtgctttctaataaaattttaattttgaggaggattaattctcagctaaaacatggcagccaaaatttaatagtgaaaaggagtgagattgaaaaacaaggaaaaaagtcagtgtcttggtccattttctgttgctataacagaatgccacagattaggaaaccagttccaaggctactgtatcaatccaaagaagaaacaatagtggttgaaaccagagatgtagcattggagggattggcacatgcagatatggtggctgagaagttccacaatcagttgtctgcaacagcagtctcaggtatgtctttatcagcagtgtgaaaacatactaatatagcaggaaagccagcccaggtggagatccagcccaaacctgaaggccagagacccaggggagccaatggcgacaatctccatctgagccagaaggcctaacaatagggagtaccagtgtctgaggacaggaggagatggatgtcctggctccagcggagagagatgccattccaagaaaaccatggaagcagaaaagaggaaagcagaaacacagatgaagcaagaggctatgtcctctgtgcatggagacagcagatctattagtagacaggatgaagagaaaaggtgtgaagaaaagccacatggctgatgtgacaaggaagaaagtgggtctctcagctcttcccttcttgtttttgcccttttcccagtaccaagaaatgtatttttgggggccacattcttcccaccataatttagaaggatgctgttgccaggtttgaagaccacttgaaacaataattgttgttattctgctatactcaccaagaatgacaaaactatttacatactggggatagcgtgctagaaaaattgctaaacaaatagtattttttccttccataaaatcagagttgtaaagagcaatatattaggcattttctttgccagagaactttagctatgattttctgcttctttaaaattcatattaatgatcgtagataccaggtatctaagggaaagactctttgcaacatcttctatatataccctgggtgtttctgtattgaatttacttaagatttaggctctacagtttgatctcaatcatgtaaaaatatatagcaagaaggctcctgggacaaaaactgaaatgtttattattaattttctctgggcattgaaattctggatgattttattttttcatacttctttctattttccatatattttacaatctgtattcatagcttcaaaaataaaatagttgctgtgaataatcactctatttcatgtttccacccctcctccatgcagcccatgtgcctcaagagaggctaattgatctgagctgt

SEQ ID NO: 460173 - DNA, 646 bp, Homo sapiens
cccctactgggaagtgaggagcccctctgcccggccacgaccccgtctgggagcaggcctccatgatgtaatactcgaaggaagctcttggaacaaaagaagggaacttctgatatgcaagaaagaatgaagagctcaggaatagactacatcacaagaaggtcagggtgctttctgctgagtatcgatgaaagcggacaagaatatatacagcagagctcttttcgctctgtcttcttcagtaagcaatgctggtggattcttctgcatcaacttggttaaactgaaacaacttatcccagaatttcttctgtatatatttccaagctcatcatcagacacctggctgcagacccacagaggctatagctgcatagaagcaacatttcccatggtcctccaagatgccccctttatggttgacttcagagactggacacagtctcagattgtccattggctactgactcatattctgttcctccaactcgttgcgtggacctctgctacccagttccttctcaattgtgtaaggtctaattgccatcataaacatcttacccacacttaccatgactctgattccctggctgaatcatgacttataacacagcaaccctttcatctctgatgctgaatctgattc

SEQ ID NO: 460174 - DNA, 1519 bp, Homo sapiens
tccactttccatagagccagaaagaactgccaattagtaatgtattcccctttgaagaagtctccctgtactaatatccgcaactcttcagaagggccagaccagaccctcatgtgcacagcacaggatccactcatccacaacgtggccttgctggccctgagctcagctcagaacttaaatgaaggaaatccacaaggagcacccccacaaggaggcaacaaacctcaaggtcccccatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggagacaagtcccgaagtccccgatctcctccaggaaagccacaaggaccacccccacaaggaggcaaccagcctcaaggtcctccacctcctccaggaaagccacaaggaccacccccacaaggaggcaacaaacctcaaggtcccccacctccaggaaagccacaaggaccacccccacaaggagacaacaagtcccgaagttctcgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggagacaacaagtcccaaagtgcccgatctcctccaggaaagccacaaggaccacccccacaaggaggcaaccagccccaaggtcccccacctcctccaggaaagccacaaggaccacccccacaaggaggcaacaaacctcaaggtcccccacctccaggaaagccacaaggaccacccccacaaggaggcagcaagtcccgaagttctcgatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccccacaaggaggcagcaagtcccgaagtgcccgatctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaatgccatgacattgggaaataggtcatcatagctctaacttctgtataccaataaaataattagcttgcaatttctgattgtggtgtctgtttctcaatatttgtgaat

SEQ ID NO: 460175 - DNA, 1040 bp, Homo sapiens
gtttccaacttccggaggctgcccacatgcctctgctcatggctccttccatctttaaagcctctcactccaacctcagctttcgtggtcacagtaccttctctcaccctcttatctccctcttatcaggtccattcctcctggaggaatgtaaaggcattctggaaaaacctgattctcattccaaggagttggaactgagcagaagaaggcgcaaaaggcccagagagtcagggcatagttcaagggaacctggtgatgtactcttacatgtcagcaggtcaggaagcaagcaagcctggaatttaagtccagggaagcagggagaaagcactttgctaaggaatcagcccagaagacagtccagacaggaacctaggttaaggaagtgcaatgggaagaccacccccgactctgatgccacccaggaaatgagtttgctgtggcctaacagttgttttctgagtatattttcatgtcaaatagcaaaagtagaacttttggaggaggtgtgaagaaatgaagagtgactagaggaaaatagagagtcagaagttgcagtaggaagcaccaaagaagaaaactctgccttcactgagctctggaagaggtggaagagatgggagacttacagttacatgctgaccttttcagtcatttggaggcctcatgttctaggctcttaactgatggtgatgaagccaccaacaggtgtgaaaggtgtcctcttatttacacactattcctttgaatagtgtgattaagttttcattcttacagttctatgctacgaccaatttgataaaagattctcatttaaccatgctgtcttcatatatgtaagcttccttgatatctaaagagtgtgagctcctgagccaagtccagtggaaaatttgcagtctcttctaggattagatgaagacccaagaattcatcttgctacagtgcgacaagacttgtcacagatagcttggatttatgggtgctcttccacagcagaaatcgtttcaccttttcaggtgacctttacagaatca

SEQ ID NO: 460176 - DNA, 2618 bp, Homo sapiens
tgtggtggcgtatgcctgtggtcctgcctactcagaaggctgaggagggggtgatttttccccaccccaaccccatgagacatttacagtgtctggagacatttctcggttgtcacaactgggaacgtgctactggcatctggtcaaaaaaagatactgaaatacaaggtagtttatatcagcccagtagtaagccaaaatctgataccagcatcagtgatttcctcagtgaagaggatgatatcgtcccttctaaaaaaataagccagtcaacagctcttgccagatcatctaaggttctggagtcaagtgatcataagctgaagaagaggtcagcaggcaagagaaatagaaatttggttgaacaacagatgctctcagaaactccagaagatgcccaaacgatgacactaagtgtggatagactggcccttttgggtagaacacattcagtcagaatcatcatcgaaaccatgggagttcctccagatagtcctcagatgacccctggcaaaaaaagctatgctggtccaccacctaaggtgactacagcaaaaaagcgcactttctttgtagaatatcactttcctgtgggcttttcggaaagcggattgggaaagacagctttgatcactgaggttgttcgactcgcctccagtaaaattacagatggaaaggtgaagttccagcagcgatttgtgtttccagtacagtttggtggcccaatgatagagcactggtggaattccaacctcactttccaaatttatgtaaagaaaactccacagaaaaagccagaagtcattggatctgtgtcactttctttgcgagctgtcattcaatcagagctgctttctttcagtgatcagcttccagtgcaacaagaaaatggtcagtctccatttggccccctcaaggtaaccatggagcttattacagataacaaagatttcactggtatcaatactaagttaagtggcaacacccattataccccactttgtgctcctacaagtccaaataaggcactaccagaacttaaccaagatatgacctgtaccaaaaatccacaaaacttaaaccaaattcatgaggaaactgcaaagaaagcacagaacttggtgctccccaaccgaaagtcaccaagccctgtagcaccacatccttcaaccttcgtagctacgccagcctcccataatttagtcaatcagacaaatgggacaacaaaagagagtgctttgctgttgcatgtgctgttgatggtgccagatgggaaagattttattagtggagaatctgagaaacaatcaccatgcaatgtttatttaaattgtaaactcttcagcacagaggaagtcaccagatctgtcatcgcatggggcacaacacaaccggtctttaacttttctcaggtgattcctgtctctctgtcttccaaatacctggaaaggcttaagaacaatgtgatggtaattgaaacttggaataaggtgcggagcccaggacaggacaagctgctcgggctggtgaaacttcccctccaccagttttacatgtcattcaaagatgctaagatttctcgcctgctgctggatgcccagtacccagttgttgctgtcgacagctacatgcctgtgattgatgtgttttcaggccaccaaaatgggagtcttcgagtctttttagctatgggttcttcaaatcaaataatggcactacaaagattaaagaatgaagaaggaacactccctcccttcagccctaggccagcccatttcctggaccagccaactgcagcatctgttgctatggcagaggaccgaggaaatggactgatggagcactgctttgagatccatatagagatggttaaagggctagcccctcttcaggcaacagtctggggagaagcagattgttatgtccagtactactttccagttcaacactctcaatccagtgtgctgaaaggacctgagttccttgaaaatgatcccatctttaatagtgaacaccatcactctctcctgttgccagctgaggttccagtgcaaaggctcctactaagtgctttctctgcacagggcctcgtgcctggaggtggagtccagtttgaaatctggtgcagatactattatcctaatgtgagagaccagaaggtcgccaaaggaaccttgccattatcaaggatctgtgctatggtaaccacccagcatcgtgaggatgtgggaatacagacctttaatctccctttaacccccaggattgagaacaggaaagaattgaggaaccagtcatcaggtttactggatgtgggcctaaggtacaggcgtagtccaagaacagcagagggagttcttgctgcccgaactgtttccatctcagtccagattatcagagcctgtggtctgcaagcagcagccaagcataatatatacttcatggtatactattgtatggatgcacattaatcttctgttaatgataaatcatctattaatgatcattaacgataatgaaaaggaaaaagtttttctttttttcttagaaatgaaattgcagtaagcatccaaatatataatatacatctttagtatttatatactatcttatgttaa

SEQ ID NO: 460177 - DNA, 348 bp, Homo sapiens
agatggcaacaggacaagaatgggagcaggtagaccctcccagtccaggcaaatattaccagtggctaagagtaaggtagtatcagtgaagaagtgatcctattattgatagatcttaaagcagagtagacaagacttgctgattaattaaatgttacgcgtgagagaaatataaaagttaaggatgaaaccaaagtttttaacctaaacaacttggaggatggagggggaaacaaaggaactagttgcaagcaaaaaggcctgagagaatctcattgacgcttccaccatgagaagacatggtgagaaagcaccatccatgaaccagaaagtgtatccccttaccag

SEQ ID NO: 460178 - DNA, 1081 bp, Homo sapiens
agatggcaacaggacaagaatgggagcaggtagaccctcccagtccaggcaaatattaccagtggctaagagtaaggtagtatcagtgaagaagtgatcctattattgatagatcttaaagcagagtagacaagacttgctgattaattaaatgttacgcgtgagagaaatataaaagttaaggatgaaaccaaagtttttaacctaaacaacttggaggatggagggggaaacaaaggaactagttgcaagctgccatttagcaagctgccatgaagatagccatctccatctgattcatttggggctacaattcatgtattaaggttaaatccatatcttttatccaccttgggtgaagaacatgaaagatcctatacaactggtctaacacctgtgtgttctctctcctaaaagttaatacccaattcagcttggtgcaggttttaaaatttaaataaaaaaataaagttaatattcaagttaaaccttggtctatgtctaatcattacaatccttctggaatccacaaatgccaaagcatttgccccaaaaagcagcctggaaccaaggttattgtcgatttccacatccacagcctaacaacgtggtgcaatcgccctttgcgacgccgcagaccaacagacggatgctgccctgctgcagtttcacagcacaccgggtctttccgcttcagctggacagaggcccagccaggccgtagggaggattccgaaggtctctctgcagaggaccggcctctcagaccgagaaggctccacccaggcaggaaaggacactggggtgtgggtgccagatcaacttgctcaccactcagaccgcacacaagaagccttatgttgaaacttgttcaacctccagttcaatgcccaagaaaaatgaagtatccacatgaccgccatgaagcagaattcaaatttccactgctgtcccatctgcctgaagaagaagagaaatggtatcgctaacatgcctcatgttacagtctcctgagttgtccagctccccatttgcacttttctatattactctgtgctactcacaaacctctcagctccgt

SEQ ID NO: 460179 - DNA, 1464 bp, Homo sapiens
cgcaaccatgaactcgtggaacgcgggcctggcgggactactggtgggcacaataggcgtctcgctgctgtccaacgcgctggtgctgctctgcctgctgcacagcgcggacatccgccgccaggcgccggcgctcttcaccctgaacctcacgtgcgggaacctgctgtgcaccgtggtcaacatgccgctcacgctggccggcgtcgtggcgcagcggcagccggcgggcgaccgcctgtgccgcctggctgccttcctcgacaccttcctggctgccaactccatgctcagcatggccgcgctcagcatcgaccgctgggtggccgtggtcttcccgctgagctaccgggccaagatgcgcctccgcgacgcggcgctcatggtggcctacacgtggctgcacgcgctcaccttcccagccgccgcgctcgccctgtcctggctcggcttccaccagctgtacgcctcgtgcacgctgtgcagccggcggccagacgagcgcctgcgcttcgccgtcttcactggcgccttccacgctctcagcttcctgctctccttcgtcgtgctctgctgcacgtacctcaaggtgctcaaggtggcccgcttccattgcaagcgcatcgacgtgatcaccatgcagacgctggtgctgctggtggacctgcaccccagtgtgcgggaacgctgtctggaggagcagaagcggaggcgacagcgagccaccaagaagatcagcaccttcatagggaccttccttgtgtgcttcgcgccctatgtgatcaccaggctagtggagctcttctccacggtgcccatcggctcccactggggggtgctgtccaagtgcttggcgtacagcaaggccgcatccgacccctttgtgtactccttactgcgacaccagtaccgcaaaagctgcaaggagattctgaacaggctcctgcacagacgctccatccactcctctggcctcacaggcgactctcacagccagaacattctgccggtgtctgagtgaaggaccgcgctcctgctgaagagtttagaatgaggcagcggttcaagtgattagagacagtgaaatttttatggaatactgcacctataaaacacatgccaatctgttagcagtcctgacttgatttaataaaaaccaaggagagccacccctgctttctggccatctcttctttgtctaccatttcaaattgacttgtgaatactcagagcagttatttttcaatcctccactctaagtgattcctccagggtgggaagcacggggagcaatggaatcagatggctcattctctccttccagctctttacatcctaactttggaggtatagaaggaaggatgtggtccaacgggaaggaagtgaagagtctattggtttttacttctaggcagtcccaatttttaaaggcagagaagtatctgcatctttatttgaaaagac

SEQ ID NO: 460180 - DNA, 567 bp, Homo sapiens
cggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcattagcacacagatttttaaaaatcaattctcttgccatgcctcctatgtgttcacatctctgcatacactacagatataagtgcataatcattcatataaacatctggtaggtattctgtaaaactgtgtttactttagtgcatgttattgtcatgttatgatgtgactggggtgtttctttgtcatgaaactttgcttcttcacagaattagaatactgctctctctatattgaactacatatacagcgttttcttgtatcagcccccaaagtctggatgcccggtgttgtgtttacatgtgattgtgcctaggagtctgttcacatagagacacctgtaagtatttattacaaaacggaatgtaagcaaatatatccacattggttttatttga

SEQ ID NO: 460181 - DNA, 8955 bp, Homo sapiens
cggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaagggtccccttctgcttgttatagccccagtagtcctgtccaggttctagaagactccacctacttttccccagactttcagctctattctgggaggcatgaaacatctgctttgacggtggaggcaaccagtagcatcagggaaaaagttgttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctggccattcagcaccaggccacagggagtgcaggaccagcccatcctacaaacaacttttcttccacggaaaacctcactcaagaagacccacaaatggtctaccagtcagcacgccaagaaccgcagggtcaagaacaccaggtggacaatacggtgatggagaaacaggtccggtccagcagcctcagcagaacaacgaggaactgcccacttacgaggaggcaaaagcacagtcgcagttcttcagggggcagcagcagcagcaacagcagcagggggcggtgggccatggttactacatggcagggggcaccagtcagaagtcccgaactgaggggaggcccactgtgaaccgtgccaacagtggacaggcgcataaggacgaggcgctgaaggaactgaagcagggccacgtccgctcgctcagcgagagaatcatgcagctgtccctggagaggaatggggccaagcaacaccttcccggctcggggaatggaaagggcttcaaagtaggaggggggccctcccctgcccagcctgcaggtaaagtgctggaccctcggggtcctccacctgagtaccccttcaagaccaagcaaatgatgtccccagtcagcaagacccaggagcacggacttttttatggtgaccagcaccccgggatgctccacgagatggtcaagccctaccctgctcctcagcctgtgagaacagatgtggccgtcctgcggtaccacgccaccccctgagtatggggtaacgagccgcccatgccaacttccgttcccatcaaccatgcagcagcacagccccatgtcctcccagacctcttccgccagcgggccactgcactctgtctccctgccgcttccactcccgatggccctgggtgctccacagcccccgcctgccgcctcccccagccagcagcttggtccagatgcctttgcgattgtggagcgagcccagcaaatggtggagatattaacagaggagaaccgggtgcttcaccaggaacttcagggttactacgacaatgccgacaagctccacaagtttgaaaaagaacttcagagaatttcggaagcctatgaaagtctggtcaagtctaccaccaagcgagaatcgctggacaaggccatgagaaacaaattggaaggcgagattagaagacttcatgatttcaacagagacctccgagatcgactagagactgctaacaggcaactatccagcagggaatacgaagggcatgaagacaaagctgcagaggggcattatgcttcccagaacaaagaattcttgaaggaaaaggagaaattagaaatggagttagcagcagtgcggactgcaagtgaggaccatcggagacacatcgagatcctggaccaggctttgagcaacgcccaggccagggtcatcaagctggaagaggagttacgagagaagcaagcatatgttgagaaagttgagaagctgcagcaggccctgacccagctgcagtctgcatgtgagaagcgagaacagatggagcggagactgcggacttggctggagagagagctggatgcactgagaacccagcagaaacatggaaatggccagccagccaacatgccggaatacaatgccccagccctcctggaacttgtgcgggagaaggaggagcggatcctggccctggaggccgacatgacaaagtgggagcagaagtacctggaggagagcaccatccgacactttgccatgaatgccgcagccactgcagcagctgagagggacaccacgatcatcaaccactcacggaatggcagctacggagagagctcgctggaggcccacatctggcaagaggaggaggaggtggtgcaggccaacagaaggtgtcaggacatggaatacactattaaaaatctccatgccaaaatcatagagaaagatgctatgattaaggtcctgcagcagcgatctcgtaaagatgccgggaagacagactcctccagcctacgtcctgcccgctccgttccatccatagcagcagctactgggacacactctcgccagacctctcttaccagcagccagctggctgaggaaaagaaggaagagaagacctggaaggggagcatagaatgggataatggggagagcacattggaagaagtgctctctcgcataaggattgctgctggggaaggagcaccatgagcatgcctctgccccactgctgccacccccacccacctcagcactgtcctccatagcctccactacggcagccagcagtgcccacgccaagacaggcagcaaggacagcagcacacagactgacaagagtgccgagctcttctggcccagcatggcctcccttcccagccgcggccggctgagcacgacccctgctcacagccccgtcctgaaacacccagcggccaaagggaccgcagagaaactggagaactctcctggccatgggaagtcgcctgaccacagaggccgggtcagcagcttgctgcacaagcccgagttccctgatggagagatgatggaagtcctcatctaactgccatccctgtggaatttcagtacagaacactgacaaacaaggaaagcggcagagaaagaagaaagacctagaaggttgtagatgggaaatcaggaatgatttgaactgataaagatttcagactcataagaacacattttataaatgttaaacacaaaaactacatgactgaagatagaagagaatgcgatggattttattacacatggtggaagagagaagaggcgtgtaggtttgcaaacaaagttaagaaataggaaactgaatttttcattgtacagaaaatgtatctcttggggagggcctgtgtacccccattctctgattataaacagataaacccaaatgtggatcatccttggaatacccccattctccttgcctcttagcatgtttgatttaagaaaagcctccaggaaatcttgagagcctgtcttggcataatgcagtgtcacctgtgccaaccatggggtgtcccgtgagtgtgagtgtggcagtgagaagaagcatcgagggcgaggggaatatgaaagttggtcttcacctaattacctgtttggtttggattttcaagagatgattgggcttcttagcttttctgaattctgcagtattttctaaacaggatagattatgatctcggtccccatccatcctaacttctgagttcatctctgtctctgctttacagtctttaattttttgttgttccttcatttttttctttttaataagacatagcagaattccttaggtatgggatttatgagaccagtacctgaactgtcatcattcctactgtgtttgatagtgaccagtaggacaaagccacgtgccgacttcctggctgcttcacctttgcatagctgggttgcagctgcgaacctcattctgactgtgaactaagcaagctttgaggaggcaggagattccgtgggtccctgtgacatattgcattaagatcgtggcacttgcttttttgtctttcacatcggctgtcttgcaaggagcttgacatttccaaattccattgctctgtttggggaagacttaggacagcactccaggaaacagatgacaatttacagacagttgtctcagtggtttccagaatctcaccagcctcccgtatagcttcttgtattgaggctcatgagcgtattcacactctttcctcccccgcgcacgcctctgcttgctctcgatcagcatccagacctccgtggcaccaggttgcctctgttgtgaacttcttttgtaacctaccaggccagttgtatatacagtgttgtcaggtttttccgggtttcagttttgaggcagtttattcaaagtgagacagaagtgccacggaaaagaggcaggagtgtgttaggtggtgggtccattagacctctgctgtgacattgcatattcagctctgcagacactggcttcctttacaaatctaagagatgctggattagaaaagaggagaagctcatcgggccatcagagagatgctcctacagggtcctgatgtttttgtacctccaggtcagctggatcgctgttttcccagttccctttgctcatgcttacttagaggaagaaagaaaggggggtacctcttccaagtaccttctaaatgaaacactcaagagagtgctactcaggaaactttgcttggatcctaaaatggactggtcttgggtgtgtaaccccggtgaagttatagcctccccaaattgaggtgacagaaggaagacaagaggtgtaagctggagagggaagggaagaaatcagtggctttggccagcctctgtgccacccagtacgacagaggagtgggaactggccctctggggctctgcttggccataggcactgcacattgtgccacctgctcatcacctcctctagtctcacactgagcatcggagtacctgttgtgcagacaggaaaactgaggagctctgagaggctgagcatggagctcaccccatgccatagggtgtgggaagagggcacaggaggcctcatccatgggggaaagggttgaggatggacatgggtggggagagggcatagacatcccttcctaatctctgttcccaccacatttcataggagatgagttaggagatgacagctaactctcttaaggacattttgaccccagtttatgttggggatggaccagaaaggaaaatgtctagagataggaaggtaaatcaactctgccagcccctaccatcaggtctgggccaccccaaacttgggctgcctcccttagacataggttagagtgagagacccagctgtttctcccgaagcctcgtcttcatgccccagacacctgattgccccaatcaggtgtcagacttgcttgctcttcgaggtccccctgagctgccaagtgttttcattgtaaacagacacatcgccatgtttcagggcttcaacggcattgtattttggactttgaccgtattttttttctcttaacctactgagactcttccttaagaacaggatctatagctttaaaatgtcttcttctatgggaaatttcctgccaagccagggcactaaattctttcatcattagagctttcctgaagtccggccatatactgagtacctgctctgagttctgggcagcttacaatatcttaaacagattttcagaaaaataatgcaactatattttctagtgtcaactgtatgcaaacagtgtggtaaataccttttaattagtcctccacccacctggagtacagggggtgcgtttattattctgatttcactgatgaggaaatgggctcagaaaggttaagtcccttcctgaaatctcacagccaggagaagctaggatgatttaaaacaaagtttggagaggcactgggcatagaccctggctgtacagcctctaacatgcggcactgcatcttggcagtctctatgcctgtctgtgatgtgtgtgtgcacgtgtaactacacacacacacacacacacacacacacacagctatcacacatctcagagcctaagaaataggactaagcccagaactcctagaatcacctataaatgctaggcatagatggaaattattgtgttccaccagaagcacagctccaaactatacctaaaaaatatttctgcacttcccagagacctggacttcaaactttcccagtggagcctgattatagaacttgagggtcctatctcaggatgaaggggagaggccctggcttcacgggaaggtattccagcattgttctgcttcacccttgactgcgttgtctggcagtttctgtgtgctgccaggatattatatggaactggagaagttggagtcaggtctctgaagctagagtttcactaattagatgcctctgtacatgagaactattactgtctgcaggtccatatagctaagctgccaggaaaaacacattatcttccaaaactttcagagcatgtgcagaaccctttcttagcgttttcttctcagcattttctctgcctcccagaggctggcagccagtgacactgcagagttcagcatgttctaaccatgcacgcagggcaggggctgccttggccctcctcaggctttcgttgggagagcaggcagtggtggagcccttctgggtgcagtcctctggggttgctctttggaactcatgtatgagtttgactccacaaggcttggcatggataccaaaacagttgcaacaaattagttctgaacctggaacagagaattcagtgcttctgttactcaggaaggaggtgttcagaatgccccgtgcagagcagccagtcattactcttgtttgttctcacctgggtgcgcaccctcatgatgcagtggctgtagcaccttcatgccaggtgctgagagaatgggaaattcttcctccccattgacctgagtcccagagacttagggacacagacttcaggtgaggctgcggacctcagaagcagtggataatagattggggcattaaaagcttttgaggcagggggctcatgttttgactgcagggagttatgctgagcaaagagatgtgtttttcaaaaccagggttcaaaaccagtgtccacgctggagtaagtggagcatgcttctctgtgttctctgaatgatcttgcactcctcttaagcaaaggagtaccatgaccatagtcagtgggatcccacaaatgttcttaaatgggtaaggctttaagtagccagagagtatccagcctaccattggcttctccacatcctaaaacctgagacagccttggtatatgctttataaatgtttcttttcttgttgtttaagtaattaaagtgtttaaaatgtcttcattagatgtgacgattgtttaatgagtttgcctctgacgtgtggctccatgggagataggcaaagtaattaagaagttaccagaaattggtcggctggggaaatgcaaaagttagcatttcagtagtgaatttctcctggaacaaatgagcaatttttcctctttctcttaagtagtatacccttttctcacttagtaatttaatggtatataaagacatgtgtataagtgagtgcatacatatgaggtatgactatagggttgtttgtgggaatttcttttcctaacatacagaagatcaaagtgttcatctcaccccgccctccttaaaaggtgtcttttgggagactatgtgctcattgactatagtgctgccaagtaaaaatatcttgggaactcttctactagaatggccttcagggcttggcatgttcctttggtttacccttagagatgagaaatcctcctcctttgaggatggatttaagttctggaaataatctcaagtgcttgatagcacagttggatgaaaaaagatggcaattaaggtaagttacaccatttttgtttctaaaaaaatccctaagaaatttcttggaatgagtctttggcctcagagcctctcaaagtgtccacttcaaggggggatcatcctcattagcacacagatttttaaaaatcaattctcttgccatgcctcctatgtgttcacatctctgcatacactacagatataagtgcataatcattcatataaacatctggtaggtattctgtaaaactgtgtttactttagtgcatgttattgtcatgttatgatgtgactggggtgtttctttgtcatgaaactttgcttcttcacagaattagaatactgctctctctatattgaactacatatacagcgttttcttgtatcagcccccaaagtctggatgcccggtgttgtgtttacatgtgattgtgcctaggagtctgttcacatagagacacctgtaagtatttattacaaaacggaatgtaagcaaatatatccacattggttttatttgaatcaaggtgtttttttgttttttgttttttttccttttgaggaggaacagggagcctcctcctccatgagcacttacagaattgtgtaaaattctgtgaaacagtggtaagcatgggcacccgatttcagctgtcctgctgccgctgccctccaacctgctctgtgtgtgtgtgtcgctgtgcttggtggcagtgtgccgtgctcgtgccggctcttcccagcagactggtatctggctgtaacgtttgacgtcttcatattgccagtctgtattgaggggtgatgtacatggccatacagccaaatgggtctgtgtaccagtgtggggattccaagaacactgcctgtcccccacagcaaatattgatgctgttggtcagccaaagattttcctctcctttgctgcttaaacttgtgccttaatattgtacataataaatggataaaatggcaa

SEQ ID NO: 460182 - DNA, 7754 bp, Homo sapiens
actccacacgagtgttcctgccaccatgcactgcattctgtgcacaccacaggagaggcagctcctcccctggcctctgtacactccaagccgcccatgccaacttccgttcccatcaaccatgcagcagcacagccccatgtcctcccagacctcttccgccagcgggccactgcactctgtctccctgccgcttccactcccgatggccctgggtgctccacagcccccgcctgccgcctcccccagccagcagcttggtccagatgcctttgcgattgtggagcgagcccagcaaatggtggagatattaacagaggagaaccgggtgcttcaccaggaacttcagggttactacgacaatgccgacaagctccacaagtttgaaaaagaacttcagagaatttcggaagcctatgaaagtctggtcaagtctaccaccaagcgagaatcgctggacaaggccatgagaaacaaattggaaggcgagattagaagacttcatgatttcaacagagacctccgagatcgactagagactgctaacaggcaactatccagcagggaatacgaagggcatgaagacaaagctgcagaggggcattatgcttcccagaacaaagaattcttgaaggaaaaggagaaattagaaatggagttagcagcagtgcggactgcaagtgaggaccatcggagacacatcgagatcctggaccaggctttgagcaacgcccaggccagggtcatcaagctggaagaggagttacgagagaagcaagcatatgttgagaaagttgagaagctgcagcaggccctgacccagctgcagtctgcatgtgagaagcgagaacagatggagcggagactgcggacttggctggagagagagctggatgcactgagaacccagcagaaacatggaaatggccagccagccaacatgccggaatacaatgccccagccctcctggaacttgtgcgggagaaggaggagcggatcctggccctggaggccgacatgacaaagtgggagcagaagtacctggaggagagcaccatccgacactttgccatgaatgccgcagccactgcagcagctgagagggacaccacgatcatcaaccactcacggaatggcagctacggagagagctcgctggaggcccacatctggcaagaggaggaggaggtggtgcaggccaacagaaggtgtcaggacatggaatacactattaaaaatctccatgccaaaatcatagagaaagatgctatgattaaggtcctgcagcagcgatctcgtaaagatgccgggaagacagactcctccagcctacgtcctgcccgctccgttccatccatagcagcagctactgggacacactctcgccagacctctcttaccagcagccagctggctgaggaaaagaaggaagagaagacctggaaggggagcatagaatgggataatggggagagcacattggaagaagtgctctctcgcataaggattgctgctggggaaggagcaccatgagcatgcctctgccccactgctgccacccccacccacctcagcactgtcctccatagcctccactacggcagccagcagtgcccacgccaagacaggcagcaaggacagcagcacacagactgacaagagtgccgagctcttctggcccagcatggcctcccttcccagccgcggccggctgagcacgacccctgctcacagccccgtcctgaaacacccagcggccaaagggaccgcagagaaactggagaactctcctggccatgggaagtcgcctgaccacagaggccgggtcagcagcttgctgcacaagcccgagttccctgatggagagatgatggaagtcctcatctaactgccatccctgtggaatttcagtacagaacactgacaaacaaggaaagcggcagagaaagaagaaagacctagaaggttgtagatgggaaatcaggaatgatttgaactgataaagatttcagactcataagaacacattttataaatgttaaacacaaaaactacatgactgaagatagaagagaatgcgatggattttattacacatggtggaagagagaagaggcgtgtaggtttgcaaacaaagttaagaaataggaaactgaatttttcattgtacagaaaatgtatctcttggggagggcctgtgtacccccattctctgattataaacagataaacccaaatgtggatcatccttggaatacccccattctccttgcctcttagcatgtttgatttaagaaaagcctccaggaaatcttgagagcctgtcttggcataatgcagtgtcacctgtgccaaccatggggtgtcccgtgagtgtgagtgtggcagtgagaagaagcatcgagggcgaggggaatatgaaagttggtcttcacctaattacctgtttggtttggattttcaagagatgattgggcttcttagcttttctgaattctgcagtattttctaaacaggatagattatgatctcggtccccatccatcctaacttctgagttcatctctgtctctgctttacagtctttaattttttgttgttccttcatttttttctttttaataagacatagcagaattccttaggtatgggatttatgagaccagtacctgaactgtcatcattcctactgtgtttgatagtgaccagtaggacaaagccacgtgccgacttcctggctgcttcacctttgcatagctgggttgcagctgcgaacctcattctgactgtgaactaagcaagctttgaggaggcaggagattccgtgggtccctgtgacatattgcattaagatcgtggcacttgcttttttgtctttcacatcggctgtcttgcaaggagcttgacatttccaaattccattgctctgtttggggaagacttaggacagcactccaggaaacagatgacaatttacagacagttgtctcagtggtttccagaatctcaccagcctcccgtatagcttcttgtattgaggctcatgagcgtattcacactctttcctcccccgcgcacgcctctgcttgctctcgatcagcatccagacctccgtggcaccaggttgcctctgttgtgaacttcttttgtaacctaccaggccagttgtatatacagtgttgtcaggtttttccgggtttcagttttgaggcagtttattcaaagtgagacagaagtgccacggaaaagaggcaggagtgtgttaggtggtgggtccattagacctctgctgtgacattgcatattcagctctgcagacactggcttcctttacaaatctaagagatgctggattagaaaagaggagaagctcatcgggccatcagagagatgctcctacagggtcctgatgtttttgtacctccaggtcagctggatcgctgttttcccagttccctttgctcatgcttacttagaggaagaaagaaaggggggtacctcttccaagtaccttctaaatgaaacactcaagagagtgctactcaggaaactttgcttggatcctaaaatggactggtcttgggtgtgtaaccccggtgaagttatagcctccccaaattgaggtgacagaaggaagacaagaggtgtaagctggagagggaagggaagaaatcagtggctttggccagcctctgtgccacccagtacgacagaggagtgggaactggccctctggggctctgcttggccataggcactgcacattgtgccacctgctcatcacctcctctagtctcacactgagcatcggagtacctgttgtgcagacaggaaaactgaggagctctgagaggctgagcatggagctcaccccatgccatagggtgtgggaagagggcacaggaggcctcatccatgggggaaagggttgaggatggacatgggtggggagagggcatagacatcccttcctaatctctgttcccaccacatttcataggagatgagttaggagatgacagctaactctcttaaggacattttgaccccagtttatgttggggatggaccagaaaggaaaatgtctagagataggaaggtaaatcaactctgccagcccctaccatcaggtctgggccaccccaaacttgggctgcctcccttagacataggttagagtgagagacccagctgtttctcccgaagcctcgtcttcatgccccagacacctgattgccccaatcaggtgtcagacttgcttgctcttcgaggtccccctgagctgccaagtgttttcattgtaaacagacacatcgccatgtttcagggcttcaacggcattgtattttggactttgaccgtattttttttctcttaacctactgagactcttccttaagaacaggatctatagctttaaaatgtcttcttctatgggaaatttcctgccaagccagggcactaaattctttcatcattagagctttcctgaagtccggccatatactgagtacctgctctgagttctgggcagcttacaatatcttaaacagattttcagaaaaataatgcaactatattttctagtgtcaactgtatgcaaacagtgtggtaaataccttttaattagtcctccacccacctggagtacagggggtgcgtttattattctgatttcactgatgaggaaatgggctcagaaaggttaagtcccttcctgaaatctcacagccaggagaagctaggatgatttaaaacaaagtttggagaggcactgggcatagaccctggctgtacagcctctaacatgcggcactgcatcttggcagtctctatgcctgtctgtgatgtgtgtgtgcacgtgtaactacacacacacacacacacacacacacacacagctatcacacatctcagagcctaagaaataggactaagcccagaactcctagaatcacctataaatgctaggcatagatggaaattattgtgttccaccagaagcacagctccaaactatacctaaaaaatatttctgcacttcccagagacctggacttcaaactttcccagtggagcctgattatagaacttgagggtcctatctcaggatgaaggggagaggccctggcttcacgggaaggtattccagcattgttctgcttcacccttgactgcgttgtctggcagtttctgtgtgctgccaggatattatatggaactggagaagttggagtcaggtctctgaagctagagtttcactaattagatgcctctgtacatgagaactattactgtctgcaggtccatatagctaagctgccaggaaaaacacattatcttccaaaactttcagagcatgtgcagaaccctttcttagcgttttcttctcagcattttctctgcctcccagaggctggcagccagtgacactgcagagttcagcatgttctaaccatgcacgcagggcaggggctgccttggccctcctcaggctttcgttgggagagcaggcagtggtggagcccttctgggtgcagtcctctggggttgctctttggaactcatgtatgagtttgactccacaaggcttggcatggataccaaaacagttgcaacaaattagttctgaacctggaacagagaattcagtgcttctgttactcaggaaggaggtgttcagaatgccccgtgcagagcagccagtcattactcttgtttgttctcacctgggtgcgcaccctcatgatgcagtggctgtagcaccttcatgccaggtgctgagagaatgggaaattcttcctccccattgacctgagtcccagagacttagggacacagacttcaggtgaggctgcggacctcagaagcagtggataatagattggggcattaaaagcttttgaggcagggggctcatgttttgactgcagggagttatgctgagcaaagagatgtgtttttcaaaaccagggttcaaaaccagtgtccacgctggagtaagtggagcatgcttctctgtgttctctgaatgatcttgcactcctcttaagcaaaggagtaccatgaccatagtcagtgggatcccacaaatgttcttaaatgggtaaggctttaagtagccagagagtatccagcctaccattggcttctccacatcctaaaacctgagacagccttggtatatgctttataaatgtttcttttcttgttgtttaagtaattaaagtgtttaaaatgtcttcattagatgtgacgattgtttaatgagtttgcctctgacgtgtggctccatgggagataggcaaagtaattaagaagttaccagaaattggtcggctggggaaatgcaaaagttagcatttcagtagtgaatttctcctggaacaaatgagcaatttttcctctttctcttaagtagtatacccttttctcacttagtaatttaatggtatataaagacatgtgtataagtgagtgcatacatatgaggtatgactatagggttgtttgtgggaatttcttttcctaacatacagaagatcaaagtgttcatctcaccccgccctccttaaaaggtgtcttttgggagactatgtgctcattgactatagtgctgccaagtaaaaatatcttgggaactcttctactagaatggccttcagggcttggcatgttcctttggtttacccttagagatgagaaatcctcctcctttgaggatggatttaagttctggaaataatctcaagtgcttgatagcacagttggatgaaaaaagatggcaattaaggtaagttacaccatttttgtttctaaaaaaatccctaagaaatttcttggaatgagtctttggcctcagagcctctcaaagtgtccacttcaaggggggatcatcctcattagcacacagatttttaaaaatcaattctcttgccatgcctcctatgtgttcacatctctgcatacactacagatataagtgcataatcattcatataaacatctggtaggtattctgtaaaactgtgtttactttagtgcatgttattgtcatgttatgatgtgactggggtgtttctttgtcatgaaactttgcttcttcacagaattagaatactgctctctctatattgaactacatatacagcgttttcttgtatcagcccccaaagtctggatgcccggtgttgtgtttacatgtgattgtgcctaggagtctgttcacatagagacacctgtaagtatttattacaaaacggaatgtaagcaaatatatccacattggttttatttgaatcaaggtgtttttttgttttttgttttttttccttttgaggaggaacagggagcctcctcctccatgagcacttacagaattgtgtaaaattctgtgaaacagtggtaagcatgggcacccgatttcagctgtcctgctgccgctgccctccaacctgctctgtgtgtgtgtgtcgctgtgcttggtggcagtgtgccgtgctcgtgccggctcttcccagcagactggtatctggctgtaacgtttgacgtcttcatattgccagtctgtattgaggggtgatgtacatggccatacagccaaatgggtctgtgtaccagtgtggggattccaagaacactgcctgtcccccacagcaaatattgatgctgttggtcagccaaagattttcctctcctttgctgcttaaacttgtgccttaatattgtacataataaatggataaaatggcaa

SEQ ID NO: 460183 - DNA, 9052 bp, Homo sapiens
cggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaagggtccccttctgcttgttatagccccagtagtcctgtccaggttctagaagactccacctacttttccccagactttcagctctattctgggaggcatgaaacatctgctttgacggtggaggcaaccagtagcatcagggaaaaagttgttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctggccattcagcaccaggccacagggagtgcaggaccagcccatcctacaaacaacttttcttccacggaaaacctcactcaagaagacccacaaatggtctaccagtcagcacgccaagaaccgcagggtcaagaacaccaggtggacaatacggtgatggagaaacaggtccggtccagcagcctcagcagaacaacgaggaactgcccacttacgaggaggcaaaagcacagtcgcagttcttcagggggcagcagcagcagcaacagcagcagggggcggtgggccatggttactacatggcagggggcaccagtcagaagtcccgaactgaggggaggcccactgtgaaccgtgccaacagtggacaggcgcataaggacgaggcgctgaaggaactgaagcagggccacgtccgctcgctcagcgagagaatcatgcagctgtccctggagaggaatggggccaagcaacaccttcccggctcggggaatggaaagggcttcaaagtaggaggggggccctcccctgcccagcctgcaggtaaagtgctggaccctcggggtcctccacctgagtaccccttcaagaccaagcaaatgatgtccccagtcagcaagacccaggagcacggacttttttatggtgaccagcaccccgggatgctccacgagatggtcaagccctaccctgctcctcagcctgtgagaacagatgtggccgtcctgcggtaccacgccaccccctgagtatggggtaacgagccgcccatgccaacttccgttcccatcaaccatgcagcagcacagccccatgtcctcccagacctcttccgccagcgggccactgcactctgtctccctgccgcttccactcccgatggccctgggtgctccacagcccccgcctgccgcctcccccagccagcagcttggtccagatgcctttgcgattgtggagcgagcccagcaaatggtggagatattaacagaggagaaccgggtgcttcaccaggaacttcagggttactacgacaatgccgacaagctccacaagtttgaaaaagaacttcagagaatttcggaagcctatgaaagtctggtcaagtctaccaccaagcgagaatcgctggacaaggccatgagaaacaaattggaaggcgagattagaagacttcatgatttcaacagagacctccgagatcgactagagactgctaacaggcaactatccagcagggaatacgaagggcatgaagacaaagctgcagaggggcattatgcttcccagaacaaagaattcttgaaggaaaaggagaaattagaaatggagttagcagcagtgcggactgcaagtgaggaccatcggagacacatcgagatcctggaccaggctttgagcaacgcccaggccagggtcatcaagctggaagaggagttacgagagaagcaagcatatgttgagaaagttgagaagctgcagcaggccctgacccagctgcagtctgcatgtgagaagcgagaacagatggagcggagactgcggacttggctggagagagagctggatgcactgagaacccagcagaaacatggaaatggccagccagccaacatgccggaatacaatgccccagccctcctggaacttgtgcgggagaaggaggagcggatcctggccctggaggccgacatgacaaagtgggagcagaagtacctggaggagagcaccatccgacactttgccatgaatgccgcagccactgcagcagctgagagggacaccacgatcatcaaccactcacggaatggcagctacggagagagctcgctggaggcccacatctggcaagaggaggaggaggtggtgcaggccaacagaaggtgtcaggacatggaatacactattaaaaatctccatgccaaaatcatagagaaagatgctatgattaaggtcctgcagcagcgatctcgtaaagatgccgggaagacagactcctccagcctacgtcctgcccgctccgttccatccatagcagcagctactgggacacactctcgccagacctctcttaccagcagccagctggctgaggaaaagaaggaagagaagacctggaaggggagcatagaatgggataatggggagagcacattggaagaagtgctctctcgcataaggattgctgctggggaaggagcaccatgagcatgcctctgccccactgctgccacccccacccacctcagcactgtcctccatagcctccactacggcagccagcagtgcccacgccaagacaggcagcaaggacagcagcacacagactgacaagagtgccgagctcttctggcccagcatggcctcccttcccagccgcggccggctgagcacgacccctgctcacagccccgtcctgaaacacccagcggccaaagggaccgcagagaaactggagaactctcctggccatgggaagtcgcctgaccacagaggccgggtcagcagcttgctgcacaagcccgagttccctgatggagagatgatggaagtcctcatctaactgccatccctgtggaatttcagtacagaacactgacaaacaaggaaagcggcagagaaagaagaaagacctagaaggttgtagatgggaaatcaggaatgatttgaactgataaagatttcagactcataagaacacattttataaatgttaaacacaaaaactacatgactgaagatagaagagaatgcgatggattttattacacatggtggaagagagaagaggcgtgtaggtttgcaaacaaagttaagaaataggaaactgaatttttcattgtacagaaaatgtatctcttggggagggcctgtgtacccccattctctgattataaacagataaacccaaatgtggatcatccttggaatacccccattctccttgcctcttagcatgtttgatttaagaaaagcctccaggaaatcttgagagcctgtcttggcataatgcagtgtcacctgtgccaaccatggggtgtcccgtgagtgtgagtgtggcagtgagaagaagcatcgagggcgaggggaatatgaaagttggtcttcacctaattacctgtttggtttggattttcaagagatgattgggcttcttagcttttctgaattctgcagtattttctaaacaggatagattatgatctcggtccccatccatcctaacttctgagttcatctctgtctctgctttacagtctttaattttttgttgttccttcatttttttctttttaataagacatagcagaattccttaggtatgggatttatgagaccagtacctgaactgtcatcattcctactgtgtttgatagtgaccagtaggacaaagccacgtgccgacttcctggctgcttcacctttgcatagctgggttgcagctgcgaacctcattctgactgtgaactaagcaagctttgaggaggcaggagattccgtgggtccctgtgacatattgcattaagatcgtggcacttgcttttttgtctttcacatcggctgtcttgcaaggagcttgacatttccaaattccattgctctgtttggggaagacttaggacagcactccaggaaacagatgacaatttacagacagttgtctcagtggtttccagaatctcaccagcctcccgtatagcttcttgtattgaggctcatgagcgtattcacactctttcctcccccgcgcacgcctctgcttgctctcgatcagcatccagacctccgtggcaccaggttgcctctgttgtgaacttcttttgtaacctaccaggccagttgtatatacagtgttgtcaggtttttccgggtttcagttttgaggcagtttattcaaagtgagacagaagtgccacggaaaagaggcaggagtgtgttaggtggtgggtccattagacctctgctgtgacattgcatattcagctctgcagacactggcttcctttacaaatctaagagatgctggattagaaaagaggagaagctcatcgggccatcagagagatgctcctacagggtcctgatgtttttgtacctccaggtcagctggatcgctgttttcccagttccctttgctcatgcttacttagaggaagaaagaaaggggggtacctcttccaagtaccttctaaatgaaacactcaagagagtgctactcaggaaactttgcttggatcctaaaatggactggtcttgggtgtgtaaccccggtgaagttatagcctccccaaattgaggtgacagaaggaagacaagaggtgtaagctggagagggaagggaagaaatcagtggctttggccagcctctgtgccacccagtacgacagaggagtgggaactggccctctggggctctgcttggccataggcactgcacattgtgccacctgctcatcacctcctctagtctcacactgagcatcggagtacctgttgtgcagacaggaaaactgaggagctctgagaggctgagcatggagctcaccccatgccatagggtgtgggaagagggcacaggaggcctcatccatgggggaaagggttgaggatggacatgggtggggagagggcatagacatcccttcctaatctctgttcccaccacatttcataggagatgagttaggagatgacagctaactctcttaaggacattttgaccccagtttatgttggggatggaccagaaaggaaaatgtctagagataggaaggtaaatcaactctgccagcccctaccatcaggtctgggccaccccaaacttgggctgcctcccttagacataggttagagtgagagacccagctgtttctcccgaagcctcgtcttcatgccccagacacctgattgccccaatcaggtgtcagacttgcttgctcttcgaggtccccctgagctgccaagtgttttcattgtaaacagacacatcgccatgtttcagggcttcaacggcattgtattttggactttgaccgtattttttttctcttaacctactgagactcttccttaagaacaggatctatagctttaaaatgtcttcttctatgggaaatttcctgccaagccagggcactaaattctttcatcattagagctttcctgaagtccggccatatactgagtacctgctctgagttctgggcagcttacaatatcttaaacagattttcagaaaaataatgcaactatattttctagtgtcaactgtatgcaaacagtgtggtaaataccttttaattagtcctccacccacctggagtacagggggtgcgtttattattctgatttcactgatgaggaaatgggctcagaaaggttaagtcccttcctgaaatctcacagccaggagaagctaggatgatttaaaacaaagtttggagaggcactgggcatagaccctggctgtacagcctctaacatgcggcactgcatcttggcagtctctatgcctgtctgtgatgtgtgtgtgcacgtgtaactacacacacacacacacacacacacacacacagctatcacacatctcagagcctaagaaataggactaagcccagaactcctagaatcacctataaatgctaggcatagatggaaattattgtgttccaccagaagcacagctccaaactatacctaaaaaatatttctgcacttcccagagacctggacttcaaactttcccagtggagcctgattatagaacttgagggtcctatctcaggatgaaggggagaggccctggcttcacgggaaggtattccagcattgttctgcttcacccttgactgcgttgtctggcagtttctgtgtgctgccaggatattatatggaactggagaagttggagtcaggtctctgaagctagagtttcactaattagatgcctctgtacatgagaactattactgtctgcaggtccatatagctaagctgccaggaaaaacacattatcttccaaaactttcagagcatgtgcagaaccctttcttagcgttttcttctcagcattttctctgcctcccagaggctggcagccagtgacactgcagagttcagcatgttctaaccatgcacgcagggcaggggctgccttggccctcctcaggctttcgttgggagagcaggcagtggtggagcccttctgggtgcagtcctctggggttgctctttggaactcatgtatgagtttgactccacaaggcttggcatggataccaaaacagttgcaacaaattagttctgaacctggaacagagaattcagtgcttctgttactcaggaaggaggtgttcagaatgccccgtgcagagcagccagtcattactcttgtttgttctcacctgggtgcgcaccctcatgatgcagtggctgtagcaccttcatgccaggtgctgagagaatgggaaattcttcctccccattgacctgagtcccagagacttagggacacagacttcaggtgaggctgcggacctcagaagcagtggataatagattggggcattaaaagcttttgaggcagggggctcatgttttgactgcagggagttatgctgagcaaagagatgtgtttttcaaaaccagggttcaaaaccagtgtccacgctggagtaagtggagcatgcttctctgtgttctctgaatgatcttgcactcctcttaagcaaaggagtaccatgaccatagtcagtgggatcccacaaatgttcttaaatgggtaaggctttaagtagccagagagtatccagcctaccattggcttctccacatcctaaaacctgagacagccttggtatatgctttataaatgtttcttttcttgttgtttaagtaattaaagtgtttaaaatgtcttcattagatgtgacgattgtttaatgagtttgcctctgacgtgtggctccatgggagataggcaaagtaattaagaagttaccagaaattggtcggctggggaaatgcaaaagttagcatttcagtagtgaatttctcctggaacaaatgagcaatttttcctctttctcttaagtagtatacccttttctcacttagtaatttaatggtatataaagacatgtgtataagtgagtgcatacatatgaggtatgactatagggttgtttgtgggaatttcttttcctaacatacagaagatcaaagtgttcatctcaccccgccctccttaaaaggtgtcttttgggagactatgtgctcattgactatagtgctgccaagtaaaaatatcttgggaactcttctactagaatggccttcagggcttggcatgttcctttggtttacccttagagatgagaaatcctcctcctttgaggatggatttaagttctggaaataatctcaagtgcttgatagcacagttggatgaaaaaagatggcaattaaggtaagttacaccatttttgtttctaaaaaaatccctaagaaatttcttggaatgagtctttggcctcagagcctctcaaagtgtccacttcaaggggggatcatcctcattagcacacagatttttaaaaatcaattctcttgccatgcctcctatgtgttcacatctctgcatacactacagatataagtgcataatcattcatataaacatctggtaggtattctgtaaaactgtgtttactttagtgcatgttattgtcatgttatgatgtgactggggtgtttctttgtcatgaaactttgcttcttcacagaattagaatactgctctctctatattgaactacatatacagcgttttcttgtatcagcccccaaagtctggatgcccggtgttgtgtttacatgtgattgtgcctaggagtctgttcacatagagacacctgtaagtatttattacaaaacggaatgtaagcaaatatatccacattggttttatttgaatcaaggtgtttttttgttttttgttttttttccttttgaggaggaacagggagcctcctcctccatgagcacttacagaattgtgtaaaattctgtgaaacagtggtaagcatgggcacccgatttcagctgtcctgctgccgctgccctccaacctgctctgtgtgtgtgtgtcgctgtgcttggtggcagtgtgccgtgctcgtgccggctcttcccagcagactggtatctggctgtaacgtttgacgtcttcatattgccagtctgtattgaggggtgatgtacatggccatacagccaaatgggtctgtgtaccagtgtggggattccaagaacactgcctgtcccccacagcaaatattgatgctgttggtcagccaaagattttcctctcctttgctgcttaaacttgtgccttaatattgtacataataaatggataaaatggcaaaatgactcttttctctcgcttgctcctttcttccttaaagaacttataaactgatgctcaataaatgtttcatttcattgtaccccacttaatgttt

SEQ ID NO: 460184 - DNA, 7444 bp, Homo sapiens
cggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaagggtccccttctgcttgttatagccccagtagtcctgtccaggttctagaagactccacctacttttccccagactttcagctctattctgggaggcatgaaacatctgctttgacggtggaggcaaccagtagcatcagggaaaaagttgttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctggccattcagcaccaggccacagggagtgcaggaccagcccatcctacaaacaacttttcttccacggaaaacctcactcaagaagacccacaaatggtctaccagtcagcacgccaagaaccgcagggtcaagaacaccaggtggacaatacggtgatggagaaacaggtccggtccagcagcctcagcagaacaacgaggaactgcccacttacgaggaggcaaaagcacagtcgcagttcttcagggggcagcagcagcagcaacagcagcagggggcggtgggccatggttactacatggcagggggcaccagtcagaagtcccgaactgaggggaggcccactgtgaaccgtgccaacagtggacaggcgcataaggacgaggcgctgaaggaactgaagcagggccacgtccgctcgctcagcgagagaatcatgcagctgtccctggagaggaatggggccaagcaacaccttcccggctcggggaatggaaagggcttcaaagtaggaggggggccctcccctgcccagcctgcaggtaaagtgctggaccctcggggtcctccacctgagtaccccttcaagaccaagcaaatgatgtccccagtcagcaagacccaggagcacggacttttttatggtgaccagcaccccgggatgctccacgagatggtcaagccctaccctgctcctcagcctgtgagaacagatgtggccgtcctgcggtaccacgccaccccctgagtatggggtaacgagccgcccatgccaacttccgttcccatcaaccatgcagcagcacagccccatgtcctcccagacctcttccgccagcgggccactgcactctgtctccctgccgcttccactcccgatggccctgggtgctccacagcccccgcctgccgcctcccccagccagcagcttggtccagatgcctttgcgattgtggagcgagcccagcaaatggtggagatattaacagaggagaaccgggtgcttcaccaggaacttcagggttactacgacaatgccgacaagctccacaagtttgaaaaagaacttcagagaatttcggaagcctatgaaagtctggtcaagtctaccaccaagcgagaatcgctggacaaggccatgagaaacaaattggaaggcgagattagaagacttcatgatttcaacagagacctccgagatcgactagagactgctaacaggcaactatccagcagggaatacgaagggcatgaagacaaagctgcagaggggcattatgcttcccagaacaaagaattcttgaaggaaaaggagaaattagaaatggagttagcagcagtgcggactgcaagtgaggaccatcggagacacatcgagatcctggaccaggctttgagcaacgcccaggccagggtcatcaagctggaagaggagttacgagagaagcaagcatatgttgagaaagttgagaagctgcagcaggccctgacccagctgcagtctgcatgtgagaagcgagaacagatggagcggagactgcggacttggctggagagagagctggatgcactgagaacccagcagaaacatggaaatggccagccagccaacatgccggaatacaatgccccagccctcctggaacttgtgcgggagaaggaggagcggatcctggccctggaggccgacatgacaaagtgggagcagaagtacctggaggagagcaccatccgacactttgccatgaatgccgcagccactgcagcagctgagagggacaccacgatcatcaaccactcacggaatggcagctacggagagagctcgctggaggcccacatctggcaagaggaggaggaggtggtgcaggccaacagaaggtgtcaggacatggaatacactattaaaaatctccatgccaaaatcatagagaaagatgctatgattaaggtcctgcagcagcgatctcgtaaagatgccgggaagacagactcctccagcctacgtcctgcccgctccgttccatccatagcagcagctactgggacacactctcgccagacctctcttaccagcagccagctggctgaggaaaagaaggaagagaagacctggaaggggagcatagaatgggataatggggagagcacattggaagaagtgctctctcgcataaggattgctgctggggaaggagcaccatgagcatgcctctgccccactgctgccacccccacccacctcagcactgtcctccatagcctccactacggcagccagcagtgcccacgccaagacaggcagcaaggacagcagcacacagactgacaagagtgccgagctcttctggcccagcatggcctcccttcccagccgcggccggctgagcacgacccctgctcacagccccgtcctgaaacacccagcggccaaagggaccgcagagaaactggagaactctcctggccatgggaagtcgcctgaccacagaggccgggtcagcagcttgctgcacaagcccgagttccctgatggagagatgatggaagtcctcatctaactgccatccctgtggaatttcagtacagaacactgacaaacaaggaaagcggcagagaaagaagaaagacctagaaggttgtagatgggaaatcaggaatgatttgaactgataaagatttcagactcataagaacacattttataaatgttaaacacaaaaactacatgactgaagatagaagagaatgcgatggattttattacacatggtggaagagagaagaggcgtgtaggtttgcaaacaaagttaagaaataggaaactgaatttttcattgtacagaaaatgtatctcttggggagggcctgtgtacccccattctctgattataaacagataaacccaaatgtggatcatccttggaatacccccattctccttgcctcttagcatgtttgatttaagaaaagcctccaggaaatcttgagagcctgtcttggcataatgcagtgtcacctgtgccaaccatggggtgtcccgtgagtgtgagtgtggcagtgagaagaagcatcgagggcgaggggaatatgaaagttggtcttcacctaattacctgtttggtttggattttcaagagatgattgggcttcttagcttttctgaattctgcagtattttctaaacaggatagattatgatctcggtccccatccatcctaacttctgagttcatctctgtctctgctttacagtctttaattttttgttgttccttcatttttttctttttaataagacatagcagaattccttaggtatgggatttatgagaccagtacctgaactgtcatcattcctactgtgtttgatagtgaccagtaggacaaagccacgtgccgacttcctggctgcttcacctttgcatagctgggttgcagctgcgaacctcattctgactgtgaactaagcaagctttgaggaggcaggagattccgtgggtccctgtgacatattgcattaagatcgtggcacttgcttttttgtctttcacatcggctgtcttgcaaggagcttgacatttccaaattccattgctctgtttggggaagacttaggacagcactccaggaaacagatgacaatttacagacagttgtctcagtggtttccagaatctcaccagcctcccgtatagcttcttgtattgaggctcatgagcgtattcacactctttcctcccccgcgcacgcctctgcttgctctcgatcagcatccagacctccgtggcaccaggttgcctctgttgtgaacttcttttgtaacctaccaggccagttgtatatacagtgttgtcaggtttttccgggtttcagttttgaggcagtttattcaaagtgagacagaagtgccacggaaaagaggcaggagtgtgttaggtggtgggtccattagacctctgctgtgacattgcatattcagctctgcagacactggcttcctttacaaatctaagagatgctggattagaaaagaggagaagctcatcgggccatcagagagatgctcctacagggtcctgatgtttttgtacctccaggtcagctggatcgctgttttcccagttccctttgctcatgcttacttagaggaagaaagaaaggggggtacctcttccaagtaccttctaaatgaaacactcaagagagtgctactcaggaaactttgcttggatcctaaaatggactggtcttgggtgtgtaaccccggtgaagttatagcctccccaaattgaggtgacagaaggaagacaagaggtgtaagctggagagggaagggaagaaatcagtggctttggccagcctctgtgccacccagtacgacagaggagtgggaactggccctctggggctctgcttggccataggcactgcacattgtgccacctgctcatcacctcctctagtctcacactgagcatcggagtacctgttgtgcagacaggaaaactgaggagctctgagaggctgagcatggagctcaccccatgccatagggtgtgggaagagggcacaggaggcctcatccatgggggaaagggttgaggatggacatgggtggggagagggcatagacatcccttcctaatctctgttcccaccacatttcataggagatgagttaggagatgacagctaactctcttaaggacattttgaccccagtttatgttggggatggaccagaaaggaaaatgtctagagataggaaggtaaatcaactctgccagcccctaccatcaggtctgggccaccccaaacttgggctgcctcccttagacataggttagagtgagagacccagctgtttctcccgaagcctcgtcttcatgccccagacacctgattgccccaatcaggtgtcagacttgcttgctcttcgaggtccccctgagctgccaagtgttttcattgtaaacagacacatcgccatgtttcagggcttcaacggcattgtattttggactttgaccgtattttttttctcttaacctactgagactcttccttaagaacaggatctatagctttaaaatgtcttcttctatgggaaatttcctgccaagccagggcactaaattctttcatcattagagctttcctgaagtccggccatatactgagtacctgctctgagttctgggcagcttacaatatcttaaacagattttcagaaaaataatgcaactatattttctagtgtcaactgtatgcaaacagtgtggtaaataccttttaattagtcctccacccacctggagtacagggggtgcgtttattattctgatttcactgatgaggaaatgggctcagaaaggttaagtcccttcctgaaatctcacagccaggagaagctaggatgatttaaaacaaagtttggagaggcactgggcatagaccctggctgtacagcctctaacatgcggcactgcatcttggcagtctctatgcctgtctgtgatgtgtgtgtgcacgtgtaactacacacacacacacacacacacacacacacagctatcacacatctcagagcctaagaaataggactaagcccagaactcctagaatcacctataaatgctaggcatagatggaaattattgtgttccaccagaagcacagctccaaactatacctaaaaaatatttctgcacttcccagagacctggacttcaaactttcccagtggagcctgattatagaacttgagggtcctatctcaggatgaaggggagaggccctggcttcacgggaaggtattccagcattgttctgcttcacccttgactgcgttgtctggcagtttctgtgtgctgccaggatattatatggaactggagaagttggagtcaggtctctgaagctagagtttcactaattagatgcctctgtacatgagaactattactgtctgcaggtccatatagctaagctgccaggaaaaacacattatcttccaaaactttcagagcatgtgcagaaccctttcttagcgttttcttctcagcattttctctgcctcccagaggctggcagccagtgacactgcagagttcagcatgttctaaccatgcacgcagggcaggggctgccttggccctcctcaggctttcgttgggagagcaggcagtggtggagcccttctgggtgcagtcctctggggttgctctttggaactcatgtatgagtttgactccacaaggcttggcatggataccaaaacagttgcaacaaattagttctgaacctggaacagagaattcagtgcttctgttactcaggaaggaggtgttcagaatgccccgtgcagagcagccagtcattactcttgtttgttctcacctgggtgcgcaccctcatgatgcagtggctgtagcaccttcatgccaggtgctgagagaatgggaaattcttcctccccattgacctgagtcccagagacttagggacacagacttcaggtgaggctgcggacctcagaagcagtggataatagattggggcattaaaagcttttgaggcagggggctcatgttttgactgcagggagttatgctgagcaaagagatgtgtttttcaaaaccagggttcaaaaccagtgtccacgctggagtaagtggagcatgcttctctgtgttctctgaatgatcttgcactcctcttaagcaaaggagtaccatgaccatagtcagtgggatcccacaaatgttcttaaatgggtaaggctttaagtagccagagagtatccagcctaccattggcttctccacatcctaaaacctgagacagccttggtatatgctttataaatgtttcttttcttgttgtttaagtaattaaagtgtttaaaatgtc

SEQ ID NO: 460185 - DNA, 8906 bp, Homo sapiens
cggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaagggtccccttctgcttgttatagccccagtagtcctgtccaggttctagaagactccacctacttttccccagactttcagctctattctgggaggcatgaaacatctgctttgacggtggaggcaaccagtagcatcagggaaaaagttgttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctggccattcagcaccaggccacagggagtgcaggaccagcccatcctacaaacaacttttcttccacggaaaacctcactcaagaagacccacaaatggtctaccagtcagcacgccaagaaccgcagggtcaagaacaccaggtggacaatacggtgatggagaaacaggtccggtccagcagcctcagcagaacaacgaggaactgcccacttacgaggaggcaaaagcacagtcgcagttcttcagggggcagcagcagcagcaacagcagcagggggcggtgggccatggttactacatggcagggggcaccagtcagaagtcccgaactgaggggaggcccactgtgaaccgtgccaacagtggacaggcgcataaggacgaggcgctgaaggaactgaagcagggccacgtccgctcgctcagcgagagaatcatgcagctgtccctggagaggaatggggccaagcaacaccttcccggctcggggaatggaaagggcttcaaagtaggaggggggccctcccctgcccagcctgcaggtaaagtgctggaccctcggggtcctccacctgagtaccccttcaagaccaagcaaatgatgtccccagtcagcaagacccaggagcacggacttttttatggtgaccagcaccccgggatgctccacgagatggtcaagccctaccctgctcctcagcctgtgagaacagatgtggccgtcctgcggtaccacgccaccccctgagtatggggtaacgagccgcccatgccaacttccgttcccatcaaccatgcagcagcacagccccatgtcctcccagacctcttccgccagcgggccactgcactctgtctccctgccgcttccactcccgatggccctgggtgctccacagcccccgcctgccgcctcccccagccagcagcttggtccagatgcctttgcgattgtggagcgagcccagcaaatggtggagatattaacagaggagaaccgggtgcttcaccaggaacttcagggttactacgacaatgccgacaagctccacaagtttgaaaaagaacttcagagaatttcggaagcctatgaaagtctggtcaagtctaccaccaagcgagaatcgctggacaaggccatgagaaacaaattggaaggcgagattagaagacttcatgatttcaacagagacctccgagatcgactagagactgctaacaggcaactatccagcagggaatacgaagggcatgaagacaaagctgcagaggggcattatgcttcccagaacaaagaattcttgaaggaaaaggagaaattagaaatggagttagcagcagtgcggactgcaagtgaggaccatcggagacacatcgagatcctggaccaggctttgagcaacgcccaggccagggtcatcaagctggaagaggagttacgagagaagcaagcatatgttgagaaagttgagaagctgcagcaggccctgacccagctgcagtctgcatgtgagaagcgagaacagatggagcggagactgcggacttggctggagagagagctggatgcactgagaacccagcagaaacatggaaatggccagccagccaacatgccggaatacaatgccccagccctcctggaacttgtgcgggagaaggaggagcggatcctggccctggaggccgacatgacaaagtgggagcagaagtacctggaggagagcaccatccgacactttgccatgaatgccgcagccactgcagcagctgagagggacaccacgatcatcaaccactcacggaatggcagctacggagagagctcgctggaggcccacatctggcaagaggaggaggaggtggtgcaggccaacagaaggtgtcaggacatggaatacactattaaaaatctccatgccaaaatcatagagaaagatgctatgattaaggtcctgcagcagcgatctcgtaaagatgccgggaagacagactcctccagcctacgtcctgcccgctccgttccatccatagcagcagctactgggacacactctcgccagacctctcttaccagcagccagctggctgaggaaaagaaggaagagaagacctggaaggggagcataggattgctgctggggaaggagcaccatgagcatgcctctgccccactgctgccacccccacccacctcagcactgtcctccatagcctccactacggcagccagcagtgcccacgccaagacaggcagcaaggacagcagcacacagactgacaagagtgccgagctcttctggcccagcatggcctcccttcccagccgcggccggctgagcacgacccctgctcacagccccgtcctgaaacacccagcggccaaagggaccgcagagaaactggagaactctcctggccatgggaagtcgcctgaccacagaggccgggtcagcagcttgctgcacaagcccgagttccctgatggagagatgatggaagtcctcatctaactgccatccctgtggaatttcagtacagaacactgacaaacaaggaaagcggcagagaaagaagaaagacctagaaggttgtagatgggaaatcaggaatgatttgaactgataaagatttcagactcataagaacacattttataaatgttaaacacaaaaactacatgactgaagatagaagagaatgcgatggattttattacacatggtggaagagagaagaggcgtgtaggtttgcaaacaaagttaagaaataggaaactgaatttttcattgtacagaaaatgtatctcttggggagggcctgtgtacccccattctctgattataaacagataaacccaaatgtggatcatccttggaatacccccattctccttgcctcttagcatgtttgatttaagaaaagcctccaggaaatcttgagagcctgtcttggcataatgcagtgtcacctgtgccaaccatggggtgtcccgtgagtgtgagtgtggcagtgagaagaagcatcgagggcgaggggaatatgaaagttggtcttcacctaattacctgtttggtttggattttcaagagatgattgggcttcttagcttttctgaattctgcagtattttctaaacaggatagattatgatctcggtccccatccatcctaacttctgagttcatctctgtctctgctttacagtctttaattttttgttgttccttcatttttttctttttaataagacatagcagaattccttaggtatgggatttatgagaccagtacctgaactgtcatcattcctactgtgtttgatagtgaccagtaggacaaagccacgtgccgacttcctggctgcttcacctttgcatagctgggttgcagctgcgaacctcattctgactgtgaactaagcaagctttgaggaggcaggagattccgtgggtccctgtgacatattgcattaagatcgtggcacttgcttttttgtctttcacatcggctgtcttgcaaggagcttgacatttccaaattccattgctctgtttggggaagacttaggacagcactccaggaaacagatgacaatttacagacagttgtctcagtggtttccagaatctcaccagcctcccgtatagcttcttgtattgaggctcatgagcgtattcacactctttcctcccccgcgcacgcctctgcttgctctcgatcagcatccagacctccgtggcaccaggttgcctctgttgtgaacttcttttgtaacctaccaggccagttgtatatacagtgttgtcaggtttttccgggtttcagttttgaggcagtttattcaaagtgagacagaagtgccacggaaaagaggcaggagtgtgttaggtggtgggtccattagacctctgctgtgacattgcatattcagctctgcagacactggcttcctttacaaatctaagagatgctggattagaaaagaggagaagctcatcgggccatcagagagatgctcctacagggtcctgatgtttttgtacctccaggtcagctggatcgctgttttcccagttccctttgctcatgcttacttagaggaagaaagaaaggggggtacctcttccaagtaccttctaaatgaaacactcaagagagtgctactcaggaaactttgcttggatcctaaaatggactggtcttgggtgtgtaaccccggtgaagttatagcctccccaaattgaggtgacagaaggaagacaagaggtgtaagctggagagggaagggaagaaatcagtggctttggccagcctctgtgccacccagtacgacagaggagtgggaactggccctctggggctctgcttggccataggcactgcacattgtgccacctgctcatcacctcctctagtctcacactgagcatcggagtacctgttgtgcagacaggaaaactgaggagctctgagaggctgagcatggagctcaccccatgccatagggtgtgggaagagggcacaggaggcctcatccatgggggaaagggttgaggatggacatgggtggggagagggcatagacatcccttcctaatctctgttcccaccacatttcataggagatgagttaggagatgacagctaactctcttaaggacattttgaccccagtttatgttggggatggaccagaaaggaaaatgtctagagataggaaggtaaatcaactctgccagcccctaccatcaggtctgggccaccccaaacttgggctgcctcccttagacataggttagagtgagagacccagctgtttctcccgaagcctcgtcttcatgccccagacacctgattgccccaatcaggtgtcagacttgcttgctcttcgaggtccccctgagctgccaagtgttttcattgtaaacagacacatcgccatgtttcagggcttcaacggcattgtattttggactttgaccgtattttttttctcttaacctactgagactcttccttaagaacaggatctatagctttaaaatgtcttcttctatgggaaatttcctgccaagccagggcactaaattctttcatcattagagctttcctgaagtccggccatatactgagtacctgctctgagttctgggcagcttacaatatcttaaacagattttcagaaaaataatgcaactatattttctagtgtcaactgtatgcaaacagtgtggtaaataccttttaattagtcctccacccacctggagtacagggggtgcgtttattattctgatttcactgatgaggaaatgggctcagaaaggttaagtcccttcctgaaatctcacagccaggagaagctaggatgatttaaaacaaagtttggagaggcactgggcatagaccctggctgtacagcctctaacatgcggcactgcatcttggcagtctctatgcctgtctgtgatgtgtgtgtgcacgtgtaactacacacacacacacacacacacacacacacagctatcacacatctcagagcctaagaaataggactaagcccagaactcctagaatcacctataaatgctaggcatagatggaaattattgtgttccaccagaagcacagctccaaactatacctaaaaaatatttctgcacttcccagagacctggacttcaaactttcccagtggagcctgattatagaacttgagggtcctatctcaggatgaaggggagaggccctggcttcacgggaaggtattccagcattgttctgcttcacccttgactgcgttgtctggcagtttctgtgtgctgccaggatattatatggaactggagaagttggagtcaggtctctgaagctagagtttcactaattagatgcctctgtacatgagaactattactgtctgcaggtccatatagctaagctgccaggaaaaacacattatcttccaaaactttcagagcatgtgcagaaccctttcttagcgttttcttctcagcattttctctgcctcccagaggctggcagccagtgacactgcagagttcagcatgttctaaccatgcacgcagggcaggggctgccttggccctcctcaggctttcgttgggagagcaggcagtggtggagcccttctgggtgcagtcctctggggttgctctttggaactcatgtatgagtttgactccacaaggcttggcatggataccaaaacagttgcaacaaattagttctgaacctggaacagagaattcagtgcttctgttactcaggaaggaggtgttcagaatgccccgtgcagagcagccagtcattactcttgtttgttctcacctgggtgcgcaccctcatgatgcagtggctgtagcaccttcatgccaggtgctgagagaatgggaaattcttcctccccattgacctgagtcccagagacttagggacacagacttcaggtgaggctgcggacctcagaagcagtggataatagattggggcattaaaagcttttgaggcagggggctcatgttttgactgcagggagttatgctgagcaaagagatgtgtttttcaaaaccagggttcaaaaccagtgtccacgctggagtaagtggagcatgcttctctgtgttctctgaatgatcttgcactcctcttaagcaaaggagtaccatgaccatagtcagtgggatcccacaaatgttcttaaatgggtaaggctttaagtagccagagagtatccagcctaccattggcttctccacatcctaaaacctgagacagccttggtatatgctttataaatgtttcttttcttgttgtttaagtaattaaagtgtttaaaatgtcttcattagatgtgacgattgtttaatgagtttgcctctgacgtgtggctccatgggagataggcaaagtaattaagaagttaccagaaattggtcggctggggaaatgcaaaagttagcatttcagtagtgaatttctcctggaacaaatgagcaatttttcctctttctcttaagtagtatacccttttctcacttagtaatttaatggtatataaagacatgtgtataagtgagtgcatacatatgaggtatgactatagggttgtttgtgggaatttcttttcctaacatacagaagatcaaagtgttcatctcaccccgccctccttaaaaggtgtcttttgggagactatgtgctcattgactatagtgctgccaagtaaaaatatcttgggaactcttctactagaatggccttcagggcttggcatgttcctttggtttacccttagagatgagaaatcctcctcctttgaggatggatttaagttctggaaataatctcaagtgcttgatagcacagttggatgaaaaaagatggcaattaaggtaagttacaccatttttgtttctaaaaaaatccctaagaaatttcttggaatgagtctttggcctcagagcctctcaaagtgtccacttcaaggggggatcatcctcattagcacacagatttttaaaaatcaattctcttgccatgcctcctatgtgttcacatctctgcatacactacagatataagtgcataatcattcatataaacatctggtaggtattctgtaaaactgtgtttactttagtgcatgttattgtcatgttatgatgtgactggggtgtttctttgtcatgaaactttgcttcttcacagaattagaatactgctctctctatattgaactacatatacagcgttttcttgtatcagcccccaaagtctggatgcccggtgttgtgtttacatgtgattgtgcctaggagtctgttcacatagagacacctgtaagtatttattacaaaacggaatgtaagcaaatatatccacattggttttatttgaatcaaggtgtttttttgttttttgttttttttccttttgaggaggaacagggagcctcctcctccatgagcacttacagaattgtgtaaaattctgtgaaacagtggtaagcatgggcacccgatttcagctgtcctgctgccgctgccctccaacctgctctgtgtgtgtgtgtcgctgtgcttggtggcagtgtgccgtgctcgtgccggctcttcccagcagactggtatctggctgtaacgtttgacgtcttcatattgccagtctgtattgaggggtgatgtacatggccatacagccaaatgggtctgtgtaccagtgtggggattccaagaacactgcctgtcccccacagcaaatattgatgctgttggtcagccaaagattttcctctcctttgctgcttaaacttgtgccttaatattgtacataataaatggataaaatggcaa

SEQ ID NO: 460186 - DNA, 8500 bp, Homo sapiens
cggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaagggtccccttctgcttgttatagccccagtagtcctgtccaggttctagaagactccacctacttttccccagactttcagctctattctgggaggcatgaaacatctgctttgacggtggaggcaaccagtagcatcagggaaaaagttgttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctggccattcagcaccaggccacagggagtgcaggaccagcccatcctacaaacaacttttcttccacggaaaacctcactcaagaagacccacaaatggtctaccagtcagcacgccaagaaccgcagggtcaagaacaccaggtggacaatacggtgatggagaaacaggtccggtccagcagcctcagcagaacaacgaggaactgcccacttacgaggaggcaaaagcacagtcgcagttcttcagggggcagcagcagcagcaacagcagcagggggcggtgggccatggttactacatggcagggggcaccagtcagaagtcccgaactgaggggaggcccactgtgaaccgtgccaacagtggacaggcgcataaggacgaggcgctgaaggaactgaagcagggccacgtccgctcgctcagcgagagaatcatgcagctgtccctggagaggaatggggccaagcaacaccttcccggctcggggaatggaaagggcttcaaagtaggaggggggccctcccctgcccagcctgcaggtaaagtgctggaccctcggggtcctccacctgagtaccccttcaagaccaagcaaatgatgtccccagtcagcaagacccaggagcacggacttttttatggtgaccagcaccccgggatgctccacgagatggtcaagccctaccctgctcctcagcctgtgagaacagatgtggccgtcctgcggtaccacgccaccccctgagtatggggtaacgagccgcccatgccaacttccgttcccatcaaccatgcagcagcacagccccatgtcctcccagacctcttccgccagcgggccactgcactctgtctccctgccgcttccactcccgatggccctgggtgctccacagcccccgcctgccgcctcccccagccagcagcttggtccagatgcctttgcgattgtggagcgagcccagcaaatggtggagatattaacagaggagaaccgggtgcttcaccaggaacttcagggttactacgacaatgccgacaagctccacaagtttgaaaaagaacttcagagaatttcggaagcctatgaaagtctggtcaagtctaccaccaagcgagaatcgctggacaaggccatgagaaacaaattggaaggcgagattagaagacttcatgatttcaacagagacctccgagatcgactagagactgctaacaggcaactatccagcagggaatacgaagggcatgaagacaaagctgcagaggggcattatgcttcccagaacaaagaattcttgaaggaaaaggagaaattagaaatggagttagcagcagtgcggactgcaagtgaggaccatcggagacacatcgagatcctggaccaggctttgagcaacgcccaggccagggtcatcaagctggaagaggagttacgagagaagcaagcatatgttgagaaagttgagaagctgcagcaggccctgacccagctgcagtctgcatgtgagaagcgagaacagatggagcggagactgcggacttggctggagagagagctggatgcactgagaacccagcagaaacatggaaatggccagccagccaacatgccggaatacaatgccccagccctcctggaacttgtgcgggagaaggaggagcggatcctggccctggaggccgacatgacaaagtgggagcagaagtacctggaggagagcaccatccgacactttgccatgaatgccgcagccactgcagcagctgagagggacaccacgatcatcaaccactcacggaatggcagctacggagagagctcgctggaggcccacatctggcaagaggaggaggaggtggtgcaggccaacagaaggtgtcaggacatggaatacactattaaaaatctccatgccaaaatcatagagaaagatgctatgattaaggtcctgcagcagcgatctcgtaaagatgccgggaagacagactcctccagcctacgtcctgcccgctccgttccatccatagcagcagctactgggacacactctcgccagacctctcttaccagcagccagctggctgaggaaaagaaggaagagaagacctggaaggggagcatagaatgggataatggggagagcacattggaagaagtgctctctcgcataaggattgctgctggggaaggagcaccatgagcatgcctctgccccactgctgccacccccacccacctcagcactgtcctccatagcctccactacggcagccagcagtgcccacgccaagacaggcagcaaggacagcagcacacagactgacaagagtgccgagctcttctggcccagcatggcctcccttcccagccgcggccggctgagcacgacccctgctcacagccccgtcctgaaacacccagcggccaaagggaccgcagagaaactggagaactctcctggccatgggaagtcgcctgaccacagaggccgggtcagcagcttgctgcacaagcccgagttccctgatggagagatgatggaagtcctcatctaactgccatccctgtggaatttcagtacagaacactgacaaacaaggaaagcggcagagaaagaagaaagacctagaaggttgtagatgggaaatcaggaatgatttgaactgataaagatttcagactcataagaacacattttataaatgttaaacacaaaaactacatgactgaagatagaagagaatgcgatggattttattacacatggtggaagagagaagaggcgtgtaggtttgcaaacaaagttaagaaataggaaactgaatttttcattgtacagaaaatgtatctcttggggagggcctgtgtacccccattctctgattataaacagataaacccaaatgtggatcatccttggaatacccccattctccttgcctcttagcatgtttgatttaagaaaagcctccaggaaatcttgagagcctgtcttggcataatgcagtgtcacctgtgccaaccatggggtgtcccgtgagtgtgagtgtggcagtgagaagaagcatcgagggcgaggggaatatgaaagttggtcttcacctaattacctgtttggtttggattttcaagagatgattgggcttcttagcttttctgaattctgcagtattttctaaacaggatagattatgatctcggtccccatccatcctaacttctgagttcatctctgtctctgctttacagtctttaattttttgttgttccttcatttttttctttttaataagacatagcagaattccttaggtatgggatttatgagaccagtacctgaactgtcatcattcctactgtgtttgatagtgaccagtaggacaaagccacgtgccgacttcctggctgcttcacctttgcatagctgggttgcagctgcgaacctcattctgactgtgaactaagcaagctttgaggaggcaggagattccgtgggtccctgtgacatattgcattaagatcgtggcacttgcttttttgtctttcacatcggctgtcttgcaaggagcttgacatttccaaattccattgctctgtttggggaagacttaggacagcactccaggaaacagatgacaatttacagacagttgtctcagtggtttccagaatctcaccagcctcccgtatagcttcttgtattgaggctcatgagcgtattcacactctttcctcccccgcgcacgcctctgcttgctctcgatcagcatccagacctccgtggcaccaggttgcctctgttgtgaacttcttttgtaacctaccaggccagttgtatatacagtgttgtcaggtttttccgggtttcagttttgaggcagtttattcaaagtgagacagaagtgccacggaaaagaggcaggagtgtgttaggtggtgggtccattagacctctgctgtgacattgcatattcagctctgcagacactggcttcctttacaaatctaagagatgctggattagaaaagaggagaagctcatcgggccatcagagagatgctcctacagggtcctgatgtttttgtacctccaggtcagctggatcgctgttttcccagttccctttgctcatgcttacttagaggaagaaagaaaggggggtacctcttccaagtaccttctaaatgaaacactcaagagagtgctactcaggaaactttgcttggatcctaaaatggactggtcttgggtgtgtaaccccggtgaagttatagcctccccaaattgaggtgacagaaggaagacaagaggtgtaagctggagagggaagggaagaaatcagtggctttggccagcctctgtgccacccagtacgacagaggagtgggaactggccctctggggctctgcttggccataggcactgcacattgtgccacctgctcatcacctcctctagtctcacactgagcatcggagtacctgttgtgcagacaggaaaactgaggagctctgagaggctgagcatggagctcaccccatgccatagggtgtgggaagagggcacaggaggcctcatccatgggggaaagggttgaggatggacatgggtggggagagggcatagacatcccttcctaatctctgttcccaccacatttcataggagatgagttaggagatgacagctaactctcttaaggacattttgaccccagtttatgttggggatggaccagaaaggaaaatgtctagagataggaaggtaaatcaactctgccagcccctaccatcaggtctgggccaccccaaacttgggctgcctcccttagacataggttagagtgagagacccagctgtttctcccgaagcctcgtcttcatgccccagacacctgattgccccaatcaggtgtcagacttgcttgctcttcgaggtccccctgagctgccaagtgttttcattgtaaacagacacatcgccatgtttcagggcttcaacggcattgtattttggactttgaccgtattttttttctcttaacctactgagactcttccttaagaacaggatctatagctttaaaatgtcttcttctatgggaaatttcctgccaagccagggcactaaattctttcatcattagagctttcctgaagtccggccatatactgagtacctgctctgagttctgggcagcttacaatatcttaaacagattttcagaaaaataatgcaactatattttctagtgtcaactgtatgcaaacagtgtggtaaataccttttaattagtcctccacccacctggagtacagggggtgcgtttattattctgatttcactgatgaggaaatgggctcagaaaggttaagtcccttcctgaaatctcacagccaggagaagctaggatgatttaaaacaaagtttggagaggcactgggcatagaccctggctgtacagcctctaacatgcggcactgcatcttggcagtctctatgcctgtctgtgatgtgtgtgtgcacgtgtaactacacacacacacacacacacacacacacacagctatcacacatctcagagcctaagaaataggactaagcccagaactcctagaatcacctataaatgctaggcatagatggaaattattgtgttccaccagaagcacagctccaaactatacctaaaaaatatttctgcacttcccagagacctggacttcaaactttcccagtggagcctgattatagaacttgagggtcctatctcaggatgaaggggagaggccctggcttcacgggaaggtattccagcattgttctgcttcacccttgactgcgttgtctggcagtttctgtgtgctgccaggatattatatggaactggagaagttggagtcaggtctctgaagctagagtttcactaattagatgcctctgtacatgagaactattactgtctgcaggtccatatagctaagctgccaggaaaaacacattatcttccaaaactttcagagcatgtgcagaaccctttcttagcgttttcttctcagcattttctctgcctcccagaggctggcagccagtgacactgcagagttcagcatgttctaaccatgcacgcagggcaggggctgccttggccctcctcaggctttcgttgggagagcaggcagtggtggagcccttctgggtgcagtcctctggggttgctctttggaactcatgtatgagtttgactccacaaggcttggcatggataccaaaacagttgcaacaaattagttctgaacctggaacagagaattcagtgcttctgttactcaggaaggaggtgttcagaatgccccgtgcagagcagccagtcattactcttgtttgttctcacctgggtgcgcaccctcatgatgcagtggctgtagcaccttcatgccaggtgctgagagaatgggaaattcttcctccccattgacctgagtcccagagacttagggacacagacttcaggtgaggctgcggacctcagaagcagtggataatagattggggcattaaaagcttttgaggcagggggctcatgttttgactgcagggagttatgctgagcaaagagatgtgtttttcaaaaccagggttcaaaaccagtgtccacgctggagtaagtggagcatgcttctctgtgttctctgaatgatcttgcactcctcttaagcaaaggagtaccatgaccatagtcagtgggatcccacaaatgttcttaaatgggtaaggctttaagtagccagagagtatccagcctaccattggcttctccacatcctaaaacctgagacagccttggtatatgctttataaatgtttcttttcttgttgtttaagtaattaaagtgtttaaaatgtcttcattagatgtgacgattgtttaatgagtttgcctctgacgtgtggctccatgggagataggcaaagtaattaagaagttaccagaaattggtcggctggggaaatgcaaaagttagcatttcagtagtgaatttctcctggaacaaatgagcaatttttcctctttctcttaagtagtatacccttttctcacttagtaatttaatggtatataaagacatgtgtataagtgagtgcatacatatgaggtatgactatagggttgtttgtgggaatttcttttcctaacatacagaagatcaaagtgttcatctcaccccgccctccttaaaaggtgtcttttgggagactatgtgctcattgactatagtgctgccaagtaaaaatatcttgggaactcttctactagaatggccttcagggcttggcatgttcctttggtttacccttagagatgagaaatcctcctcctttgaggatggatttaagttctggaaataatctcaagtgcttgatagcacagttggatgaaaaaagatggcaattaaggtaagttacaccatttttgtttctaaaaaaatccctaagaaatttcttggaatgagtctttggcctcagagcctctcaaagtgtccacttcaaggggggatcatcctcattagcacacagatttttaaaaatcaattctcttgccatgcctcctatgtgttcacatctctgcatacactacagatataagtgcataatcattcatataaacatctggtaggtattctgtaaaactgtgtttactttagtgcatgttattgtcatgttatgatgtgactggggtgtttctttgtcatgaaactttgcttcttcacagaattagaatactgctctctctatattgaactacatatacagcgttttcttgtatcagcccccaaagtctggatgcccggtgttgtgtttacatgtgattgtgcctaggagtctgttcacatagagacacctgtaagtatttattacaaaacggaatgtaagcaaatatatccacattggttttatttga

SEQ ID NO: 460187 - DNA, 3464 bp, Homo sapiens
cggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaagggtccccttctgcttgttatagccccagtagtcctgtccaggttctagaagactccacctacttttccccagactttcagctctattctgggaggcatgaaacatctgctttgacggtggaggcaaccagtagcatcagggaaaaagttgttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctggccattcagcaccaggccacagggagtgcaggaccagcccatcctacaaacaacttttcttccacggaaaacctcactcaagaagacccacaaatggtctaccagtcagcacgccaagaaccgcagggtcaagaacaccaggtggacaatacggtgatggagaaacaggtccggtccagcagcctcagcagaacaacgaggaactgcccacttacgaggaggcaaaagcacagtcgcagttcttcagggggcagcagcagcagcaacagcagcagggggcggtgggccatggttactacatggcagggggcaccagtcagaagtcccgaactgaggggaggcccactgtgaaccgtgccaacagtggacaggcgcataaggacgaggcgctgaaggaactgaagcagggccacgtccgctcgctcagcgagagaatcatgcagctgtccctggagaggaatggggccaagcaacaccttcccggctcggggaatggaaagggcttcaaagtaggaggggggccctcccctgcccagcctgcaggtaaagtgctggaccctcggggtcctccacctgagtaccccttcaagaccaagcaaatgatgtccccagtcagcaagacccaggagcacggacttttttatggtgaccagcaccccgggatgctccacgagatggtcaagccctaccctgctcctcagcctgtgagaacagatgtggccgtcctgcggtaccacgccaccccctgagtatggggtaacgagccgcccatgccaacttccgttcccatcaaccatgcagcagcacagccccatgtcctcccagacctcttccgccagcgggccactgcactctgtctccctgccgcttccactcccgatggccctgggtgctccacagcccccgcctgccgcctcccccagccagcagcttggtccagatgcctttgcgattgtggagcgagcccagcaaatggtggagatattaacagaggagaaccgggtgcttcaccaggaacttcagggttactacgacaatgccgacaagctccacaagtttgaaaaagaacttcagagaatttcggaagcctatgaaagtctggtcaagtctaccaccaagcgagaatcgctggacaaggccatgagaaacaaattggaaggcgagattagaagacttcatgatttcaacagagacctccgagatcgactagagactgctaacaggcaactatccagcagggaatacgaagggcatgaagacaaagctgcagaggggcattatgcttcccagaacaaagaattcttgaaggaaaaggagaaattagaaatggagttagcagcagtgcggactgcaagtgaggaccatcggagacacatcgagatcctggaccaggctttgagcaacgcccaggccagggtcatcaagctggaagaggagttacgagagaagcaagcatatgttgagaaagttgagaagctgcagcaggccctgacccagctgcagtctgcatgtgagaagcgagaacagatggagcggagactgcggacttggctggagagagagctggatgcactgagaacccagcagaaacatggaaatggccagccagccaacatgccggaatacaatgccccagccctcctggaacttgtgcgggagaaggaggagcggatcctggccctggaggccgacatgacaaagtgggagcagaagtacctggaggagagcaccatccgacactttgccatgaatgccgcagccactgcagcagctgagagggacaccacgatcatcaaccactcacggaatggcagctacggagagagctcgctggaggcccacatctggcaagaggaggaggaggtggtgcaggccaacagaaggtgtcaggacatggaatacactattaaaaatctccatgccaaaatcatagagaaagatgctatgattaaggtcctgcagcagcgatctcgtaaagatgccgggaagacagactcctccagcctacgtcctgcccgctccgttccatccatagcagcagctactgggacacactctcgccagacctctcttaccagcagccagctggctgaggaaaagaaggaagagaagacctggaaggggagcatagaatgggataatggggagagcacattggaagaagtgctctctcgcataaggattgctgctggggaaggagcaccatgagcatgcctctgccccactgctgccacccccacccacctcagcactgtcctccatagcctccactacggcagccagcagtgcccacgccaagacaggcagcaaggacagcagcacacagactgacaagagtgccgagctcttctggcccagcatggcctcccttcccagccgcggccggctgagcacgacccctgctcacagccccgtcctgaaacacccagcggccaaagggaccgcagagaaactggagaactctcctggccatgggaagtcgcctgaccacagaggccgggtcagcagcttgctgcacaagcccgagttccctgatggagagatgatggaagtcctcatctaactgccatccctgtggaatttcagtacagaacactgacaaacaaggaaagcggcagagaaagaagaaagacctagaaggttgtagatgggaaatcaggaatgatttgaactgataaagatttcagactcataagaacacattttataaatgttaaacacaaaaactacatgactgaagatagaagagaatgcgatggattttattacacatggtggaagagagaagaggcgtgtaggtttgcaaacaaagttaagaaataggaaactgaatttttcattgtacagaaaatgtatctcttggggagggcctgtgtacccccattctctgattataaacagataaacccaaatgtggatcatccttggaataccccc

SEQ ID NO: 460188 - DNA, 454 bp, Homo sapiens
gctggggaaggagcaccatgagcatgcctctgccccactgctgccacccccacccacctcagcactgtcctccatagcctccactacggcagccagcagtgcccacgccaagacaggcagcaaggacagcagcacacagactgacaagagtgccgagctcttctggcccagcatggcctcccttcccagccgcggccggctgagcacgacccctgctcacagccccgtcctgaaacacccagcggccaaagggaccgcagagaaactgggtatgtgggctaccccaccttgatgcccctgaaaactgtggaactgtctggcctaagagaatcttttgttgagctagagaggaagcaggggcacccatcagctcttactctatggggatgctattctaatgcacttaggatatgtgtgccctttcttattacgggaataaatatgcatatagaca

SEQ ID NO: 460189 - DNA, 470 bp, Homo sapiens
tccctcctttctgtcctcaaccttgaccattcagaactttgtgacacattcagtcccgcagaggacttgactttcgctggtgctgctgcaacccttggaaccgggttgtgtgagaacattagagcatttgcgccttcactcagtgtgtcttgaggactgttatgttgacctcacgggtcattttggtgggtggctggacttgtgataattctgaatagtaactttggaattttatgaatcaaaaagaaagagctccctctgccaagttgaaacactgtgggagaatgcctggtgggttcttgtgagtcacacaggaaggaaggaggacttgatgggcactcatattcacttcgctttctttcccccagggtccccttctgcttgttatagccccagtagtcctgtccaggttctagaagactccacctacttttccccagactttcagctctattctgggaggcatgaaa

SEQ ID NO: 460190 - DNA, 3415 bp, Homo sapiens
cggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaagggtccccttctgcttgttatagccccagtagtcctgtccaggttctagaagactccacctacttttccccagactttcagctctattctgggaggcatgaaacatctgctttgacggtggaggcaaccagtagcatcagggaaaaagttgttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctggccattcagcaccaggccacagggagtgcaggaccagcccatcctacaaacaacttttcttccacggaaaacctcactcaagaagacccacaaatggtctaccagtcagcacgccaagaaccgcagggtcaagaacaccaggtggacaatacggtgatggagaaacaggtccggtccagcagcctcagcagaacaacgaggaactgcccacttacgaggaggcaaaagcacagtcgcagttcttcagggggcagcagcagcagcaacagcagcagggggcggtgggccatggttactacatggcagggggcaccagtcagaagtcccgaactgaggggaggcccactgtgaaccgtgccaacagtggacaggcgcataaggacgaggcgctgaaggaactgaagcagggccacgtccgctcgctcagcgagagaatcatgcagctgtccctggagaggaatggggccaagcaacaccttcccggctcggggaatggaaagggcttcaaagtaggaggggggccctcccctgcccagcctgcaggtaaagtgctggaccctcggggtcctccacctgagtaccccttcaagaccaagcaaatgatgtccccagtcagcaagacccaggagcacggacttttttatggtgaccagcaccccgggatgctccacgagatggtcaagccctaccctgctcctcagcctgtgagaacagatgtggccgtcctgcggtaccacgccaccccctgagtatggggtaacgagccgcccatgccaacttccgttcccatcaaccatgcagcagcacagccccatgtcctcccagacctcttccgccagcgggccactgcactctgtctccctgccgcttccactcccgatggccctgggtgctccacagcccccgcctgccgcctcccccagccagcagcttggtccagatgcctttgcgattgtggagcgagcccagcaaatggtggagatattaacagaggagaaccgggtgcttcaccaggaacttcagggttactacgacaatgccgacaagctccacaagtttgaaaaagaacttcagagaatttcggaagcctatgaaagtctggtcaagtctaccaccaagcgagaatcgctggacaaggccatgagaaacaaattggaaggcgagattagaagacttcatgatttcaacagagacctccgagatcgactagagactgctaacaggcaactatccagcagggaatacgaagggcatgaagacaaagctgcagaggggcattatgcttcccagaacaaagaattcttgaaggaaaaggagaaattagaaatggagttagcagcagtgcggactgcaagtgaggaccatcggagacacatcgagatcctggaccaggctttgagcaacgcccaggccagggtcatcaagctggaagaggagttacgagagaagcaagcatatgttgagaaagttgagaagctgcagcaggccctgacccagctgcagtctgcatgtgagaagcgagaacagatggagcggagactgcggacttggctggagagagagctggatgcactgagaacccagcagaaacatggaaatggccagccagccaacatgccggaatacaatgccccagccctcctggaacttgtgcgggagaaggaggagcggatcctggccctggaggccgacatgacaaagtgggagcagaagtacctggaggagagcaccatccgacactttgccatgaatgccgcagccactgcagcagctgagagggacaccacgatcatcaaccactcacggaatggcagctacggagagagctcgctggaggcccacatctggcaagaggaggaggaggtggtgcaggccaacagaaggtgtcaggacatggaatacactattaaaaatctccatgccaaaatcatagagaaagatgctatgattaaggtcctgcagcagcgatctcgtaaagatgccgggaagacagactcctccagcctacgtcctgcccgctccgttccatccatagcagcagctactgggacacactctcgccagacctctcttaccagcagccagctggctgaggaaaagaaggaagagaagacctggaaggggagcataggattgctgctggggaaggagcaccatgagcatgcctctgccccactgctgccacccccacccacctcagcactgtcctccatagcctccactacggcagccagcagtgcccacgccaagacaggcagcaaggacagcagcacacagactgacaagagtgccgagctcttctggcccagcatggcctcccttcccagccgcggccggctgagcacgacccctgctcacagccccgtcctgaaacacccagcggccaaagggaccgcagagaaactggagaactctcctggccatgggaagtcgcctgaccacagaggccgggtcagcagcttgctgcacaagcccgagttccctgatggagagatgatggaagtcctcatctaactgccatccctgtggaatttcagtacagaacactgacaaacaaggaaagcggcagagaaagaagaaagacctagaaggttgtagatgggaaatcaggaatgatttgaactgataaagatttcagactcataagaacacattttataaatgttaaacacaaaaactacatgactgaagatagaagagaatgcgatggattttattacacatggtggaagagagaagaggcgtgtaggtttgcaaacaaagttaagaaataggaaactgaatttttcattgtacagaaaatgtatctcttggggagggcctgtgtacccccattctctgattataaacagataaacccaaatgtggatcatccttggaataccccc

SEQ ID NO: 460191 - DNA, 1437 bp, Homo sapiens
cggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaagggtccccttctgcttgttatagccccagtagtcctgtccaggttctagaagactccacctacttttccccagactttcagctctattctgggaggcatgaaacatctgctttgacggtggaggcaaccagtagcatcagggaaaaagttgttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctggccattcagcaccaggccacagggagtgcaggaccagcccatcctacaaacaacttttcttccacggaaaacctcactcaagaagacccacaaatggtctaccagtcagcacgccaagaaccgcagggtcaagaacaccaggtggacaatacggtgatggagaaacaggtccggtccagcagcctcagcagaacaacgaggaactgcccacttacgaggaggcaaaagcacagtcgcagttcttcagggggcagcagcagcagcaacagcagcagggggcggtgggccatggttactacatggcagggggcaccagtcagaagtcccgaactgaggggaggcccactgtgaaccgtgccaacagtggacaggcgcataaggacgaggcgctgaaggaactgaagcagggccacgtccgctcgctcagcgagagaatcatgcagctgtccctggagaggaatggggccaagcaacaccttcccggctcggggaatggaaagggcttcaaagtaggaggggggccctcccctgcccagcctgcaggtaaagtgctggaccctcggggtcctccacctgagtaccccttcaagaccaagcaaatgatgtccccagtcagcaagacccaggagcacggacttttttatggtgaccagcaccccgggatgctccacgagatggtcaagccctaccctgctcctcagcctgtgagaacagatgtggccgtcctgcggtaccacgccaccccctgagtatggggtaacgaggtgattatcaactgcagacgtttcgtgcggcttttcaaaattcaatagtcatgttattagcatttattattttcagagcagattaggtttttgtcatcaggcttttttccttatgcatgatatttaataaaccactttgtggccag

SEQ ID NO: 460192 - DNA, 1597 bp, Homo sapiens
ttggagaagaactgaacatgagcaccagaccccactcaacagcatcaatattttgctactcctctacttatcctatattcactggttatataaatataatttatatatatataaatgcactggttgtataaatataactatatttaaattatatttataaattataaatacatatgtatatttaaattatatttatatatattcattggctatataaatataattaactggttgttataaaaaacctgtggctttctttcctcgatgccaccttttctctcacttcctgggctcagtcacccccagctgtgccttatctccttccctgctatccaatgcctctggtctctgccatctgctctgccctctcctgcctgctcccacaaccttgtcccaaattcacttttcagagcccagatactaagtcacacaactttttctggggcctttttttgggggagaagcaggaagtggagaacttggggagagtgggatgccggaaccctgtccagtctcagtgaagaagggtgtggcagccagcagtgcccagaacaccactctcccctggaaaactactacatggtatgcaaggcagatgagaaatttaatcagctgctacattttcttcgcagtcataagcaagagcaacacctggtcttctttagcacttgcacctgtgtggaatactacaggaaggctctggaggtgctgatgaagagtgtgaagattgtgtgcatccatggaaagatgaaatacgatcttcatgcaaattgaaaattgcaattgttctgcaaattgcaaagtggaattttagtgtgcactgatgtggtggcccaggaatcaatgttcctgaagtaaactgggttttgcagtacaatcgcccctacaatgcaagtgcctttgtgcagcacttttcttatattactgatttgagacttctcctcattttgaatgtaagcatttagtgtcataagtttccttttcagcattgctttagctttatctcacatattttgttacttgagtaaacttcagcatttcattttggtttattgataatctttttgagtgtgtttctttgtaccatttttattttgattgcactggatatttcaagcatacatatgtgacttattgcagtctgctggtatcagtgttttgctattttaagtgaaatgtaggaatctttaccttccatgaggggaacatcacacaccggggactgttgtggggtggggagaagggggagggatagcattaggagatatagctaatgctaaatgacgagttaatgggtgcagcacaccaacatggcacatgtatacatatgtaacaaacctgcctgttttgcacatgtaccctaaaacttaaagtataataataataataaaaagacaagtaaatagcaaataccaattgattgaatgtctgtaaataaataaataagcacattaaaaaaaaaagaaacctttaccttccatgattttttatattactgtcttgagcatcagataatgttataattttggctttgaccttcaaatatttttataaacctcatgagaaaaaggatgccctaccctttgtacccatatat

SEQ ID NO: 460193 - DNA, 758 bp, Homo sapiens
ccaggtacctcagttggaaatgcagaaatcacccctcttctgcattggtctggctgggagctgataaacgatgggacaaaactggaaaagacaacaaaagctttggaatgttccacaacttccttttattcgagttcctccctccatctatgacacttccttactaaaggccctcaaccaagggcaacagcgctacttttacagcattatgaggatttacaactccaggccccagtgggaggccctgcagacccgctacattcacagccttcagcaccaacagctgcttggctatattactcaacgggaagccttgtcttatgctcttgtacttagagattcaaccaagagagcctcagccaaggtagctcctcaaagaaccattccccggaaaacttcagccatgacaagaagatgtccatcagtactacctgtatctgtggttctacctagggcccaaagtaaaaggcgccaagtgctcaggaactgagacttggcagcattttcagaaacaggaagtttgcccatgtatccctggtatctagtgggtgctttgtgcatatttgttgaatgacagtgaataatttctaatataaaccccagacctaaaaataatctctgattcatataaattttgccagcaagaccaagaggtttaagagcaatggagccgagagtaagcaagcctttccacataacatccgtagagtaaaaggacttttaaagctttcaaagtaaaagtttactttggattagaa

SEQ ID NO: 460194 - DNA, 900 bp, Homo sapiens
ggaccgtacatccgctggtcctcaagggaccccaaataaccgacgcggcccgcagacctcaaataaccgacgcggcccgcagaccccaaataactgacgtggcccgtagaccccaaataaccgacatggcccacagaccccaaataacggacgcggcccgtagaccccaaataaccgacgtagcccgtagactccaaataaccgacacggcccgcagacctcaaataaccgatgcggcccacagacctcaaataaccgacgcggcctgcagaccccaaataaccaacactgcttacagaccccaaataaccgacgcggcccgcagaccccaaataactgacgtggcccgtagaccccaaataaccgacatggcccgcagaccccaaataacggacgcggcccgtagaccccaaataaccgacacggcccgcagaccccaaataactgacgcagcctgcagaccccagataaccgatgcggcccgcagaccccaaataactgacacagcttggacaggagaactttggagacggcacctggagtcttggaccctgctggatgtcttttccctcgttggccctgtggtgtatccttctgtggagacaaaccacacccaggaacgccgccgctgctgagtcctgagtgtatcttccagcccctccctgagtgtatctttctgtggagacaaaccacacccaggaatgccaccactgctgagtcccgagtccttccagccccgccctgagtgtgcagaggccgtggggcctgacactgcatgacgggcagtgtgctgctcacccaagcctcagaacaaagtatgaaactgattgctttccatcgacacatccagcccagctgagcctggaggccgatttcacacatatttactacatccctgcc

SEQ ID NO: 460195 - DNA, 3993 bp, Homo sapiens
ctgtggcctgttctttctgccctgagttctcccatcacgttgagttcacatgtaacttggtgactcagcactgtagtggagaggcctgtttcctagcagagttgttggagtttgcagaagttatttttgctgtctatcatgaaaataccaagtcagcaagtgatataatcagtattgagtcatgcaaagagtatctgcttggagtagtaaaagttccaacaaaagagctgctgatcaagagatctgggatcacaggatggtatcctatcattttaccagaagacgggggcctacctcatggcctggagctcatgcagaagatcgtgggtggtctggagctttcgatttccttcacgcatcgtggagatagagaacgggtgttggaagctgctgagcatttgggctggagctttgagaacagcctgaaagattttgtcagaatggatgaaggggagccagccactgtcaccatctccaccccaaggctgtggctgcccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcaccaggggcccatcactgctttggtacttcagggaggagaggctagagatccaagtgtggcgagcttatggcaatgacagtgtggagagaccccatcagacagacagctggattggctcagcctatgtggacctggccagacttggggagaggtcagcgaggacgctaactgtcagtggtgtgtatcctctgtttggacgaaatgcttccaacctctcaggagctgccttgcgagttcatgtggttctttcctctctttcctcacaccttgagcccactcatgagctggactccatggactgcagcagccacagtgagtctgagcagctccccagaaggaatgatgaggtccagctctctccaccagaagtcatctcctgccaccagaagtctcctgcctccacccaggtcccctgcagcagcaccacagctgaagtccgcctgacgcaggagggccctgctgatttggatggaacgtttgcagtcagcatcctagtagaaagagcaatgcacttgagcttgaaagggagccccttgacagagcggaaagtatcgatacccagttgttgtgtatcctttgcaacagccgatgagtcatctcctgtatacacccaagtggttgaaaacacagattcccccatctggaattttcaacagcagtcaaggctatcaaaagagctgcttctggacccacaacaaaccctggtcttcaaagtttggcataaaggagatgaggagagggtgattggctttgcctcggtggacctctccccacttctctctggcttccagtttgtctgtggctggtacaacatcacagacttcagtggagagtgccaggggcagataaaagttgctgtctcccctttggagagtttgatacacttcaaagaagaaaggcaagcaaggcgtggagtggagacctcaaaatcactgatcccaatatacagtcccttttccttccctgcctctgatacgtatgctgcattctccagccacatggcaaggcagaccctagaccaacttgctcatgcctcctcaaaggagcttgatttctcctctcctgggagaagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcaggaagaatctgagtgagcttgatcagattcagaggtacttccgccagaagctcaccaagcctttcctacccctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacagatctgcagactatcaccagggattcgcaagcagctttgagttctcaccgagccaggagtagaagcaacaaggccaccaccctcccagatgctcaggacacagaagcactgcaagaacgatgcacaatgccagatgagccattggtaagagctccagataaaggcacagattccccatcaccccctcctctcgaagagacttcaaatggaggaagaatgctccatgagtccctgaggcatgcagtacccattacaaggatgcagagcagtgaagacactgaggcaggcccagcctacagtgatgaggactatgaagaagacatcattgagcccaggaccttaaatgagatcaccacggtgacagacaaaactagcccttggtctagtgtcatatcagacacaagtgaggtcatcagccctcagcctgacgaggtgcagagggaaggcccctcttgtccttctccagggcctttctgcagagaggagcttatggtcaaaagtagctttctctccagcccagaaagggctgtcaacccccacctgcctaggcagggttctcctagccaaagtcttgttgcttgtgagtgtgaggcctctaaggccagggttggtggcgagtctgcctcagccaaccctcagcccatcccatgcccaacactctcaggagctcaacagagcagcacgtttgttggatggagctcaccacagacagatcagaacaaggagcccaagtcagaggccccagctgagaatgaagctgccaccagtgagctcggtgactctgctgatagcttcaagaagttgccgctaaatctagcctcccagagcagaagggaaaaccataagggaccacccatcgactcctctgacatcaggcagaggcaggtgacaactggatcagagacgtccacaaagcagagcctcctgctcccagggcccattgtggtgcccaacttctttttgcctccccagcagttggaggcttccctgcggatgctttcactctcagcaactttgccaccagcagccacaacagatcaggacaagagcgaagccaccaggggagctctctcccaaaggccttgtcgccccagacctaactcgctccccctcaacctgcctgaggaagaaactctcaggattgcacggatattttcttctcagtactcccagaaagactgacgcagcctgaggggctggggggaaggagacacctgcccaccctccgtcagctttgtccagcttgcaggaggcaccaggtctggctccttcagggctgtcacagtcctgaaaccaccacttgcctaggccacggatgcctcaagagacccggtcagcccagactggaggagtgccccaaaccagtccagtgtccacttgccagaatttcagctccttttttctgtggtgaggcaaaggctagaaataaaatggaatccgcgcccaagtgggacccaagcaggcatctttcggtggagaaacgccccccagtgtccttgacacagctgactgctggcatgagcccaccctctgcctgaagatgcaggaccatttttgccttaaaagttggggaggagggacatgtagattgtgtgcattgtgcatagtcaaggaaatcctagggccacctccagttcatttgtgtgggaacaaggatattttatagatacaaattatttttatgctgtgttgaattaatcaattaggagaggaaggggaaatcacttccttcaaactttttatctgattgtctaaaattctaaccatgcttttaacttattatttttacccagctctgaaggtcattgttcttgcctgtgtttgaataaaatcatattggtgtttgtaatctgtgcacaagtgtttc

SEQ ID NO: 460196 - DNA, 617 bp, Homo sapiens
ctgtggcctgttctttctgccctgagttctcccatcacgttgagttcacatgtaacttggtgactcagcactgtagtggagaggcctgtttcctagcagagttgttggagtttgcagaagttatttttgctgtctatcatgaaaataccaagtcaggtgagcaccatatgacttgtcacaatcaaaattaaaagaggctgcattgtgaatggtatagcccttcctaggagatacatactgcagtatttaaaggtgaggagtcataatctctgcaacttatttctgaaagatatagcaaaaaataaggatatgtactaagtatgtaagagaaagatagtgtagagagaaataaagcaaatgtgtcagtgttaatgggtgtatcgagatgaagggtgtgtaggagttcattattatatttttgcaacttttctgtatacctgaatttttttcaaaacatttaatttaaaaaatgggctggcacagtggcccaaacctataatcccagcactttgggaggccgaagtgggaggatcacttgagcccaagagttcaaggtgcagtgagttatgattgcaccactgcattccagcctggatgagagagtgagaccctgccaa

SEQ ID NO: 460197 - DNA, 4089 bp, Homo sapiens
ctgtggcctgttctttctgccctgagttctcccatcacgttgagttcacatgtaacttggtgactcagcactgtagtggagaggcctgtttcctagcagagttgttggagtttgcagaagttatttttgctgtctatcatgaaaataccaagtcaggtgagcaccatatgacttgtcacaatcaaaattaaaagaggctgcattgtgaatggtatagcccttcctaggagatacatactgcagtatttaaagcaagtgatataatcagtattgagtcatgcaaagagtatctgcttggagtagtaaaagttccaacaaaagagctgctgatcaagagatctgggatcacaggatggtatcctatcattttaccagaagacgggggcctacctcatggcctggagctcatgcagaagatcgtgggtggtctggagctttcgatttccttcacgcatcgtggagatagagaacgggtgttggaagctgctgagcatttgggctggagctttgagaacagcctgaaagattttgtcagaatggatgaaggggagccagccactgtcaccatctccaccccaaggctgtggctgcccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcaccaggggcccatcactgctttggtacttcagggaggagaggctagagatccaagtgtggcgagcttatggcaatgacagtgtggagagaccccatcagacagacagctggattggctcagcctatgtggacctggccagacttggggagaggtcagcgaggacgctaactgtcagtggtgtgtatcctctgtttggacgaaatgcttccaacctctcaggagctgccttgcgagttcatgtggttctttcctctctttcctcacaccttgagcccactcatgagctggactccatggactgcagcagccacagtgagtctgagcagctccccagaaggaatgatgaggtccagctctctccaccagaagtcatctcctgccaccagaagtctcctgcctccacccaggtcccctgcagcagcaccacagctgaagtccgcctgacgcaggagggccctgctgatttggatggaacgtttgcagtcagcatcctagtagaaagagcaatgcacttgagcttgaaagggagccccttgacagagcggaaagtatcgatacccagttgttgtgtatcctttgcaacagccgatgagtcatctcctgtatacacccaagtggttgaaaacacagattcccccatctggaattttcaacagcagtcaaggctatcaaaagagctgcttctggacccacaacaaaccctggtcttcaaagtttggcataaaggagatgaggagagggtgattggctttgcctcggtggacctctccccacttctctctggcttccagtttgtctgtggctggtacaacatcacagacttcagtggagagtgccaggggcagataaaagttgctgtctcccctttggagagtttgatacacttcaaagaagaaaggcaagcaaggcgtggagtggagacctcaaaatcactgatcccaatatacagtcccttttccttccctgcctctgatacgtatgctgcattctccagccacatggcaaggcagaccctagaccaacttgctcatgcctcctcaaaggagcttgatttctcctctcctgggagaagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcaggaagaatctgagtgagcttgatcagattcagaggtacttccgccagaagctcaccaagcctttcctacccctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacagatctgcagactatcaccagggattcgcaagcagctttgagttctcaccgagccaggagtagaagcaacaaggccaccaccctcccagatgctcaggacacagaagcactgcaagaacgatgcacaatgccagatgagccattggtaagagctccagataaaggcacagattccccatcaccccctcctctcgaagagacttcaaatggaggaagaatgctccatgagtccctgaggcatgcagtacccattacaaggatgcagagcagtgaagacactgaggcaggcccagcctacagtgatgaggactatgaagaagacatcattgagcccaggaccttaaatgagatcaccacggtgacagacaaaactagcccttggtctagtgtcatatcagacacaagtgaggtcatcagccctcagcctgacgaggtgcagagggaaggcccctcttgtccttctccagggcctttctgcagagaggagcttatggtcaaaagtagctttctctccagcccagaaagggctgtcaacccccacctgcctaggcagggttctcctagccaaagtcttgttgcttgtgagtgtgaggcctctaaggccagggttggtggcgagtctgcctcagccaaccctcagcccatcccatgcccaacactctcaggagctcaacagagcagcacgtttgttggatggagctcaccacagacagatcagaacaaggagcccaagtcagaggccccagctgagaatgaagctgccaccagtgagctcggtgactctgctgatagcttcaagaagttgccgctaaatctagcctcccagagcagaagggaaaaccataagggaccacccatcgactcctctgacatcaggcagaggcaggtgacaactggatcagagacgtccacaaagcagagcctcctgctcccagggcccattgtggtgcccaacttctttttgcctccccagcagttggaggcttccctgcggatgctttcactctcagcaactttgccaccagcagccacaacagatcaggacaagagcgaagccaccaggggagctctctcccaaaggccttgtcgccccagacctaactcgctccccctcaacctgcctgaggaagaaactctcaggattgcacggatattttcttctcagtactcccagaaagactgacgcagcctgaggggctggggggaaggagacacctgcccaccctccgtcagctttgtccagcttgcaggaggcaccaggtctggctccttcagggctgtcacagtcctgaaaccaccacttgcctaggccacggatgcctcaagagacccggtcagcccagactggaggagtgccccaaaccagtccagtgtccacttgccagaatttcagctccttttttctgtggtgaggcaaaggctagaaataaaatggaatccgcgcccaagtgggacccaagcaggcatctttcggtggagaaacgccccccagtgtccttgacacagctgactgctggcatgagcccaccctctgcctgaagatgcaggaccatttttgccttaaaagttggggaggagggacatgtagattgtgtgcattgtgcatagtcaaggaaatcctagggccacctccagttcatttgtgtgggaacaaggatattttatagatacaaattatttttatgctgtgttgaattaatcaattaggagaggaaggggaaatcacttccttcaaactttttatctgattgtctaaaattctaaccatgcttttaacttattatttttacccagctctgaaggtcattgttcttgcctgtgtttgaataaaatcatattggtgtttgtaatctgtgcacaagtgtttc

SEQ ID NO: 460198 - DNA, 1814 bp, Homo sapiens
ctgtggcctgttctttctgccctgagttctcccatcacgttgagttcacatgtaacttggtgactcagcactgtagtggagaggcctgtttcctagcagagttgttggagtttgcagaagttatttttgctgtctatcatgaaaataccaagtcagcaagtgatataatcagtattgagtcatgcaaagagtatctgcttggagtagtaaaagttccaacaaaagagctgctgatcaagagatctgggatcacaggatggtatcctatcattttaccagaagacgggggcctacctcatggcctggagctcatgcagaagatcgtgggtggtctggagctttcgatttccttcacgcatcgtggagatagagaacgggtgttggaagctgctgagcatttgggctggagctttgagaacagcctgaaagattttgtcagaatggatgaaggggagccagccactgtcaccatctccaccccaaggctgtggctgcccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcaccaggggcccatcactgctttggtacttcagggaggagaggctagagatccaagtgtggcgagcttatggcaatgacagtgtggagagaccccatcagacagacagctggattggctcagcctatgtggacctggccagacttggggagaggtcagcgaggacgctaactgtcagtggtgtgtatcctctgtttggacgaaatgcttccaacctctcaggagctgccttgcgagttcatgtggttctttcctctctttcctcacaccttgagcccactcatgagctggactccatggactgcagcagccacagtgagtctgagcagctccccagaaggaatgatgaggtccagctctctccaccagaagtcatctcctgccaccagaagtctcctgcctccacccaggtcccctgcagcagcaccacagctgaagtccgcctgacgcaggagggccctgctgatttggatggaacgtttgcagtcagcatcctagtagaaagagcaatgcacttgagcttgaaagggagccccttgacagagcggaaagtatcgatacccagttgttgtgtatcctttgcaacagccgatgagtcatctcctgtatacacccaagtggttgaaaacacagattcccccatctggaattttcaacagcagtcaaggctatcaaaagagctgcttctggacccacaacaaaccctggtcttcaaagtttggcataaaggagatgaggagagggtgattggctttgcctcggtggacctctccccacttctctctggcttccagtttgtctgtggctggtacaacatcacagacttcagtggagagtgccaggggcagataaaagttgctgtctcccctttggagagtttgatacacttcaaagaagaaaggcaagcaaggcgtggagtggagacctcaaaatcactgcagccgcccctgccctgtgccgtgctgcgctcacctgcctccccagccagccgctgacctctcgcccttcacttgggcagagggagccaattggaggcgctgcttgtcttctttggttctgggaggggtgagggatgggggtcctgtacacaaccacccactagttctcttctccagccaagaggaataaagttttgcttccattca

SEQ ID NO: 460199 - DNA, 815 bp, Homo sapiens
tctccctccaccctcctccatcaagggggagagtggaacatttatgcttatcccttccttaacctttgtgatacaggaatattttggatggatagcttctttaaaatatgaagacttcgaagttatttatccaaaccaacctgatcatttcttaagagtgaatataccttggaagacgtgtcctgcctttagtagcgtcacaatggattacatcctctataaagcagtctgggaggctaacatctgccacaagacaaatatggtgcctgcccccatggagctcatattcgaatggagaaaatgtcaacaagtatcccacggagtgaacacttcaaaaggagaagcacaggtgagaaaatcgaatttggacaccgttgaggagactattgcagtcatccaagctcaagatggtggagcttcatccttgagaataaccaatggggatagatttaagagacacttagagtctgcagccaacagggctgaatgagcagagagttatgattcagaagatcatctaaaattgaacagctgccactactggcaataagtctactgccatttggtagataaccttcttatcacacagaaaaatatcagtacagacaaatagaccgcaaagaaaatgagaccatcagcaaagaagataaagaagtttgtacaaagcaactttttataaatggatggctgtcaggcaaaaataaatttcctgtggacaagaccaagagcaaggcaagaggaaaataaacatgtttaaactattggagagtccataatttaaatataaactcttctgttgagtggtagtgtgcacc

SEQ ID NO: 460200 - DNA, 5940 bp, Homo sapiens
agcggccccgccgcagggcaggcctggccgggcctccccgggctgcggcggcgccccctgcaggccgcggcgggcagagcggggggaaggaacccgagccgggctgccaccgtgtcccaaccggtgccgccgccggagcttctccgggccccgagtcctcgccgaacgccctcctcgccgcccgccgcgtcccggcgccctccggagccgccgagccgcccgcgcacacctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggatgttctccaagttcacctccatcctgcagcacgccgtggaggcgcttgcaccttctcttcctttacaagaagattttgtttatcactggaaggcaattacccattactacatagagacttcagatgataaagccccagtgaccgatacaaatattccatcgcatctggaacagatgttagatatactggttcaagaagaaaatgaacgggaatctggagagacagggccatgtatggaatatttgcttcatcacaagatcttggaaacattatataccttggggaaagctgattgtcctccgggaatgaaacagcaggttttggttttctatacgaaacttctgggaagaatccggcagccactacttccacacattaacgtgcacaggccagtgcagaataagatgaaatcattggcttccaaaggagtaccaaatgtaatttcagaagatacattaaaaggtcaggattccttgtcaacagatacaggacagtcccgtcaaccagaggaactatctggtgctactggaatggagcaaacagaattggaagatgagcctcctcatcagatggatcacctgtccacaagcttggataacctcagtgtcacctcactgccagaggcctcggttgtttgtccaaatcaggattacaatttagtgaattctttgttaaatcttactagaagtcctgatggcagaatagctgtgaaggcatgtgaaggcttgatgctgttagtaagtttgccagagcctgcggctgcaaagtgccttacacagagcacttgcttgtgtgaactactgacagacagacttgcctccctgtacaaggccctacctcagtcagtggatccgttagatattgaaaccgtggaagcaattaactggggcttggactcatatagtcataaagaagatgcttcagcatttccaggaaaacgagccttaatttcatttctttcctggtttgattattgtgatcagctcattaaggaagcccaaaagactgctgctgttgctcttgccaaagctgttcatgaaagatttttcattggtgttatggaacctcaattaatgcaaacttctgagatgggtattctcacatccactgctctgcttcatcgcatcgttcggcaagtgacctctgatgttttgcttcaagaaatggtgttttttatccttggagaacagagggaaccagaaactctggcagaaatcagcagacatcctttaaggcataggttaattgaacattgtgatcacatatctgatgagataagcataatgacattacgaatgtttgaacatcttttacaaaaacccaatgagcacattctttacaacttggtcttgagaaatcttgaagaaagaaattatacagaatataaacctttgtgcccagaagataaagatgtggtagaaaatggattgatagcaggagcagtagatctggaagaagatccattatttactgacatttcaccagaaaacactttgccaaaccaagagtggcttagttcttcacctcctgctactccagaccaccccaaaaatgatggaaaaactgaagttcataaaattgtaaatagttttctctgtctggtaccggatgacgcaaaatcctcctaccatgttgagggcacaggatatgacacttacctccgagacgctcataggcagttccgagactactgtgctatctgcttaagatgggagtggcctgggtctccaaaagcattggaaaagtgcaatttagaagctgctttctttgaaggtcattttttgaaagtgctgttcgacagaatgggaagaattcttgatcagccatatgatgtaaacttacaagtaacctcagtgttatctagactttctctcttccctcatccacacatccacgagtaccttttggatccttacgtgaacctcgctcctggctgtagatctctcttctctgtaattgtcagggttgttggagaccttatgcttcgaatccagcgtattcaagactttactcccaagcttctgttagtcagaaagcggttacttggtttggaacctgaaggccctattattgaccacatcacactgctagagggtgtgattgtgttagaagagttctgtaaggagctggcggcaatcgcatttgtaaaatatcatgcttcctccacaccataaataacatctttcatgtaactgggggaacagaactactgtgtacatttcaccaaaaaagactcagttccacccagccacaagaggataaaaagcctttttaaacgcagtattgctgtaaactggacagaaccattaagaacctattgagtggacattcttggtgaaatgttgtataatgttgttttcattggctttatcataatggttctatatatacaattgcacattgttgaatccaggatacaatcaaaggaacttcaggaaataagcatttctaatgactgtgaaaagctgcaatatttccaatgtcatgactttgatgatatttctgttatattaatgtccttttaggtagcaaggcattttgacattctctgggactcaaatgcttgtattcttttggattaataagtagcaaaaaaaaatcactaattttataactttttaaggtcagaattcttatcaaacaaaatatgaaaactgtaaatgagaaaaaaatacaattcagaaaccattgaatgaattaattataggcgataaaaatgtgtagagcaccattaactttcttcagcttttttaagaataacaatttaatatgataaattcttgattaatataatatatctatatttttaaagaaatgttcttttactcttttgtgcacatagccatgttagtgattttcttcatgtgtgggtcccagtttatttaaactgtgtcgttttcgcagcagtgttcaatttgctcaccattggtagtgtttgctaaaattgtatttttttaagctaagtaacatgtactgggttgagaacctttttcccccctctccctctcagaaaattgctttataaaattgctttataatttgattttcttactgaaacgcatggtggtgtctaggtggggaactgactgataacccttggcagcaatcaaagtgccagtggctcctcgatgtttacatttttttctattttgttcagtcttttgttttaaatgattctaaagagattaaagaaaacagagttttaaatgtcctatttacatgttaaaggatttggggaaattgggtatgtatgtgaatgggtgtacatgtaggaacctgtagttcagcaaagctgcgctgggcacagcatgcttgtacttgattgacaaaatcgtgtttgccagtccactttctatttttcctttaagtgatgctgatcactcaaataatgcttttaagctattgtttgtttttatttgacatgttaagccgcagcactttcttcttcatctttccatttactgatatttgggggaacaggctatcaaaggttccggcttgaagggaactgtcactaccccctctaggaagttattttatgtagcatgtttgcatatacgcattgtgtggcatgtgcatagaggcttgttttacacctatctgctcattttgttgtgttagcttttctggtttatttcatagtttgttcttgctatttattaagaacagaatatcaaaagattatgaatagcctcagctctagaatgcttaccactgttaaaacaacaaaaagactaaacctctaatttcatgcaaatctttgttagcttattctaagaaatttattaagtaaaacaaagaaaaaacagaagtgggagatagttattttgtgcgtaattttctttaaatcattttgaatgatgtgaaggcattcagtttgctgtatttttttaatcacttcatacaaggaaaacttcgacatttacatttctagatgtagtaacagtctactttgatatatgagtatttaaactaaggcattaagagatattagatatttcttaatgttttcatagtgctcaataggtgtagtagcaatgatattacctctgaaaccaaatactcttttatccttgattccactatgggaccttataactagtccatgaaaccaagctcagaaaagctttaactcttatatttgtgtatatgtatgctgcttctgaaaatataatttttctaagttgttgtaatgactttaatttgtaatcagctaaggcttaagatttcatttgtttctaagtttctgtttttcatcccttcttttttcttttatatttagttcagacctagagccagtagaagctctcacagtgagttcaatttgttagtgaaacattgtactgcatcaccagtttttcttaccttctgttgacagctgaatatttctgttactcagtacttgcaaaaacagtaactaaaatgcactatgctgagtggaaagcaccgtcataacaattgattgccatagcaagttccaaagtgaatttcagccttgcttcacatttgtatcaataaatatgcacattttttaaaactttctaacaatatagtctttggatttgtttttagttatgagccgcattctttacttgatagaactcagatttgtcttagcctattgccatatagtactcaccttataactatgtaactttctcgtaatgtatctgtttgtgcaatatggaagctgtgagtggattcatagctttttggtttaattgtacattattgtgtgtgtatatatgtatatatgtatatatataaggaccaaaattcttagctcgcttacactgttgctagtgtaaacattgttacacttaattttacagggcacaaattatggaattacttcataaattcatggtaatgttttcataaattattgcattaacatacaattgccatttaattatgaagtccatcagtattgacagaagacgttacagtgaagtgctaaaaccacactatatggtaattatattttgggttatgtagtaaatcaaatatgcatgtcattgtgacactttatgtgttaaaacatggtagataatcacattttctgggccctgtaaaatagtgttactgtaatactctgttttgcctcctgccttgtttacattaaacaggatatttggtaaatttttttgtattgaaagttgtgtaggttactgacagtgttaccagcgtctggaattcttggtccctccgtggagaaactcttcagatggtcattgtgtacctactctctcttcaaaggaagttgtgatcaagttcaactttttgtgctaacaatgcatgcaggactaagagggatgatctaaaaaataaataatgtaatttaaacaaaacgtcttatgtttttgggttcctaagttaattcgatgtgtattgaatttcatggccatcatgcttggcatatggaagagagcttgtttgcgagcagagagaagaaaaacaacctaatgatagaatttgagatctcagatccaaccatgacgtgaagccttaggtcttttaattgcttgagccctggggtggtgct

SEQ ID NO: 460201 - DNA, 387 bp, Homo sapiens
tttggagtccatgattgtggatgttgggcagacgttgccttcatggtggtaagagggattccagagtctcttatgtcctcaaagcttcaagctcagccaaaagaatctcgatggtttccacaaaaaatcttgggccttggatcaactgcccacccttgaaccaatcctggtggccccaggctgattggcagacctgaatcacctatcccatgcccagaactttggcttgaccaggctcatccaaaacaagggaatccagagtgtttccccaaagaaaatcagggggctattactgggaaaaagaattccaccacaagtataaaaaatactgttatcaataaaacatcacctgatactttggttcattaaagatgtattactttggtt

SEQ ID NO: 460202 - DNA, 5760 bp, Homo sapiens
agcggccccgccgcagggcaggcctggccgggcctccccgggctgcggcggcgccccctgcaggccgcggcgggcagagcggggggaaggaacccgagccgggctgccaccgtgtcccaaccggtgccgccgccggagcttctccgggccccgagtcctcgccgaacgccctcctcgccgcccgccgcgtcccggcgccctccggagccgccgagccgcccgcgcacacctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggatgttctccaagttcacctccatcctgcagcacgccgtggaggcgcttgcaccttctcttcctttacaagaagattttgtttatcactggaaggcaattacccattactacatagagacttcagatgataaagccccagtgaccgatacaaatattccatcgcatctggaacagatgttagatatactggttcaagaagaaaatgaacgggaatctggagagacagggccatgtatggaatatttgcttcatcacaagatcttggaaacattatataccttggggaaagctgattgtcctccgggaatgaaacagcaggttttggttttctatacgaaacttctgggaagaatccggcagccactacttccacacattaacgtgcacaggccagtgcagaataagatgaaatcattggcttccaaaggagtaccaaatgtaatttcagaagatacattaaaaggtcaggattccttgtcaacagatacaggacagtcccgtcaaccagaggaactatctggtgctactggaatggagcaaacagaattggaagatgagcctcctcatcagatggatcacctgtccacaagcttggataacctcagtgtcacctcactgccagaggcctcggttgtttgtccaaatcaggattacaatttagtgaattctttgttaaatcttactagaagtcctgatggcagaatagctgtgaaggcatgtgaaggcttgatgctgttagtaagtttgccagagcctgcggctgcaaagtgccttacacagagcacttgcttgtgtgaactactgacagacagacttgcctccctgtacaaggccctacctcagtcagtggatccgttagatattgaaaccgtggaagcaattaactggggcttggactcatatagtcataaagaagatgcttcagcatttccaggaaaacgagccttaatttcatttctttcctggtttgattattgtgatcagctcattaaggaagcccaaaagactgctgctgttgctcttgccaaagctgttcatgaaagatttttcattggtgttatggaacctcaattaatgcaaacttctgagatgggtattctcacatccactgctctgcttcatcgcatcgttcggcaagtgacctctgatgttttgcttcaagaaatggtgttttttatccttggagaacagagggaaccagaaactctggcagaaatcagcagacatcctttaaggcataggttaattgaacattgtgatcacatatctgatgagataagcataatgacattacgaatgtttgaacatcttttacaaaaacccaatgagcacattctttacaacttggtcttgagaaatcttgaagaaagaaattatacagaatataaacctttgtgcccagaagataaagatgtggtagaaaatggattgatagcaggagcagtagatctggaagaagatccattatttactgacatttcaccagaaaacactttgccaaaccaagagtggcttagttcttcacctcctgctactccagaccaccccaaaaatgatggaaaaactgaagttcataaaattgtaaatagttttctctgtctggtaccggatgacgcaaaatcctcctaccatgttgagggcacaggatatgacacttacctccgagacgctcataggcagttccgagactactgtgctatctgcttaagatgggagtggcctgggtctccaaaagcattggaaaagtgcaatttagaagctgctttctttgaaggtcattttttgaaagtgctgttcgacagaatgggaagaattcttgatcagccatatgatgtaaacttacaagtaacctcagtgttatctagactttctctcttccctcatccacacatccacgagtaccttttggatccttacgtgaacctcgctcctggctgtagatctctcttctctgtaattgtcagggttgttggagaccttatgcttcgaatccagcgtattcaagactttactcccaagcttctgttagtcagaaagcggttacttggtttggaacctgaaggccctattattgaccacatcacactgctagagggtgtgattgtgttagaagagttctgtaaggagctggcggcaatcgcatttgtaaaatatcatgcttcctccacaccataaataacatctttcatgtaactgggggaacagaactactgtgtacatttcaccaaaaaagactcagttccacccagccacaagaggataaaaagcctttttaaacgcagtattgctgtaaactggacagaaccattaagaacctattgagtggacattcttggtgaaatgttgtataatgttgttttcattggctttatcataatggttctatatatacaattgcacattgttgaatccaggatacaatcaaaggaacttcaggaaataagcatttctaatgactgtgaaaagctgcaatatttccaatgtcatgactttgatgatatttctgttatattaatgtccttttaggtagcaaggcattttgacattctctgggactcaaatgcttgtattcttttggattaataagtagcaaaaaaaaatcactaattttataactttttaaggtcagaattcttatcaaacaaaatatgaaaactgtaaatgagaaaaaaatacaattcagaaaccattgaatgaattaattataggcgataaaaatgtgtagagcaccattaactttcttcagcttttttaagaataacaatttaatatgataaattcttgattaatataatatatctatatttttaaagaaatgttcttttactcttttgtgcacatagccatgttagtgattttcttcatgtgtgggtcccagtttatttaaactgtgtcgttttcgcagcagtgttcaatttgctcaccattggtagtgtttgctaaaattgtatttttttaagctaagtaacatgtactgggttgagaacctttttcccccctctccctctcagaaaattgctttataaaattgctttataatttgattttcttactgaaacgcatggtggtgtctaggtggggaactgactgataacccttggcagcaatcaaagtgccagtggctcctcgatgtttacatttttttctattttgttcagtcttttgttttaaatgattctaaagagattaaagaaaacagagttttaaatgtcctatttacatgttaaaggatttggggaaattgggtatgtatgtgaatgggtgtacatgtaggaacctgtagttcagcaaagctgcgctgggcacagcatgcttgtacttgattgacaaaatcgtgtttgccagtccactttctatttttcctttaagtgatgctgatcactcaaataatgcttttaagctattgtttgtttttatttgacatgttaagccgcagcactttcttcttcatctttccatttactgatatttgggggaacaggctatcaaaggttccggcttgaagggaactgtcactaccccctctaggaagttattttatgtagcatgtttgcatatacgcattgtgtggcatgtgcatagaggcttgttttacacctatctgctcattttgttgtgttagcttttctggtttatttcatagtttgttcttgctatttattaagaacagaatatcaaaagattatgaatagcctcagctctagaatgcttaccactgttaaaacaacaaaaagactaaacctctaatttcatgcaaatctttgttagcttattctaagaaatttattaagtaaaacaaagaaaaaacagaagtgggagatagttattttgtgcgtaattttctttaaatcattttgaatgatgtgaaggcattcagtttgctgtatttttttaatcacttcatacaaggaaaacttcgacatttacatttctagatgtagtaacagtctactttgatatatgagtatttaaactaaggcattaagagatattagatatttcttaatgttttcatagtgctcaataggtgtagtagcaatgatattacctctgaaaccaaatactcttttatccttgattccactatgggaccttataactagtccatgaaaccaagctcagaaaagctttaactcttatatttgtgtatatgtatgctgcttctgaaaatataatttttctaagttgttgtaatgactttaatttgtaatcagctaaggcttaagatttcatttgtttctaagtttctgtttttcatcccttcttttttcttttatatttagttcagacctagagccagtagaagctctcacagtgagttcaatttgttagtgaaacattgtactgcatcaccagtttttcttaccttctgttgacagctgaatatttctgttactcagtacttgcaaaaacagtaactaaaatgcactatgctgagtggaaagcaccgtcataacaattgattgccatagcaagttccaaagtgaatttcagccttgcttcacatttgtatcaataaatatgcacattttttaaaactttctaacaatatagtctttggatttgtttttagttatgagccgcattctttacttgatagaactcagatttgtcttagcctattgccatatagtactcaccttataactatgtaactttctcgtaatgtatctgtttgtgcaatatggaagctgtgagtggattcatagctttttggtttaattgtacattattgtgtgtgtatatatgtatatatgtatatatataaggaccaaaattcttagctcgcttacactgttgctagtgtaaacattgttacacttaattttacagggcacaaattatggaattacttcataaattcatggtaatgttttcataaattattgcattaacatacaattgccatttaattatgaagtccatcagtattgacagaagacgttacagtgaagtgctaaaaccacactatatggtaattatattttgggttatgtagtaaatcaaatatgcatgtcattgtgacactttatgtgttaaaacatggtagataatcacattttctgggccctgtaaaatagtgttactgtaatactctgttttgcctcctgccttgtttacattaaacaggatatttggtaaatttttttgtattgaaagttgtgtaggttactgacagtgttaccagcgtctggaattcttggtccctccgtggagaaactcttcagatggtcattgtgtacctactctctcttcaaaggaagttgtgatcaagttcaactttttgtgctaacaatgcatgcaggactaagagggatgatctaaaaaataaataatgtaatttaaacaaaacgtcttatgttttt

SEQ ID NO: 460203 - DNA, 3546 bp, Homo sapiens
agcggccccgccgcagggcaggcctggccgggcctccccgggctgcggcggcgccccctgcaggccgcggcgggcagagcggggggaaggaacccgagccgggctgccaccgtgtcccaaccggtgccgccgccggagcttctccgggccccgagtcctcgccgaacgccctcctcgccgcccgccgcgtcccggcgccctccggagccgccgagccgcccgcgcacacctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggatgttctccaagttcacctccatcctgcagcacgccgtggaggcgcttgcaccttctcttcctttacaagaagattttgtttatcactggaaggcaattacccattactacatagagacttcagatgataaagccccagtgaccgatacaaatattccatcgcatctggaacagatgttagatatactggttcaagaagaaaatgaacgggaatctggagagacagggccatgtatggaatatttgcttcatcacaagatcttggaaacattatataccttggggaaagctgattgtcctccgggaatgaaacagcaggttttggttttctatacgaaacttctgggaagaatccggcagccactacttccacacattaacgtgcacaggccagtgcagaataagatgaaatcattggcttccaaaggagtaccaaatgtaatttcagaagatacattaaaaggtcaggattccttgtcaacagatacaggacagtcccgtcaaccagaggaactatctggtgctactggaatggagcaaacagaattggaagatgagcctcctcatcagatggatcacctgtccacaagcttggataacctcagtgtcacctcactgccagaggcctcggttgtttgtccaaatcaggattacaatttagtgaattctttgttaaatcttactagaagtcctgatggcagaatagctgtgaaggcatgtgaaggcttgatgctgttagtaagtttgccagagcctgcggctgcaaagtgccttacacagagcacttgcttgtgtgaactactgacagacagacttgcctccctgtacaaggccctacctcagtcagtggatccgttagatattgaaaccgtggaagcaattaactggggcttggactcatatagtcataaagaagatgcttcagcatttccaggaaaacgagccttaatttcatttctttcctggtttgattattgtgatcagctcattaaggaagcccaaaagactgctgctgttgctcttgccaaagctgttcatgaaagatttttcattggtgttatggaacctcaattaatgcaaacttctgagatgggtattctcacatccactgctctgcttcatcgcatcgttcggcaagtgacctctgatgttttgcttcaagaaatggtgttttttatccttggagaacagagggaaccagaaactctggcagaaatcagcagacatcctttaaggcataggttaattgaacattgtgatcacatatctgatgagataagcataatgacattacgaatgtttgaacatcttttacaaaaacccaatgagcacattctttacaacttggtcttgagaaatcttgaagaaagaaattatacagaatataaacctttgtgcccagaagataaagatgtggtagaaaatggattgatagcaggagcagtagatctggaagaagatccattatttactgacatttcaccagaaaacactttgccaaaccaagagtggcttagttcttcacctcctgctactccagaccaccccaaaaatgatggaaaaactgaagttcataaaattgtaaatagttttctctgtctggtaccggatgacgcaaaatcctcctaccatgttgagggcacaggatatgacacttacctccgagacgctcataggcagttccgagactactgtgctatctgcttaagatgggagtggcctgggtctccaaaagcattggaaaagtgcaatttagaagctgctttctttgaaggtcattttttgaaagtgctgttcgacagaatgggaagaattcttgatcagccatatgatgtaaacttacaagtaacctcagtgttatctagactttctctcttccctcatccacacatccacgagtaccttttggatccttacgtgaacctcgctcctggctgtagatctctcttctctgtaattgtcagggttgttggagaccttatgcttcgaatccagcgtattcaagactttactcccaagcttctgttagtcagaaagcggttacttggtttggaacctgaaggccctatttcagacctagagccagtagaagctctcacagtgagttcaatttgttagtgaaacattgtactgcatcaccagtttttcttaccttctgttgacagctgaatatttctgttactcagtacttgcaaaaacagtaactaaaatgcactatgctgagtggaaagcaccgtcataacaattgattgccatagcaagttccaaagtgaatttcagccttgcttcacatttgtatcaataaatatgcacattttttaaaactttctaacaatatagtctttggatttgtttttagttatgagccgcattctttacttgatagaactcagatttgtcttagcctattgccatatagtactcaccttataactatgtaactttctcgtaatgtatctgtttgtgcaatatggaagctgtgagtggattcatagctttttggtttaattgtacattattgtgtgtgtatatatgtatatatgtatatatataaggaccaaaattcttagctcgcttacactgttgctagtgtaaacattgttacacttaattttacagggcacaaattatggaattacttcataaattcatggtaatgttttcataaattattgcattaacatacaattgccatttaattatgaagtccatcagtattgacagaagacgttacagtgaagtgctaaaaccacactatatggtaattatattttgggttatgtagtaaatcaaatatgcatgtcattgtgacactttatgtgttaaaacatggtagataatcacattttctgggccctgtaaaatagtgttactgtaatactctgttttgcctcctgccttgtttacattaaacaggatatttggtaaatttttttgtattgaaagttgtgtaggttactgacagtgttaccagcgtctggaattcttggtccctccgtggagaaactcttcagatggtcattgtgtacctactctctcttcaaaggaagttgtgatcaagttcaactttttgtgctaacaatgcatgcaggactaagagggatgatctaaaaaataaataatgtaatttaaacaaaacgtcttatgttttt

SEQ ID NO: 460204 - DNA, 924 bp, Homo sapiens
agcggccccgccgcagggcaggcctggccgggcctccccgggctgcggcggcgccccctgcaggccgcggcgggcagagcggggggaaggaacccgagccgggctgccaccgtgtcccaaccggtgccgccgccggagcttctccgggccccgagtcctcgccgaacgccctcctcgccgcccgccgcgtcccggcgccctccggagccgccgagccgcccgcgcacacctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggatgttctccaagttcacctccatcctgcagcacgccgtggaggcgcttgcaccttctcttcctttacaagaagattttgtttatcactggaaggcaattacccattactacatagagacttcagatgataaagccccagtgaccgatacaaatattccatcgcatctggaacagatgttagatatactggttcaagaagaaaatgaacgggaatctggagagacagggccatgtatggaatatttgcttcatcacaagatcttggaaacattatataccttggggaaagctgattgtcctccgggaatgaaacagcaggttttggttttctatacgaaacttctgggaagaatccggcagccactacttccacacattaacgtgcacaggccagtgcagaaattaattagactctgtggtgaagtcctagcaacaccaacagaaaatgaagagattcagtttctttgcattgtgtgtgcgaagctgaaacaggacccctacctggttaactttttcctagaggtatgata

SEQ ID NO: 460205 - DNA, 2823 bp, Homo sapiens
agcggccccgccgcagggcaggcctggccgggcctccccgggctgcggcggcgccccctgcaggccgcggcgggcagagcggggggaaggaacccgagccgggctgccaccgtgtcccaaccggtgccgccgccggagcttctccgggccccgagtcctcgccgaacgccctcctcgccgcccgccgcgtcccggcgccctccggagccgccgagccgcccgcgcacacctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggatgttctccaagttcacctccatcctgcagcacgccgtggaggcgcttgcaccttctcttcctttacaagaagattttgtttatcactggaaggcaattacccattactacatagagacttcagatgataaagccccagtgaccgatacaaatattccatcgcatctggaacagatgttagatatactggttcaagaagaaaatgaacgggaatctggagagacagggccatgtatggaatatttgcttcatcacaagatcttggaaacattatataccttggggaaagctgattgtcctccgggaatgaaacagcaggttttggttttctatacgaaacttctgggaagaatccggcagccactacttccacacattaacgtgcacaggccagtgcagaataagatgaaatcattggcttccaaaggagtaccaaatgtaatttcagaagatacattaaaaggtcaggattccttgtcaacagatacaggacagtcccgtcaaccagaggaactatctggtgctactggaatggagcaaacagaattggaagatgagcctcctcatcagatggatcacctgtccacaagcttggataacctcagtgtcacctcactgccagaggcctcggttgtttgtccaaatcaggattacaatttagtgaattctttgttaaatcttactagaagtcctgatggcagaatagctgtgaaggcatgtgaaggcttgatgctgttagtaagtttgccagagcctgcggctgcaaagtgccttacacagagcacttgcttgtgtgaactactgacagacagacttgcctccctgtacaaggccctacctcagtcagtggatccgttagatattgaaaccgtggaagcaattaactggggcttggactcatatagtcataaagaagatgcttcagcatttccaggaaaacgagccttaatttcatttctttcctggtttgattattgtgatcagctcattaaggaagcccaaaagactgctgctgttgctcttgccaaagctgttcatgaaagatttttcattggtgttatggaacctcaattaatgcaaacttctgagatgggtattctcacatccactgctctgcttcatcgcatcgttcggcaagtgacctctgatgttttgcttcaagaaatggtgttttttatccttggagaacagagggaaccagaaactctggcagaaatcagcagacatcctttaaggcataggttaattgaacattgtgatcacatatctgatgagataagcataatgacattacgaatgtttgaacatcttttacaaaaacccaatgagcacattctttacaacttggtcttgagaaatcttgaagaaagaaattatacagaatataaacctttgtgcccagaagataaagatgtggtagaaaatggattgatagcaggagcagtagatctggaagaagatccattatttactgacatttcaccagaaaacactttgccaaaccaagagtggcttagttcttcacctcctgctactccagaccaccccaaaaatgatggaaaaactgaagttcataaaattgtaaatagttttctctgtctggtaccggatgacgcaaaatcctcctaccatgttgagggcacaggatatgacacttacctccgagacgctcataggcagttccgagactactgtgctatctgcttaagatgggagtggcctgggtctccaaaagcattggaaaagtgcaatttagaagctgctttctttgaaggtcattttttgaaagtgctgttcgacagaatgggaagaattcttgatcagccatatgatgtaaacttacaagtaacctcagtgttatctagactttctctcttccctcatccacacatccacgagtaccttttggatccttacgtgaacctcgctcctggctgtagatctctcttctctgtaattgtcagggttgttggagaccttatgcttcgaatccagcgtattcaagactttactcccaagcttctgttagtcagaaagcggttacttggtttggaacctgaaggccctatgcagacgttgccttcatggtggtaagagggattccagagtctcttatgtcctcaaagcttcaagctcagccaaaagaatctcgatggtttccacaaaaaatcttgggccttggatcaactgcccacccttgaaccaatcctggtggccccaggctgattggcagacctgaatcacctatcccatgcccagaactttggcttgaccaggctcatccaaaacaagggaatccagagtgtttccccaaagaaaatcagggggctattactgggaaaaagaattccaccacaagtataaaaaatactgttatcaataaaacatcacctgatactttggttcattaaagatgtattactttggtt

SEQ ID NO: 460206 - DNA, 1496 bp, Homo sapiens
agttcgcgagcgctggctatgggtcctggggcgcggctggcggcgctgctggcggtgctggcgctcgggacaggagacccagaaagggctgcggctcggggcgacacgttctcggcgctgaccagcgtggcgcgcgccctggcgcccgagcgccggctgctggggctgctgaggcggtacctgcgcggggaggaggcgcggctgcgggacctgactagattctacgacaaggtactttctttgcatgaggattcaacaacccctgtggctaaccctctgcttgcatttactctcatcaaacgcctgcagtctgactggaggaatgtgctctgaaggatggctatgagaaggtggagcaagaccttccagcctttgaggaccttgagggagcagcaagggccctgatgcggctgcaggacgtgtacatgctcaatgtgaaaggcctggcccgaggtgtctttcagagagtcactggctctgccatcactgacctgtacagccccaaacggctcttttctctcacaggggatgactgcttccaagttggcaaggtggcctatgacatgggggattattaccatgccattccatggctggaggaggctgtcagtctcttccgaggatcttacggagagtggaagacagaggatgaggcaagtctagaagatgccttggatcacttggcctttgcttatttccggggcaggaaatgtttcgtgtgccctcagcctctctcgggagtttcttctctacagtacgtaatggataaaagataagccagccacagcatctccttctgagatgcattgagagtcatgcaaagaggccagcaggccacgggtagctctgccaatgcatggggcatcttgcagccaaagtgggtacaaacaggcccagataataagaggatggccaggaatgtcttgaaatatgaaaggctcttggcagagagccccaaccacgtggtagctgaggctgtcatccagaggcccaatataccccacctgcagaccagagacacctacgaggggctatgtcagaccctgggttcccagcccactctctaccagatccctagcctctactgttcctatgagaccaattccaacgcctacctgctgctccagcccatccggaaggaggtcatccacctggagccctacattgctctctaccatgacttcgtcagtgactcagaggctcagaaaattagagaacttgcagaaccatggggacgtggtacatgtggctgtatgcatttgtcaaaactcaccaaatggtccacttgagacctgtgtatatcattgtatttattctcagtgtagtacaataagatattttgagagagagaggtcattttcccataattttattacagtatattattattattatattttattgttaatctctgtgcctcatttatgaattataaattataacatataattataaattaaactttgtaattcagttacaatcattattataatttc

SEQ ID NO: 460207 - DNA, 1530 bp, Homo sapiens
agttcgcgagcgctggctatgggtcctggggcgcggctggcggcgctgctggcggtgctggcgctcgggacaggagacccagaaagggctgcggctcggggcgacacgttctcggcgctgaccagcgtggcgcgcgccctggcgcccgagcgccggctgctggggctgctgaggcggtacctgcgcggggaggaggcgcggctgcgggacctgactagattctacgacaaggtactttctttgcatgaggattcaacaacccctgtggctaaccctctgcttgcatttactctcatcaaacgcctgcagtctgactggaggaatgtggtacatagtctggaggccagtgagaacatccgagctctgaaggatggctatgagaaggtggagcaagaccttccagcctttgaggaccttgagggagcagcaagggccctgatgcggctgcaggacgtgtacatgctcaatgtgaaaggcctggcccgaggtgtctttcagagagtcactggctctgccatcactgacctgtacagccccaaacggctcttttctctcacaggggatgactgcttccaagttggcaaggtggcctatgacatgggggattattaccatgccattccatggctggaggaggctgtcagtctcttccgaggatcttacggagagtggaagacagaggatgaggcaagtctagaagatgccttggatcacttggcctttgcttatttccggggcaggaaatgtttcgtgtgccctcagcctctctcgggagtttcttctctacagtacgtaatggataaaagataagccagccacagcatctccttctgagatgcattgagagtcatgcaaagaggccagcaggccacgggtagctctgccaatgcatggggcatcttgcagccaaagtgggtacaaacaggcccagataataagaggatggccaggaatgtcttgaaatatgaaaggctcttggcagagagccccaaccacgtggtagctgaggctgtcatccagaggcccaatataccccacctgcagaccagagacacctacgaggggctatgtcagaccctgggttcccagcccactctctaccagatccctagcctctactgttcctatgagaccaattccaacgcctacctgctgctccagcccatccggaaggaggtcatccacctggagccctacattgctctctaccatgacttcgtcagtgactcagaggctcagaaaattagagaacttgcagaaccatggggacgtggtacatgtggctgtatgcatttgtcaaaactcaccaaatggtccacttgagacctgtgtatatcattgtatttattctcagtgtagtacaataagatattttgagagagagaggtcattttcccataattttattacagtatattattattattatattttattgttaatctctgtgcctcatttatgaattataaattataacatataattataaattaaactttgtaattcagttacaatcattattataatttc

SEQ ID NO: 460208 - DNA, 1388 bp, Homo sapiens
  misc_feature (755)..(755): n is a, c, g, or t
  misc_feature (757)..(758): n is a, c, g, or t
  misc_feature (761)..(764): n is a, c, g, or t
  misc_feature (766)..(766): n is a, c, g, or t
  misc_feature (774)..(774): n is a, c, g, or t
  misc_feature (779)..(779): n is a, c, g, or t
agttcgcgagcgctggctatgggtcctggggcgcggctggcggcgctgctggcggtgctggcgctcgggacaggagacccagaaagggctgcggctcggggcgacacgttctcggcgctgaccagcgtggcgcgcgccctggcgcccgagcgccggctgctggggctgctgaggcggtacctgcgcggggaggaggcgcggctgcgggacctgactagattctacgacaaggtactttctttgcatgaggattcaacaacccctgtggctaaccctctgcttgcatttactctcatcaaacgcctgcagtctgactggaggaatgtggtacatagtctggaggccagtgagaacatccgagctctgaaggatggctatgagaaggtggagcaagaccttccagcctttgaggaccttgagggagcagcaagggccctgatgcggctgcaggacgtgtacatgctcaatgtgaaaggcctggcccgaggtgtctttcagagagtcactggctctgccatcactgacctgtacagccccaaacggctcttttctctcacaggggatgactgcttccaagttggcaaggtggcctatgacatgggggattattaccatgccattccatggctggaggaggctgtcagtctcttccgaggatcttacggagagtggaagacagaggatgaggcaagtctagaagatgccttggatcacttggcctttgcttatttccgggggaaatgttacgtgtgacnannacnnnnanggagtttnttctntacagcccagataataagaggatggccaggaatgtcttgaaatatgaaaggctcttggcagagagccccaaccacgtggtagctgaggctgtcatccagaggcccaatataccccacctgcagaccagagacacctacgaggggctatgtcagaccctgggttcccagcccactctctaccagatccctagcctctactgttcctatgagaccaattccaacgcctacctgctgctccagcccatccggaaggaggtcatccacctggagccctacattgctctctaccatgacttcgtcagtgactcagaggctcagaaaattagagaacttgcagaaccatggggacgtggtacatgtggctgtatgcatttgtcaaaactcaccaaatggtccacttgagacctgtgtatatcattgtatttattctcagtgtagtacaataagatattttgagagagagaggtcattttcccataattttattacagtatattattattattatattttattgttaatctctgtgcctcatttatgaattataaattataacatataattataaattaaactttgtaattcagttacaatcattattataatttc

SEQ ID NO: 460209 - DNA, 1229 bp, Homo sapiens
aacagcagccaggctcaaccatctgacagaatctgctcatgctcttatgagcctaatcccttgggtcaaagaggcaccttgtcagagaactttggaagtacttagaatggaactgccaaggatacccatgggccatgtcacgcgacagcttgaaaccagcccaaatgccctcaaggagacattcccaaacctgcgagagaagagccttctgcatttccacggcaagcaagagaagggaaaaccacaacagcagtcccctcgtagagatgcaattcatcatgggcaggacggctggagcccacaataccccacaatggagcagggagcaccagccggaactcacccctgctgccattcctcctcctaccagcaagcctctagcgacatctctgaacatggtctctccctgctcacactcagctatgcagagcgggaaaaggtacaaccttcagaacgttctgcttagctactacgctctaacccggtggataaaggataaccagcatcccctgtcaggacacagggagctgtcctgcagagctggctctacatcagatctgatctgaatgcacttgttctaaaacgcttcatcaaaagattaactgcatgctcttccttcagcgtttcctgtccaaaacaagcactggggattctgaggaacctctgaggagcaccctgcctttacttgcagttcttccagagagatgttggagctgacaactggagacaatatggcttggtgacaacatcataaaagttctctgcctcctcccttatggagccttggctttccacagacgatggaatgtttgtctgatgctgggcaaagaagattaatgacaaggtacgcaccatgggaaagcacaatgagaaggcagccatctgtaaagaagagtgcccatactgggatctgatcctgctgactccctaatcgtggacttccggtctccagaactattgtttaagccacccagtctctaatattgtgttatgaaagctcaagtagacaaatgcaaagagcccagatatcatcctctagccttccttcccaaactcacctgtcttagattctattccattagttccagtgtaacaaactgattcatactgatctaataatcaggaacaaatttcatcatcccctcagagacatggtgggaaatgaggctttttatgcccagccaataaaacaacctagcagccacttacttgtccctccatttctttgc

SEQ ID NO: 460210 - DNA, 476 bp, Homo sapiens
gttaaatgaggtcgtaagggtggggtcctgaccccataggattaatgtctttataagaagagacaccagagatggttgtctctctccccaggtacgcaccatgggaaagcacaatgagaaggcagccatctgtaaagaagagtgcccatactgggatctgatcctgctgactccctaatcgtggacttccggtctccagaactattgtttaagccacccagtctctaatattgtgttatgaaagctcaagtagacaaatgcaaagagcccagatatcatcctctagccttccttcccaaactcacctgtcttagattctattccattagttccagtgtaacaaactgattcatactgatctaataatcaggaacaaatttcatcatcccctcagagacatggtgggaaatgaggctttttatgcccagccaataaaacaacctagcagccacttacttgtccctccatttctttgc

SEQ ID NO: 460211 - DNA, 2951 bp, Homo sapiens
  misc_feature (3)..(3): n is a, c, g, or t
  misc_feature (6)..(6): n is a, c, g, or t
  misc_feature (9)..(9): n is a, c, g, or t
acnggnaanaccgagaccaccaaggacctggcgaaagccttgggcttgctctgtgttgtcaccaactgtggcgaaggcatggattacagggccgtggggaagattttctctggcctggcacagtgcggggcttggggctgctttgatgagtttaatcgaatcgatgcttctgtgctctccgtgatctcctcccagatccagacgatccgaaatgctctgatccatcagttaaccacgttccagtttgaagggcaggagatttccctggactcccgcatgggcatcttcatcaccatgaaccccggctacgcaggccgcacggagctgcccgagtcggtgaaggcgctgttcaggcctgtggtcgtgatcgtgcccgacctgcagcagatctgtgagatcatgctcttctctgagggcttcctggaggccaaggtggggggccttggcagcgccaggtcgtgcagtgcagacttcacccgggtctgcttccagactggggacctaggacgcactctggcgaaaaagatgacggttctgtataagctggcccgggagcagctgtccaagcagtatcactatgattttggactcagagccctgaaatcggtgctggtcatggctgtgactgtactcaatgttgcacgcacacacgcacgcacacacacgcacacgcacggacacacgcacgcgcacacacacacggatacatgcacgcgcacacacgacgtggtgctgatgagggccttgcgagacatgaacttgcccaaatttgtgtttgaagatgttcctcttttccttggtttgatttcggatctgtttcctgggctggactgccctcgcgtccgctaccctgacttcaacgatgcggtagagcaggtcctggaggagaacggctacgcggtcctacccatccaggtggataaagtggttcaaatgttcgagaccatgttaacccgccacacgacgatggtggtggggcccaccagagggggcaagtccgtcgtcattaacactctgtgtcaggcccagaccaagcttgggctgacgacaaagttgtacatcctgaaccccaaagccgtgagtgtcatagaactctacggcatcctggacccaaccacccgagactggacagatggggtgttgtcaaacatcttcagggaaatcaacaagccaacagacaagaaggagcgaaagtgagtatctttgtagtgatgcaatgtggtaggtaccgggattgttcccagcttaccacagaggaaactgaggcctagaaaaggtcagaaatgtggcccaaggccagggatttggccctgatctgtgtgactctaagttctcaaacacagccgccatcaagctgcctgatcaccacgttctatggcaaggtatattttatttgatggtgatgtggatgctctatgggtggaaaacatgaattctgtgatggatgacaacaggttgttgacattggccaacggggaacgcatccggctccaagcacactgtgccctgctctttgaggcaagtagtgattaaaagtaaatttgaacataaatctttcttgtaattaaaaatgcaaatgtttgttaaagtagtagtaaatgtagatgattatttaaaaacaaacaatgcataagggtttataatgaatacaactctttgttctttactcctctcatccctctttatcccagaagtgactacttttactttttatgaattgtttcttctgatgattaccctagtgtctataagtaacaggcttagcatgatattcttcctttatacattttatagtttatacattatctgttgactgactgctacaaaagtgagaattcatctcttataccactaacgtcagaatagtatattgctaagttggttaacagtagataatgtttacattataatgaagatagaaataatttactgaagaaccaactaatatactacgattacatttactttcttttagagccatttcctttgtctagagtttgtaattgccttcctttttttccctcacactatttgcctttattttaatctcatttttttttttaaactttctatcatatcaagtattctgtcgagcccctttatttcctggaggctattctccaaagccctctatctcttaggatatggactgctcgtttcataggtgtggccctgggacttgctttcactctagcttagtattaatgccatttctaactgtaaaatttgtcagtgcatgaaatatttgtacatattattatctgattagctgactgaactatattttttttgtagagagagctaggtttgttaatatatctggtttagctttgtacttatgaagttttatactgcctgatctcaactatgttaaaaaaataataaagaaaaaagattgactggaaaacactccaaaacaacatttgtttctgggtggtgggatttggataacttattttcttctttatatttttctattttttgtcagatattctacaacgtattaattttcacattaattttataatagaaaaaccaaaaagatgttacatcagaagtgtgtaatcttctcatcaaaatcccaggtgttcagttaaaaagctcatggaagctgtgttgattttggtattatttggatttcatgcagttgtaaaaactttccataagagaaggtccttaaacatctagtttatcttgtgtatagctatagccatgattgattttctttatttatccaggttggagatttacagtatgcctcccctgcaactgtctctcgatgtggaatggtttatgtggatcctaaaaacttgaaatatcgaccatactggaaaaaatgggttaatcaaataccaaacaaggtgaaatttttttctaaaatgaacttaaatttattagtattgatggctagttggataacatagtccagagggatgtttgtagttgaaggc

SEQ ID NO: 460212 - DNA, 2947 bp, Homo sapiens
aactggaaaaccaagactggtagactctctttttcttcagacaataggcaggagccaggcagagtccagggattcttggaacacctatcttttcttcggaggacactaagttctatttgaagacaaagttcaatatggcaacaggactgatgggacacgaaggagtcgctaccgtgatttggtgacagttcttcaaaacgacagtgtctcaaggaaaggtggacctaggaactcctgaacttttgggttgccttaagtgagaaatcagcatggctcaggcaagtctcctggcttgtgaaggcctagcaggtgtgagtttggttcccactgcagccagcaagaagatgatgctgagccagattgccagcaagcaggccgagaatggcgagcgggcaggtagccctgatgtgctgaggtggtttactctcatttatgaattttgtctgagagctgcattgggtctcatctcatgttccgagatgggctatgagtttagatttgatttgtcttcaaagggtcaccgaaaagacagtgataagtcccggagccgcaaagatgatgacagcttgtctgaggcctctcattcaaaaaagactgttaaaaaggcagacagcatcagagaggttcctttctccaacagctggaagtggacccagagtagaacagtgtctccaggaagagggcagtggtggcctcatgacatgcctgattattgcccccaggtggtggtagtggaacaaaatggttcttttcaagtaaagattcccaaaaattttgtttgtgaacactgctttggagcctttcggagcagttaccacctaaagaggcacatccttattcacactggtgagaagccatttgaatgcgatatatgtgatatgcgtttcatccagaagtaccacctggaacgccacaagcgtgtgcacagtggtgaaaagccttaccagtgtgaacggtgtcatcagtgtttttctcggacagatcgattactcagacacaaacggatgtgccaagggtgccagtccaagacttccgacgggcagttttctctataggcgcaaggggccccgggtggtgggagtgatcagaagaacctgccgaagagcacaccccctctggtctgatggtcccaccaccgccccatgtgaacctgtcccactcctggaggagtggacccaggagaccagaagagtgcatcaggggacagtggccccagaacctcagctctgtaaataatctgagactatgagtatctcggggaagttcttacagcattcctgggtaggggagctagtccctggacccttggctgaggtcataggtggggactcaaggtacaggaccaagactgaagtgtggctcccacaaccttggactccagctggcagctgaaatggaaaagattggggaaggggatttgtttgttctgttcttgtttttgtttatccaaaagcaacttcagcgggtaaactgtggatacaggtaatccagaggcataagagtcctggtccaaagtagggactatagctggtccagctctccccaaaaattgggtttttagttgcagtagctcctcagtgtttcacaatcctgcacttcgcctcctttttgaggaagaataaggtcaggaatggcagctgagcttactttggcttccttatacactgtagggacaaaaggaaaaacggggtggagcagacaagggctggatccaaaaagtggatggcacctcttccttcctcaagggaaaaggaagagttgtgccagtgggtgttgtcatggcccatgtcacattggcacctgatggcatcagctcaaatgcctttaggaggaaacttgggtgagagtggcccatgaagcccttttcttctttttttggggagtcggtcttggagatggtatgtggctacctcgctgccattgactcctaaagtgagacagatgtgttgagcaaggagtcatggaagtcaaagtgggttctctctccttgtgccctcttaggaacaacccaagactggtcccaagttggctaacagctgctcaagaaacaaaggaatctggggtcttctgacatgcctgttgagcagtaggagctgttctccctccccaagtcctatcactgtattcaggtagaggaggtagggaggggtctgtcctttggtcccaaaaaacaagatctcggcttgcttcctgatggccatccctacccaacagagtgtgggggatgggggtgggggtgctgcagagaaaagactaaagaagaaacctaatgtaggttccattcttaaccatattctttgctcctctctgctccaataccaccaccttgtccactcccaaaaaagtaatcgggtgtgtgtgtgtgtgtgagagagagtgtgtgtgagatatgaatgcatgtatttgtatgcttgcaggagatggcatattattgagccaaacccttctctggccctcaccttcagggaggatgagtggaaaatagcctcctcttgcccaaacatgaagggtgcttgaggtctcagcaggagctgaagaacacaatttggggaacagaagggcttttgttttggagggtttttttttttaagatgaattcaacagcctggtggttaggatgtttctaacccaagccagggcttgtgaacatgaattttctaaggtgaaataaaccttttctttctgctaaagaaagaatccttatgggaagttttggggtttggttgacccccactgtaacctgacctgacctgtggcgggtacgggaactgtcttagtaatcatggagactggctgaacctgagtgccaagctgtcagtagggtctgagatgggaaactcctgaaagtatgatttcatttcccagaaaatgtaaagaatggataccagcaatgattcctggctgttacctattctggaggggtggggttggggagggggttgtccat

SEQ ID NO: 460213 - DNA, 1647 bp, Homo sapiens
atcctcacttcagtactaatggagcagctttaatctagaagatggccagcctcctgacagagggcaaagatgatgagacaaagcacatcctgtcttgtaaagctttcaagttcaagtgaaacacatcacttatgcacacatttcattggccaaaatatgtcacatggttacacctaagttcaacagggttggatggcatcattcttccatggaggaggggaagtagggtgacggggatggcatacattggtgaacagtgatacgctcttccactgaccctataagctgttgtagggatcactgaggatggtgcctggcatgtcattcttactaaatattattacactcaaataataacatacacctgtcccctcctccccagtcacttggcctccatcaccatccagtgtcctatctgaagaagatttttcttcctgtaacaagaaagatgagaagggtaaaaacacagtccttttgctgagtcagatgtgttcctacagctgcggcagtaaaatgggactcttcccagatcttccttttgttgttgtctagttttagtcttcttcttttcattgtttttaaaataatgaagtgcaatggtgcaatctcggttcacgcacattgtgatcacaaatcagaactgacaaacgggcttagaaatccttctacaaattttccaaaacagcccagcccagcgactgagcagcagcttcctaatctccagatattagagatgacggatggtagcagagggctggatttcatccatggcttctgcagggctgacagctatgcttggctctctgcttggtgtcagatgctggtgaaattcagggtagtggaggctcttagtggcctccctggattgcaaaagggactggttctcttttgggggtttgtccttagccctgaaaatggttccaggctccgctgggatgcctgagtttcctagacctcagggagtaagtgaactgtcagggctgtatgtttgaatttacaagtcttaagtctttgggaactaggtcaactagaccttgcatatgcttacaccctggatgaataaagtctttatttacacctccacctctctccaaaaaaagaatttgagacagcatacaacaaagagcatctttcaataataattaaaaagattagtgtgacagaaatggtaagttaggtccagtgaaaataggaggatcatacctgtcttattcactcatgaactcccagtgccttaagcagtgccaggcagttagaacatgcctcaaaattatgtgttggatgaacaaataaataaatatacaatgaatatttggcagtcacccaatgccaagaagccagccctggtcagaaccctcatgtacagttgtagatgttgtacactgcacagctgcaggtgctgtcagttatgtggttttccccctccccaaaatgtacactgcacaccctccccagctaaatgcagcaaccctggacataacgtctctcagaggaaggaactaggaagccctaactctcaagaagtcttagcattgaaagtcctatgtcctgtgaactcctcaatgcccagcaaactgaaggttggtcaccttagggctatgattttatgagcgctgtcatccatgctgttaaggatagcagctcacc

SEQ ID NO: 460214 - DNA, 668 bp, Homo sapiens
catctcacaacagctttctgggtttcctctgggacatcacccttctgtccttcaatatgtgtagattgattgaggatgactttatctttggctccaaagaaagtcttatgacccaaaacaggataatcagagcacttaatttccttgtccacacctactggttcagaggaggaattttcagtgctattgccttactgaaccctactgaacttactattaagaaaaaatttggccttggtaatggacagatgaaaatcaggggtcaaaaactcaaagcccacaggagccagacagagaaacaccagatagttccacctaatataatgaaatcagcaggactcaaggctcttcacagtctcctcatttgctctgctaacaaaggttttgctgttgttcaggaagcactcatattcccccagaatgtgttgagttctttgctgggcacgagggatgcgaagagaaaaagcctgtgaagacacagaagacagtcatctgcaaaccaaagaaagaggcctcaggagaaaccaaacctgccaacaccttgatcttggactttcagcatccaggactctgagaaaataaatttctgttgtttaagtcacccatctgtggtattttgttacagcagcctgtattagttcattctcacactgctataaaggactgcc

SEQ ID NO: 460215 - DNA, 1009 bp, Homo sapiens
tttataaaatattaaaaaaaccactgagagaaggatcttctgttttattgactgtctgtatctttggtcccatgtgttgactgctttctgcaatgattcaaaactttttattttgggaattctaccctagcctggtccttgtcccactgtgtcatgtccctgttgattgcagtagtgggaagtctgtgctctggggctaaattagatctaagcccactctgtcaacctgagatctggaaagctgaccactcgagacaactagagatcccttctcctctcttctttaatgtttttgctgttgaagtttcagcacctgagaagggttttagcacagagaggattaagaactggataatcctggatttgaaagtagaatggtcctcaggcaaatcctgtggaggagaaagggcaaagtcatcccagtgtctcgtttttgagggaacttgtggctgccatgtggacagtaccaggggatatgtctcagcagccggccgggaactcttggctgcagacagttgcacagctcgttatcttgatgccaaaacaagaaccaaggacccttttccactaggagaactctcggcaagcaggacttgagacgagcggagtccagctcccctggaggtccagtaacaatatgaaaaattgcagatgcagccacccactcataagtagctggaagaagccgcagggttcgaataatcttttcggaaaactgtggatgcaccacgtagcctctggaaactccaccgtacactcgtgagagaatgagagccagaaagacaattcctttagtattaatataaaaatagatttgtaaaatattacctattttttaatattatcattatattatatatttttgtatgttatcaagggttgaatctgtcccatgagatgtgtgtgacccgtatccttagcgggctttcttgagggcttctctgccttagaggagggaattgagggtgcccagaggcagaggccctgtatggagccagctcatgaaatc

SEQ ID NO: 460216 - DNA, 993 bp, Homo sapiens
gcagtgggaacttctaggagagaatggaaattcagcgacagcagagggactgtaccgttgctttagactgcaaagcattcacaaaatcaaggagaaataacatacaatatgcagttttcactctgggtgctctgcactggaaaatgcaacagattctctttcttatttttgagaaggacaagagagctgcttgtctagaatcactgttccctttgtcaataaataaaaggcccttgtatttgcaaggatttcacatgatgttaccaaaaaaaaagaaagaaaaggcgtgtaaagttttccatagcaagtgtgctcaccaaatttggctgtaccgcttaattacagaggacccagagggaaaacccagagttctggagaatgtggtttcaggatgtgcagctgctggcagaagggtgaaagctaaagcaaccgcagacggagtttcactcttgttgcccaggctggtgtgcaatggcgtgctctcaactcactgcaacctccacttctccggttcaagtgattctcctgcctcaacctgctgaatagctggtattacagcgacacgccaccgcgcccagctaatttttgttatttttagtagagatggggtttcaccatattggcctggctggtcttcgaactcctggcctcctgtgatccgcccacctcagcctcccaaagtattgggattacaggtgtgagccactgctcccagtcttttttttttgtttaatgaactagaatggaagggaaaagaaaagagcattgcaagatggagtgaggaaacccagcaaggcctgtctgtctagattcttcttggcctctctgagcagcatttcttccttctgcgtatgggacaggaccctttctggaatgggggtcttatgacctacaatcaaacaagtatctaacatccaattaaaagagaagtcatggctcaatcctcaagaaagaaacatgattatatggagtctttgccttatgtggacacag

SEQ ID NO: 460217 - DNA, 985 bp, Homo sapiens
gcagtgggaacttctaggagagaatggaaattcagcgacagcagagggactgtaccgttgctttagactgcaaagcattcacaaaatcaaggagaaataacatacaatatgcagttttcactctgggtgctctgcactggaaaatgcaacagattctctttcttatttttgagaaggacaagagagctgcttgtctagaatcactgttccctttgtcaataaataaaaggcccttgtatttgcaaggatttcacatgatgttaccaaaaaaaaagaaagaaaaggcgtgtaaagttttccatagcaagtgtgctcaccaaatttggctgtaccgcttaattacagaggacccagagggaaaacccagagttctggagaatgtggtttcaggatgtgcagctgctggcagaagggtgaaagctaaagcaaccgcagacggagtttcactcttgttgcccaggctggtgtgcaatggcgtgctctcaactcactgcaacctccacttctccggttcaagtgattctcctgcctcaacctgctgaatagctggtattacagcgacacgccaccgcgcccagctaatttttgttatttttagtagagatggggtttcaccatattggcctggctggtcttcgaactcctggcctcctgtgatccgcccacctcagcctcccaaagtattgggattacaggtgtgagccactgctcccagtcttttttttttgtttaatgaactagaatggaagggaaaagaaaagagcattgcaagatggagtgaggaaacccagcaaggcctgtctgtctagattcttcttggcctctctgagcagcatttcttccttctgcgtatgggacaggaccctttctggaatgggggtcttatgacctacaatcaaacaaggtaggtccgatcatttccttatgaccagtttttatacagaatgtaaaccaaaagtatatgagacaggtcccgatcaatgta

SEQ ID NO: 460218 - DNA, 5057 bp, Homo sapiens
agtgctaggaaaaaaatccttgaaggctccgacaagtcctgcagaaaagagacttgttgaattttattcagtcatagagcagattttcttgggccacagggactttgttctgaagacgtagtatgaaaggctggaatacatgtctcctgcatctgtgatttagcctagcaacattgataaagcacatactgtgtgcctgacactgggttgggcgctgaggagtccttgaggggtttagctggagaaggacaggtcccgtgctcagactcagggctgtgagcctgccaggtatggagcacaaaataaggcactgagagacgtttggattgaatagtaaatgtctcgtgttcgctcacctctctgcagaacatgacctgcgaagtggagccggagccccgctatgatgctcccctctgccgctgcaaccaccattgccgcccccacgaccacgcccggccacccagcccaccgccggagcctgagaccacagatgcctcacacccatctgtcctccggagccccttgccgaggaccaccccccgcatactccaggcctctgtggcagcctggccaagtcgcagagcacagagacggtgccagccacaccatcgggggacgccccgctatcagggggcagcagtggcctgtccctgagctctccgcaagtgcccggcagccccttctcctacccagccccgtcccctagcttgagcagtgggggcctccctcggacacctggccgggacttcagcttcacacccaccttctccgacgccagcgggcccttgctcctgcccgtctgcccactccccactggccgacgcgatgaacgctccgggccctggcctccccggtgctcctggagacgggcctgcccctccctctgccccttcccctgcccttgcccttggcattgcccgccgtcttgcgggcccaggctcgtgcgcccaccccgctgccacccctgctgcccgcccccctggcctcttgccctcccccaatgaagaggaagccgggccggccccggcgatccccaccatctatgctctccttggatgggcccttggtccgaccaccagcaggggccgcccttggaagggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcgggctcgcccgaactctcgccaccccagcccctcttccggccccgctcggagtttgaggagatgaccatcctgtatgacatctggaacggtggcatcgatgaggaggacatccgcttcctgtgtgtcacctacgagcgactgctacagcaggacaatggcatggactggcttaacgacacgctctgggtctaccatccctatatcctgctggcatggggggctctgcaccttctgggatgcaggaagtccctgctcacctctctgggccccaccacccagtctgtagcagcccgcggtgcccatgaagctaagaagaagaaacgggacgatggcatccgcgagcacgtgacgggctgtgcccgcagtgagggcttctacaccatcgacaagaaggacaagctcagatacctcaacagcagccgtgccagcaccgatgagccccccgcagacacccaggacactggggatgacagagatccagagcctagggtgggaccgccgaggacacggccagctccgctgagccccgcacaccgtccactgcagggcatgagcatcccagcacagccccacgcctccacccgggcaggctcggagcggcgttcggagcagcgccgcctgctgtcctccttcactggcagctgtgacagtgacctgctcaagttcaaccagctcaagttccggaagaaaaagctcaagttctgcaagagccacattcacgactggggcttgttcgccatggagcccatcgcggctgacgagatggtcatcgagtacgtgggccagaatatccgtcaggtgatcgcagacatgcgggagaagcgttatgaggacgagggcatcgggagcagctacatgttccgggtggaccatgacaccatcatcgacgccaccaagtgcggcaacttcgcgcgcttcatcaaccacagctgcaaccccaactgctatgccaaggtgatcacggtggagtcacagaagaagatagtcatctactcgaagcagcacattaacgtcaatgaggagattacctatgactataagttccccatcgaggacgtcaagatcccctgcctctgtggctccgagaactgccgggggaccctcaactaggccccggcaccagactcaaaggatgtcagccgtagccctgggactcccgagcgtggagcccctggccccggggccggcccccgcgcccgcccccatttcaggtgctgtcctctacccagcggccattcagggcctggcgcccacactaccccctggagcccctggctcggcccctccgcgggaaagggcttctctgtcgttcagcccacgtctctctcattttaacaaacgcccctttcaggatttctgtttaactccagcatcagcttctctctctccgtctctcctcccctctctctcttctctgtctcttctctctcccaccatcaccctcggcctcttcctgtgaatgctgctacgttgttttgtcttctctatttttttcctcgttgtgagaaaagacatttaaccgttgaaatgtgaaggtggaatcagagaggggccccgcgggggtctgcagaggcctcagtgtggctgtgcgtggcccgtgtcctggaagccacccggacctggacgcagggccaggtgctgtgggaaggatggaggcccccacggccttgacctcagaacactacgccctgaaagcgcccctcactgcccgtgggcacagtgaggagaccccacacctttccccacccgagctgcagcctgttccttccccagaggcctggggcaccactgacccggtggaccctgatggagctaagctgtcccaggcaggggtctccgctctgggctttccctgccacctcacaccccagcaccccctaaaccttgggttcaatgtttactttctcattcggatgccagcaacgcgggagcctctcggaggccccagtgcaggtgaggggcgctgagaacgcgggcagccactctcttctgcccttgccttcgccctgggtgggacagggctcccaagggcaggcgggtcccccagtcccgccattacgggttgtcagaccgtctgcgtgtggcattttttggcttataagcttcacccactcacccccaacccacaccccacatccccctgccggcagcccctcaacctaagaaggccagagcatatttattttcggagggagcagattacttctcccagagaaaggaaaatcttggaaaagatttaaaaacacaaatctaagccttgacggtttttttttcccttttgacccccttcccatctcttcagaatttattcccatggcttttttttttcttgtgcgtgtataaaatcaaaaggaaggggaaaaaggtttttgaagttcagaaccaacttctgtatatagaggctgccgcaaaggactttctcttgggaacattgtttcttgtagaaacatgcgggaagacattttttgctcatttctttgtacttccaaaaaaaaaggaaaaaaaagacaaaagcaagtccccccgtaccccagaaagcagaggaggcgtgtaaataatttctggaaagtgactgttgtgacccggagtcctcatcaagatgagcgcgctccatgagggagctgctcccaccctgcggacgcaggcggccggagcctctggtatctcagcttgtgtcaagcttgttatcatgtaaattctgtacaaagaattgttatttttctcttttttgttgttggtggttttgttgtgtgttttttgttgttttttttttattcctttcccccaggccctctctatttgagactgtgcccgccggtttcaagatcaaggaaattggtggcaacaagacacagatggggtacctgggcacagcggcgaacttctcttccgtttgcggttttctgcctaattgtgcaactgaggaaataatttatttttcacatgaggaaatgcgtagcttgtagagacggctgattcaagttacatgtacagcctccaaagggctgtctccattctgtccccttcccataaaagaagtgggggtgttcgagaagaccagggaagggacccttgcctcacccctccccctggcctcaccttgctcccagccatcgtgcccagtgttaacctcggctggccttcactaaggggactagacctccctctccccaggagccccagccccagagtggtttgcaataatcaagatatgtgtcgagtcatttttctttcaactccctcatttttcattgaacaaatctctgcttttcaagagttgggggtttctgctattttttgctttctctccctccccctgcaaagatgagaaccaatgagttttagggatgtttgtgcgggtagactccatcatccatatgtaacttgttttgaagagaagtgtttccgttgtgtgtcttgatgtaaatatttgttcatatttttgtgaattcaatactatgtaccattgtattatagtaacttttataaagcaaaccataaatatactgacttttcttacagatacgccgtctctcttgctctcctctctccctctcctctttattctttctttctgttgggagcacatcctgcttctgtggagggtggagtggtccactcagacact

SEQ ID NO: 460219 - DNA, 1263 bp, Homo sapiens
ataccccccacagcaatgtcgtcttcatggcattgatggtccggctgcagtcatgaagccagatgctcaagatttggaaaccaaagttcatgttctttcagtcagctcccctgttctgggagaaaatgctgaagagagtgttgatggggaaaacaccttggatactgcttccaagccagatcttcagaagattttccaaaaacaatagtatctcagatagtctgaactttgatgaggagactgatggcgaggaagaagaaggaaagaaaataagatcccaggctacatattcagaaaaagaaagacccaattccacatccagcctgcactcgaccacagatgcaaatgcttccggttcctatgctgctgcccaaccggccggtaacgagctgggggaagtggaggaactggaggactttgcttccgttttcgattttgcagcccaaccgctgcataaccggctgcgagaagtggagggcctggaggacttttaagcatagtcctgccccttgaagtgtcacagtaagatgtcatataatcagggataaaaaaaggaatggattggggcccctgctccacttactgtatatacttggaaaaagaagaaaatcagaagacatttcttcttacagctagaaagcgggaaaagagcaaatcatccaactgccttatctccactgatccaactgatttatctcgtgaaggagaaagctcaagaaggaaggagaatttgaggaaggctgaactcagagaagagaggtgataaaatagagagaaaggtctctggagagatcagctacaccgtagccagctgggacctgtggaggacgaagatcattatgatattccctgcagcaggaagcagcaaatgaactgtcaggccagtgaggtctgacacccaattataagttgtcaaatatatacacagcgtctttccatcatacctacatttgttaacgttatttttatttaccttctgttttgtgtccagcactgatattgtgctaaatccttcagacaaagtttggtgctttcatgacctgactatgtgtttgcagtaagtgtttggagaaatgagggagatgagagaagaagtgctgtgtatgttcacattttggggcacagcagtccccagatcagctggggaagcaaggtgagctagtgacaagttggccagaaagtatagatgagcagcaagaaacaggagtggagagagacagggtgaaccggggggtgggagagagagctggaagtcttaagatt

SEQ ID NO: 460220 - DNA, 1451 bp, Homo sapiens
tcggagtttctagcagtgtgcttttggagtcattagtagtgagtgtgcgactgggatggtagagtatttccactgggacagttcagtggcaccggctcactccaggagactgagatggctgaaaatgaagaacaggtgtatcttgcaaatctccccacatataaacattctacgtggacttcacctacaaaacgcaagctcagaaataaaattggtatcacaacagttctctgggaagccaagtcagctaccaataatcacagcagtaaaaatctgaagatgagggctgacgaaggcttttctgaaacttgttgccgatgctcggctgggcttgaagaggtgaagacagttgctgagcgtaaagcagttaaattacaccataaaattcaggtgaggaaacagacgcacacagaggtgaagcagcttccccaaaggcgcatggctaagagtggttatttgtctccttgtcacgctgttttgagggaaggattcctacactaggattatgaagatcgccaaacagatgacgctggatcccagaaaagtggggcagaatgcagtttagttgtcacatatgctcacagcctagggaagaagacagcggacagcccacagggccacgcgatggttcaagaacagagtgaacagccagggcctgtgaaagggaggaatctcccagtgtttgtgccatgttttgatctgactgaaagccataaacatagccgaagcctgggccatccacagaagacccaatgttctctttttccaagtgggcattttgtatctctgaagagttctagactgagctacatcagtagacctctgcatttaaagggagcaattctcatccgaggatcctgattcttctactgtagtgcaatttcaccactctctccaaatgtctccaagcaaattcaaagcagctgaaaataactgcatgcctgagagtgagagaaatttcttaagtgatcgaccaaatctgggtctgattagtgggtggatgcctcattggagaggctgatttgagagtcggggtacaaataataatggctaataatggcaaacaattagtaattgctaggtgccaggagttgtgctaaatgctttacatgagtagataggatattgcagatctcaacagttaagaaatttgcttgtgatcatgtagtttggagagtatcagagtctgaaatgaagacaacttgagggtcaataaacaggaagaaaaagtactctacaagacagtttatctgataacggtatgatggaagatggcatcaggcggaggtaaatgggacgagggactggaagaaaaccactgaatcaaagactcttggagttgaaagtttccttagcaactatctagattcattaacttcttcacagttgagagatttctgcattatttttcttccataaataaccaatctctgcttaattttttaccagac

SEQ ID NO: 460221 - DNA, 984 bp, Homo sapiens
tatatttaattcgtacccaaataggatgataaaaaaaaccaccaacaaccagggaggaatctcccagtgtttgtgccatgttttgatctgactgaaagccataaacatagccgaagcctgggccatccacagaagacccaatgttctctttttccaagtgggcattttgtatctctgaagagttctagactgagctacatcagtagacctctgcatttaaagggagcaattctcatccgaggatcctgattcttctactgtagtgcaatttcaccactctctccaaatgtctccaagcaaattcaaagcagctgaaaataactgcatgcctgagaggaccacgaagcttcaggccagccctgtcccgaagtcttctgtgcttcatgtcgagtggtctgcagtggactgtgtctgcttgaagcgatgctccggagggcttattgttgtgtggggtaaagcatgagatcactgaaaaatgagagaaatcgagcatacgaaatgtgaagcatatctgttgacaccatgcgctccctttgcttgcactggatggcgcatggtttccgtgcgcagtgcctgaggtgtggggcaggcgaggcccatgcagcctggctcctttccagaaggttgctgttcattacagctcgagtgtgctgggttctgcagatattatctattttaaattaacgctccgtaaaaggaatttaaagttttctgaaaagaaaccaatgaatgaagctaatagtaataatgcaaacacaagcaagctgccaagtaagccatttttctattacggagcccttcatcagtcatattattaaagaaaaaacaacaatactagtaataatgatcacctattcaagaccaagaggttgatcctccaaaattcaaacaaggaaaaatctctcccaatctctcctttcctccatcccttttctttacttctcatcccatatataatattatataatgcatacgtaataaaag

SEQ ID NO: 460222 - DNA, 1596 bp, Homo sapiens
tcggagtttctagcagtgtgcttttggagtcattagtagtgagtgtgcgactgggatggtagagtatttccactgggacagttcagtggcaccggctcactccaggagactgagatggctgaaaatgaagaacaggtgtatcttgcaaatctccccacatataaacattctacgtggacttcacctacaaaacgcaagctcagaaataaaattggtatcacaacagttctctgggaagccaagtcagctaccaataatcacagcagtaaaaatctgaagatgagggctgacgaaggcttttctgaaacttgttgccgatgctcggctgggcttgaagaggtgaagacagttgctgagcgtaaagcagttaaattacaccataaaattcaggtgaggaaacagacgcacacagaggtgaagcagcttccccaaaggcgcatggctaagagtggttatttgtctccttgtcacgctgttttgagggaaggattcctacactaggattatgaagatcgccaaacagatgacgctggatcccagaaaagtggggcagaatgcagtttagttgtcacatatgctcacagcctagggaagaagacagcggacagcccacagggccacgcgatggttcaagaacagagtgaacagccagggcctgtgaaagggaggaatctcccagtgtttgtgccatgttttgatctgactgaaagccataaacatagccgaagcctgggccatccacagaagacccaatgttctctttttccaagtgggcattttgtatctctgaagagttctagactgagctacatcagtagacctctgcatttaaagggagcaattctcatccgaggatcctgattcttctactgtagtgcaatttcaccactctctccaaatgtctccaagcaaattcaaagcagctgaaaataactgcatgcctgagaggaccacgaagcttcaggccagccctgtcccgaagtcttctgtgcttcatgtcgagtggtctgcagtggactgtgtctgcttgaagcgatgctccggagggcttattgttgtgtggggtaaagcatgagatcactgaaaaatgagagaaatcgagcatacgaaatgtgaagcatatctgttgacaccatgcgctccctttgcttgcactggatggcgcatggtttccgtgcgcagtgcctgaggtgtggggcaggcgaggcccatgcagcctggctcctttccagaaggttgctgttcattacagctcgagtgtgctgggttctgcagatattatctattttaaattaacgctccgtaaaaggaatttaaagttttctgaaaagaaaccaatgaatgaagctaatagtaataatgcaaacacaagcaagctgccaagtaagccatttttctattacggagcccttcatcagtcatattattaaagaaaaaacaacaatactagtaataatgatcacctattcaagaccaagaggttgatcctccaaaattcaaacaaggaaaaatctctcccaatctctcctttcctccatcccttttctttacttctcatcccatatataatattatataatgcatacgtaataaaag

SEQ ID NO: 460223 - DNA, 1225 bp, Homo sapiens
gttttaatcaccatgacatttgcagtcatttattacaacagcagcaggaaacaaacagtgctcatgatgtccacatgtcatgagtggagggaccccgatcactggattagggcccaccgctcatctttacgaatcacatctggaaagaccctctttccaaacaaggtccattctgtgtttcctgagactcacgggttccttaggggtaaagaaactagtagtgatgatggtagtgatgatggtgatgatgatggtgatgatggtgagcatgatggtgatgatggtgaagatggtgatgatgatggtgatggtgatgtgatgatggtggtgatgatggtgatggtggtgatggtgacggtggtgatgatgatggtgatggtgattgatgatggtgatggtggtgatgatggtgatgatggtgatggtggtgatgatgatggtgatggtgatgatggtaataatgatggtggtagtgatggtgatgatgaccagatcaaagactggctgaaaaacaggaaggaggtgaaagcagcccttcataagacacgcccaccagtgcaatgtcagtttaccattgccatgggaacacccataagacacgcctaccagtgttatgtcagtttaccattgccatggcaacacccagaagttactgccccttttgcaagacaacgacccagaagttcccaccctttttctagaaatttctgaataagctcacccttgtctgggatggaattaaaagtagatataaatatggctgcagaactgccctgggctgctgctctcaggcactgcctgtgggccctgctctgctgtggtgtggtggtcacggggctgctaccctgcacctccataaagctgcttcctcctaccaccagctcgctcctaagcacagccaaaatccttcccgggctaagcccagtgtggggttcgcctgccctgcttcagacggattgaagatcagatcagatacagcggaagaaagaactactggactggaagttaccaacatgactcaccagacggagatgggaagagatgcctgcagcccccggcgagcgtttcctccacgcagtgagcctcaggagcacaggtcatcacggagtgcattgaagctgagttctcttctacctttatttccaatacaattgctttaaatgtacatttatgtaatttaatttttaataattctgtgtttacaactggctcacaaaattcctgg

SEQ ID NO: 460224 - DNA, 5144 bp, Homo sapiens
ggcggcgggagagctgctggctcgcccggatcccgggagctgcctggaggcgggcccggcccggggaaggtgagcggctgcgggacccagcccctcgccgggagcgggcaccatggtgctgtcggtgcctgtgatcgcgctgggcgccacgctgggcacagccaccagcatcctcgcgttgtgcggggtcacctgcctgtgtcggcacatgcaccccaagaaggggctgctgccgcgggaccaggaccccgacctggagaaggcgaagcccagcttgctcgggtctgcacaacagttcaatgttaaaaagtccacggaacctgttcagccccgtgccctcctcaagttcccagacatctatggacccaggccagctgtgacggctccagaggtcatcaactatgcagactattcactgaggtctacggaggagcccactgcacctgccagcccccaacccccgaatgacagtcgcctcaagaggcaggtcacagaggagctgttcatcctccctcagaatggtgtggtggaggatgtctgtgtcatggagacctggaacccagagaaggctgccagttggaaccaggcccccaaactccactactgcctggactatgactgtcagaaggcagaattgtttgtgactcgcctggaagctgtgaccagcaaccacgacggaggctgtgactgctacgtccaagggagtgtggccaataggaccggctctgtggaggctcagacagccctaaagaagcggcagctgcacaccacctgggaggagggcctggtgctccccctggcggaggaggagctccccacagccaccctgacgctgaccttgaggacctgcgaccgcttctcccgtcacagcgtggccggggagctccgcctgggcctggacgggacatctgtgcctctaggggctgcccagtggggcgagctgaagacttcagcgaaggagccatctgcaggagctggagaggtcctactatccatcagctacctcccggctgccaaccgcctcctggtggtgctgattaaagccaagaacctccactctaaccagtccaaggagctcctggggaaggatgtctctgtcaaggtgaccttgaagcaccaggctcggaagctgaagaagaagcagactaaacgagctaagcacaagatcaaccccgtgtggaacgagatgatcatgtttgagctgcctgacgacctgctgcaggcctccagtgtggagctggaagtgctgggccaggacgattcagggcagagctgtgcgcttggccactgcagcctgggcctgcacacctcgggctctgagcgcagccactgggaggagatgctcaaaaaccctcgccggcagattgccatgtggcaccagctgcacctgtaaccagctgcccagctgcctcccttcttggacagccctgacccgtcctctgcaacctcctttctgtgcccctttcctcattctgacacccagaagacagtgacagatgtgtttgcaaggctgggatggctctctcatcatactcttgtttcttagaaataagcaagacagagcaggaaatggaatatgcgggtcacactgaggaatgcattttgctcatctgtgttattgaaggaggtgcttattaaatacagttcctatgcctgttttataggtggggttaggccagatgcagagaaagctaaatgtgggaatcatggatgcaaagaagaatttggctttttgaaaaacaagcatttcaaaaatgatgaaggaagtgaaagtatcctggatcaactcctagagttagagattgcccaggtggaaagaaaccttagccagcgttcaatcaagctcaccatgcagggcagtcacccggcagttctcaaactttagcatgtgaagagtcaccagcagattcctgggctcgcctggagacattcctagtcggtattcctggtcgaagcccaggagccttcctttttaacaagctgatgtagagggtggagcactgtatgtggagaaattccttctacaatattccacacaggtttttggccacagtccttgatggagtcccaaaaccatggtgcagccagttccaatgctggacacctcaaccatcagggtgaaatctggggcctcagctttttaatttaattattttaattcttaatactttaatttgtgcatttcataagccccctgctcttggactgaattttgtgctttttattgaagaattttattgtttttatcttaaaatcagtttctattatccttggggagaccatccctaacaaagtacaggtgggatctcctgtgagtcattggctgggttctgattgctagatgtcacacccaccagcatcaccaaagtgactctgagatagaccggtcccttctcagcgttccagtcacttcaggaggaatttagttattgacttagtctatgacatctggctacatgtaggtagagaagaaagacaattttaaaaaggaaatcaggtcttttgcaactgtgcctccctctgtctgttttcacttgaatgggtaaataaccagcagctaggttttgaattcctaccttgttattctaaacagatgtccacattgttaattaaatctaaattatgagccttgctgagtggatacggtacttacacctgaaccaggattcctgggttctgttgttgacattgcccttcagcacctgtttggccagctgtataagataggactaatgactaggaagcctaccccaatgaatgatatactagatgaaatagtgttcaaaacctgtaggcactctctggctaaaaacaaactctgaggccaccagcagatcatctttaagctaagttactatttttcacctttttttttagacggagttttgctctttgttgcccaggctggagtgcagtggcacgatctcggctcactgcaacctccgcctcccaagttcaagcgattctcctgtctcagcctcctgggtagctgggattacaggtgcccaccaacatgcctggctaatttttgtacttttagtagagatggggtttcaccatgttggccaggctggtcttcaactccagatctcaggtgatctaccctcctcggcctcccaaagtactgggattacaggcctgagccaccgcgcccggcctatttttcactttaatttggcagctgagaatgcccaaaaagtgccagaagcatcgtggcatttccagaaccatggattctgcctttggacccctctctattaatattaaaactctgggccttcagatgtcaccctaatccactgccctaagacagaatttctggacaagatgggtaagggcttcattccttcaacaagtcaagtcatacttggcctctccctgagaatctgagcaggagccttataacctgtggtcattattttttctttctgtacagaaatagaaaagcattagaaataacttctaaccatcctctgaaaaaacagaaaaaatatcgaatccctctttcatgagaagtcttttggataattggaaaccttcatcactgaggttggccagcccctgccaagtgttgtgtaggcaaagcacttgttagtggcttcctatgaaatgttttagagatctcttcaccatactggtttcttctctttggttggtgtgggtaaaagaaaacaaaacatttcctataagctgaaagctgaccagcattctcttcttggtaacatctactactccaacctagaaaatttggattctagaccaaaaatcaggaaacatggctccttataaatctgtgcagctgccttatagtaccatcaaaggaatttcaggtgggctgggcggggccccgatcccagaattatcaactccacccatcatcatttggtcatgaagcatcctttcattcttcttcttcttttttttggggggggcggggcgggggagggatctcaaagttttagtcttccagaatccaaattaaaggttgcccctgatgggggccaggttccgccacagaacatcttagatgtcagccttgacctcacttagcagggattacagaaatgagatacattttgaaggagagttgtctgttatgttcactgtattctaagtgcctgggataaagctgtctcatgggtgctccatatatattcatatatatttgttgagtgaattaatgaattaagagtggctggcagagtaggcagaaaaagacactgcaaatggcataaaaattaaagtcctagctgagttctcaatggtaaaggcatcagatgtcttagcagtcaagctagaaattcatgacaatgagtattactatttgcctaatgacaactcattgctctccatgtaaatgtaatcaacagatgaagagaatataattgctctgcttttccactaaaactccatcttagtgaattttaaattatccagagatgtcaaactgccaaataaaaatatttcagtagtctttgcatcagcttaccttgtaccagaaacatttccaatttactatcaaattatagtaactgagcctgtgtgaagtatctcatcattttcgaaaggaacaccttgtgtgatgccagtgagcatttctaaaaagggtgtgaggtagaggtaaaaataaggtgagagaccatttcagaatgcactgttgctcaaaaaggtgatctggttctttcttcagagatttctacggggatagaaaatcgggagtctgccctcattaatctgtgactccacctcttgcatcaaatcaatatctatttgttgagcacttattgattaagaccttgcatatgtctgtccattttgatttgagatacaactttttgtgtgggttgaatgacaaatcactccaaacaaagctgggcacagagaatcagctaggagaccagttattcagggtccatttctcttggatgtaaaggagtcctgggtaaaatgtggctgtaacctaaaccaactagtccttgtgatttgtttctgccctctgtgtttcctgttgtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacaggg

SEQ ID NO: 460225 - DNA, 412 bp, Homo sapiens
tgatttggtgagcacttattgatttggtgcaagaggtggaatcacagattaatgagggcagaccttgcatatgtctgtccattttgatttgagatacaactttttgtgtgggttgaatgacaaatcactccaaacaaagctgggcacagagaatcagctaggagaccagttattcagggtccatttctcttggatgtaaaggagtcctgggtaaaatgtggctgtaacctaaaccaactagtccttgtgatttgtttctgccctctgtgtttcctgttgtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacaggg

SEQ ID NO: 460226 - DNA, 4618 bp, Homo sapiens
ggcggcgggagagctgctggctcgcccggatcccgggagctgcctggaggcgggcccggcccggggaaggtgagcggctgcgggacccagcccctcgccgggagcgggcaccatggtgctgtcggtgcctgtgatcgcgctgggcgccacgctgggcacagccaccagcatcctcgcgttgtgcggggtcacctgcctgtgtcggcacatgcaccccaagaaggggctgctgccgcgggaccaggaccccgacctggagaaggcgaagcccagcttgctcgggtctgcacaacagttcaatgttaaaaagtccacggaacctgttcagccccgtgccctcctcaagttcccagacatctatggacccaggccagctgtgacggctccagaggtcatcaactatgcagactattcactgaggtctacggaggagcccactgcacctgccagcccccaacccccgaatgacagtcgcctcaagaggcaggtcacagaggagctgttcatcctccctcagaatggtgtggtggaggatgtctgtgtcatggagacctggaacccagagaaggctgccagttggaaccaggcccccaaactccactactgcctggactatgactgtcagaaggcagaattgtttgtgactcgcctggaagctgtgaccagcaaccacgacggaggctgtgactgctacgtccaagggagtgtggccaataggaccggctctgtggaggctcagacagccctaaagaagcggcagctgcacaccacctgggaggagggcctggtgctccccctggcggaggaggagctccccacagccaccctgacgctgaccttgaggacctgcgaccgcttctcccgtcacagcgtggccggggagctccgcctgggcctggacgggacatctgtgcctctaggggctgcccagtggggcgagctgaagacttcagcgaaggagccatctgcaggagctggagaggtcctactatccatcagctacctcccggctgccaaccgcctcctggtggtgctgattaaagccaagaacctccactctaaccagtccaaggagctcctggggaaggatgtctctgtcaaggtgaccttgaagcaccaggctcggaagctgaagaagaagcagactaaacgagctaagcacaagatcaaccccgtgtggaacgagatgatcatgtttgagctgcctgacgacctgctgcaggcctccagtgtggagctggaagtgctgggccaggacgattcagggcagagctgtgcgcttggccactgcagcctgggcctgcacacctcgggctctgagcgcagccactgggaggagatgctcaaaaaccctcgccggcagattgccatgtggcaccagctgcacctgtaaccagctgcccagctgcctcccttcttggacagccctgacccgtcctctgcaacctcctttctgtgcccctttcctcattctgacacccagaagacagtgacagatgtgtttgcaaggctgggatggctctctcatcatactcttgtttcttagaaataagcaagacagagcaggaaatggaatatgcgggtcacactgaggaatgcattttgctcatctgtgttattgaaggaggtgcttattaaatacagttcctatgcctgttttataggtggggttaggccagatgcagagaaagctaaatgtgggaatcatggatgcaaagaagaatttggctttttgaaaaacaagcatttcaaaaatgatgaaggaagtgaaagtatcctggatcaactcctagagttagagattgcccaggtggaaagaaaccttagccagcgttcaatcaagctcaccatgcagggcagtcacccggcagttctcaaactttagcatgtgaagagtcaccagcagattcctgggctcgcctggagacattcctagtcggtattcctggtcgaagcccaggagccttcctttttaacaagctgatgtagagggtggagcactgtatgtggagaaattccttctacaatattccacacaggtttttggccacagtccttgatggagtcccaaaaccatggtgcagccagttccaatgctggacacctcaaccatcagggtgaaatctggggcctcagctttttaatttaattattttaattcttaatactttaatttgtgcatttcataagccccctgctcttggactgaattttgtgctttttattgaagaattttattgtttttatcttaaaatcagtttctattatccttggggagaccatccctaacaaagtacaggtgggatctcctgtgagtcattggctgggttctgattgctagatgtcacacccaccagcatcaccaaagtgactctgagatagaccggtcccttctcagcgttccagtcacttcaggaggaatttagttattgacttagtctatgacatctggctacatgtaggtagagaagaaagacaattttaaaaaggaaatcaggtcttttgcaactgtgcctccctctgtctgttttcacttgaatgggtaaataaccagcagctaggttttgaattcctaccttgttattctaaacagatgtccacattgttaattaaatctaaattatgagccttgctgagtggatacggtacttacacctgaaccaggattcctgggttctgttgttgacattgcccttcagcacctgtttggccagctgtataagataggactaatgactaggaagcctaccccaatgaatgatatactagatgaaatagtgttcaaaacctgtaggcactctctggctaaaaacaaactctgaggccaccagcagatcatctttaagctaagttactatttttcacctttttttttagacggagttttgctctttgttgcccaggctggagtgcagtggcacgatctcggctcactgcaacctccgcctcccaagttcaagcgattctcctgtctcagcctcctgggtagctgggattacaggtgcccaccaacatgcctggctaatttttgtacttttagtagagatggggtttcaccatgttggccaggctggtcttcaactccagatctcaggtgatctaccctcctcggcctcccaaagtactgggattacaggcctgagccaccgcgcccggcctatttttcactttaatttggcagctgagaatgcccaaaaagtgccagaagcatcgtggcatttccagaaccatggattctgcctttggacccctctctattaatattaaaactctgggccttcagatgtcaccctaatccactgccctaagacagaatttctggacaagatgggtaagggcttcattccttcaacaagtcaagtcatacttggcctctccctgagaatctgagcaggagccttataacctgtggtcattattttttctttctgtacagaaatagaaaagcattagaaataacttctaaccatcctctgaaaaaacagaaaaaatatcgaatccctctttcaaaggttgcccctgatgggggccaggttccgccacagaacatcttagatgtcagccttgacctcacttagcagggattacagaaatgagatacattttgaaggagagttgtctgttatgttcactgtattctaagtgagtgaattaatgaattaagagtggctggcagagtaggcagaaaaagacactgcaaatggcataaaaattaaagtcctagctgagttctcaatggtaaaggcatcagatgtcttagcagtcaagctagaaattcatgacaatgagtattactatttgcctaatgacaactcattgctctccatgtaaatgtaatcaacagatgaagagaatataattgctctgcttttccactaaaactccatcttagtgaattttaaattatccagagatgtcaaactgccaaataaaaatatttcagtagtctttgcatcagcttaccttgtaccagaaacatttccaatttactatcaaattatagtaactgagcctgtgtgaagtatctcatcattttcgaaaggaacaccttgtgtgatgccagtgagcatttctaaaaagggtgtgaggtagaggtaaaaataaggtgagagaccatttcagaatgcactgttgctcaaaaaggtgatctggttctttcttcagagatttctacggggatagaaaatcgggagtctgccctcattaatctgtgactccacctcttgcatcaaatcaatatctatttgttgagcacttattgattaagaccttgcatatgtctgtccattttgatttgagatacaactttttgtgtgggttgaatgacaaatcactccaaacaaagctgggcacagagaatcagctaggagaccagttattcagggtccatttctcttggatgtaaaggagtcctgggtaaaatgtggctgtaacctaaaccaactagtccttgtgatttgtttctgccctctgtgtttcctgttgtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacaggg

SEQ ID NO: 460227 - DNA, 2599 bp, Homo sapiens
gggctgtacggtccggaatatttgggatctacttgttattctaaacagatgtccacattgttaattaaatctaaattatgagccttgctgagtggatacggtacttacacctgaaccaggattcctgggttctgttgttgacattgcccttcagcacctgtttggccagctgtataagataggactaatgactaggaagcctaccccaatgaatgatatactagatgaaatagtgttcaaaacctgtaggcactctctggctaaaaacaaactctgaggccaccagcagatcatctttaagctaagttactatttttcacctttttttttagacggagttttgctctttgttgcccaggctggagtgcagtggcacgatctcggctcactgcaacctccgcctcccaagttcaagcgattctcctgtctcagcctcctgggtagctgggattacaggtgcccaccaacatgcctggctaatttttgtacttttagtagagatggggtttcaccatgttggccaggctggtcttcaactccagatctcaggtgatctaccctcctcggcctcccaaagtactgggattacaggcctgagccaccgcgcccggcctatttttcactttaatttggcagctgagaatgcccaaaaagtgccagaagcatcgtggcatttccagaaccatggattctgcctttggacccctctctattaatattaaaactctgggccttcagatgtcaccctaatccactgccctaagacagaatttctggacaagatgggtaagggcttcattccttcaacaagtcaagtcatacttggcctctccctgagaatctgagcaggagccttataacctgtggtcattattttttctttctgtacagaaatagaaaagcattagaaataacttctaaccatcctctgaaaaaacagaaaaaatatcgaatccctctttcatgagaagtcttttggataattggaaaccttcatcactgaggttggccagcccctgccaagtgttgtgtaggcaaagcacttgttagtggcttcctatgaaatgttttagagatctcttcaccatactggtttcttctctttggttggtgtgggtaaaagaaaacaaaacatttcctataagctgaaagctgaccagcattctcttcttggtaacatctactactccaacctagaaaatttggattctagaccaaaaatcaggaaacatggctccttataaatctgtgcagctgccttatagtaccatcaaaggaatttcaggtgggctgggcggggccccgatcccagaattatcaactccacccatcatcatttggtcatgaagcatcctttcattcttcttcttcttttttttggggggggcggggcgggggagggatctcaaagttttagtcttccagaatccaaattaaaggttgcccctgatgggggccaggttccgccacagaacatcttagatgtcagccttgacctcacttagcagggattacagaaatgagatacattttgaaggagagttgtctgttatgttcactgtattctaagtgcctgggataaagctgtctcatgggtgctccatatatattcatatatatttgttgagtgaattaatgaattaagagtggctggcagagtaggcagaaaaagacactgcaaatggcataaaaattaaagtcctagctgagttctcaatggtaaaggcatcagatgtcttagcagtcaagctagaaattcatgacaatgagtattactatttgcctaatgacaactcattgctctccatgtaaatgtaatcaacagatgaagagaatataattgctctgcttttccactaaaactccatcttagtgaattttaaattatccagagatgtcaaactgccaaataaaaatatttcagtagtctttgcatcagcttaccttgtaccagaaacatttccaatttactatcaaattatagtaactgagcctgtgtgaagtatctcatcattttcgaaaggaacaccttgtgtgatgccagtgagcatttctaaaaagggtgtgaggtagaggtaaaaataaggtgagagaccatttcagaatgcactgttgctcaaaaaggtgatctggttctttcttcagagatttctacggggatagaaaatcgggagtctgccctcattaatctgtgactccacctcttgcatcaaatcaatatctatttgttgagcacttattgattaagaccttgcatatgtctgtccattttgatttgagatacaactttttgtgtgggttgaatgacaaatcactccaaacaaagctgggcacagagaatcagctaggagaccagttattcagggtccatttctcttggatgtaaaggagtcctgggtaaaatgtggctgtaacctaaaccaactagtccttgtgatttgtttctgccctctgtgtttcctgttgtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacaggg

SEQ ID NO: 460228 - DNA, 4413 bp, Homo sapiens
ggcggcgggagagctgctggctcgcccggatcccgggagctgcctggaggcgggcccggcccggggaaggtgagcggctgcgggacccagcccctcgccgggagcgggcaccatggtgctgtcggtgcctgtgatcgcgctgggcgccacgctgggcacagccaccagcatcctcgcgttgtgcggggtcacctgcctgtgtcggcacatgcaccccaagaaggggctgctgccgcgggaccaggaccccgacctggagaaggcgaagcccagcttgctcgggtctgcacaacagttcaatgttaaaaagtccacggaacctgttcagccccgtgccctcctcaagttcccagacatctatggacccaggccagctgtgacggctccagaggtcatcaactatgcagactattcactgaggtctacggaggagcccactgcacctgccagcccccaacccccgaatgacagtcgcctcaagaggcaggtcacagaggagctgttcatcctccctcagaatggtgtggtggaggatgtctgtgtcatggagacctggaacccagagaaggctgccagttggaaccaggcccccaaactccactactgcctggactatgactgtcagaaggcagaattgtttgtgactcgcctggaagctgtgaccagcaaccacgacggaggctgtgactgctacgtccaagggagtgtggccaataggaccggctctgtggaggctcagacagccctaaagaagcggcagctgcacaccacctgggaggagggcctggtgctccccctggcggaggaggagctccccacagccaccctgacgctgaccttgaggacctgcgaccgcttctcccgtcacagcgtggccggggagctccgcctgggcctggacgggacatctgtgcctctaggggctgcccagtggggcgagctgaagacttcagcgaaggagccatctgcaggagctggagaggtcctactatccatcagctacctcccggctgccaaccgcctcctggtggtgctgattaaagccaagaacctccactctaaccagtccaaggagctcctggggaaggatgtctctgtcaaggtgaccttgaagcaccaggctcggaagctgaagaagaagcagactaaacgagctaagcacaagatcaaccccgtgtggaacgagatgatcatgtttgagctgcctgacgacctgctgcaggcctccagtgtggagctggaagtgctgggccaggacgattcagggcagagctgtgcgcttggccactgcagcctgggcctgcacacctcgggctctgagcgcagccactgggaggagatgctcaaaaaccctcgccggcagattgccatgtggcaccagctgcacctgtaaccagctgcccagctgcctcccttcttggacagccctgacccgtcctctgcaacctcctttctgtgcccctttcctcattctgacacccagaagacagtgacagatgtgtttgcaaggctgggatggctctctcatcatactcttgtttcttagaaataagcaagacagagcaggaaatggaatatgcgggtcacactgaggaatgcattttgctcatctgtgttattgaaggaggtgcttattaaatacagttcctatgcctgttttataggtggggttaggccagatgcagagaaagctaaatgtgggaatcatggatgcaaagaagaatttggctttttgaaaaacaagcatttcaaaaatgatgaaggaagtgaaagtatcctggatcaactcctagagttagagattgcccaggtggaaagaaaccttagccagcgttcaatcaagctcaccatgcagggcagtcacccggcagttctcaaactttagcatgtgaagagtcaccagcagattcctgggctcgcctggagacattcctagtcggtattcctggtcgaagcccaggagccttcctttttaacaagctgatgtagagggtggagcactgtatgtggagaaattccttctacaatattccacacaggtttttggccacagtccttgatggagtcccaaaaccatggtgcagccagttccaatgctggacacctcaaccatcagggtgaaatctggggcctcagctttttaatttaattattttaattcttaatactttaatttgtgcatttcataagccccctgctcttggactgaattttgtgctttttattgaagaattttattgtttttatcttaaaatcagtttctattatccttggggagaccatccctaacaaagtacaggtgggatctcctgtgagtcattggctgggttctgattgctagatgtcacacccaccagcatcaccaaagtgactctgagatagaccggtcccttctcagcgttccagtcacttcaggaggaatttagttattgacttagtctatgacatctggctacatgtaggtagagaagaaagacaattttaaaaaggaaatcaggtcttttgcaactgtgcctccctctgtctgttttcacttgaatgggtaaataaccagcagctaggttttgaattcctaccttgttattctaaacagatgtccacattgttaattaaatctaaattatgagccttgctgagtggatacggtacttacacctgaaccaggattcctgggttctgttgttgacattgcccttcagcacctgtttggccagctgtataagataggactaatgactaggaagcctaccccaatgaatgatatactagatgaaatagtgttcaaaacctgtaggcactctctggctaaaaacaaactctgaggccaccagcagatcatctttaagctaagttactatttttcacctttttttttagacggagttttgctctttgttgcccaggctggagtgcagtggcacgatctcggctcactgcaacctccgcctcccaagttcaagcgattctcctgtctcagcctcctgggtagctgggattacaggtgcccaccaacatgcctggctaatttttgtacttttagtagagatggggtttcaccatgttggccaggctggtcttcaactccagatctcaggtgatctaccctcctcggcctcccaaagtactgggattacaggcctgagccaccgcgcccggcctatttttcactttaatttggcagctgagaatgcccaaaaagtgccagaagcatcgtggcatttccagaaccatggattctgcctttggacccctctctattaatattaaaactctgggccttcagatgtcaccctaatccactgccctaagacagaatttctggacaagatgggtaagggcttcattccttcaacaagtcaagtcatacttggcctctccctgagaatctgagcaggagccttataacctgtggtcattattttttctttctgtacagaaatagaaaagcattagaaataacttctaaccatcctctgaaaaaacagaaaaaatatcgaatccctctttcatgagaagtcttttggataattggaaaccttcatcactgaggttggccagcccctgccaagtgttgtgtaggcaaagcacttgttagtggcttcctatgaaatgttttagagatctcttcaccatactggtttcttctctttggttggtgtgggtaaaagaaaacaaaacatttcctataagctgaaagctgaccagcattctcttcttggtaacatctactactccaacctagaaaatttggattctagaccaaaaatcaggaaacatggctccttataaatctgtgcagctgccttatagtaccatcaaaggaatttcaggtgggctgggcggggccccgatcccagaattatcaactccacccatcatcatttggtcatgaagcatcctttcattcttcttcttcttttttttggggggggcggggcgggggagggatctcaaagttttagtcttccagaatccaaattaaaggttgcccctgatgggggccaggttccgccacagaacatcttagatgtcagccttgacctcacttagcagggattacagaaatgagatacattttgaaggagagttgtctgttatgttcactgtattctaagtgcctgggataaagctgtctcatgggtgctccatatatattcatatatatttgttttattcagggtccatttctcttggatgtaaaggagtcctgggtaaaatgtggctgtaacctaaaccaactagtccttgtgatttgtttctgccctctgtgtttcctgttgtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacaggg

SEQ ID NO: 460229 - DNA, 3794 bp, Homo sapiens
  misc_feature (3)..(4): n is a, c, g, or t
  misc_feature (8)..(8): n is a, c, g, or t
gannctanccattaggtggagaagaggagggaggaagggagaagggagaaggaagaggcaaggggagcagatgagagcagcagagtggggaccacctgcagcaggtccaggcaatatccatgggcgcagccataggatggatgggccgatggatggaggagttcaatgttaaaaagtccacggaacctgttcagccccgtgccctcctcaagttcccagacatctatggacccaggccagctgtgacggctccagaggtcatcaactatgcagactattcactgaggtctacggaggagcccactgcacctgccagcccccaacccccgaatgacagtcgcctcaagaggcaggtcacagaggagctgttcatcctccctcagaatggtgtggtggaggatgtctgtgtcatggagacctggaacccagagaaggctgccagttggaaccaggcccccaaactccactactgcctggactatgactgtcagaaggcagaattgtttgtgactcgcctggaagaaagtcccacgcctgtgttgttctccttgcctgcagctgtgaccagcaaccacgacggaggctgtgactgctacgtccaagggagtgtggccaataggaccggctctgtggaggctcagacagccctaaagaagcggcagctgcacaccacctgggaggagggcctggtgctccccctggcggaggaggagctccccacagccaccctgacgctgaccttgaggacctgcgaccgcttctcccgtcacagcgtggccggggagctccgcctgggcctggacgggacatctgtgcctctaggggctgcccagtggggcgagctgaagacttcagcgaaggagccatctgcaggagctggagaggtcctactatccatcagctacctcccggctgccaaccgcctcctggtggtgctgattaaagccaagaacctccactctaaccagtccaaggagctcctggggaaggatgtctctgtcaaggtgaccttgaagcaccaggctcggaagctgaagaagaagcagactaaacgagctaagcacaagatcaaccccgtgtggaacgagatgatcatgtttgagctgcctgacgacctgctgcaggcctccagtgtggagctggaagtgctgggccaggacgattcagggcagagctgtgcgcttggccactgcagcctgggcctgcacacctcgggctctgagcgcagccactgggaggagatgctcaaaaaccctcgccggcagattgccatgtggcaccagctgcacctgtaaccagctgcccagctgcctcccttcttggacagccctgacccgtcctctgcaacctcctttctgtgcccctttcctcattctgacacccagaagacagtgacagatgtgtttgcaaggctgggatggctctctcatcatactcttgtttcttagaaataagcaagacagagcaggaaatggaatatgcgggtcacactgaggaatgcattttgctcatctgtgttattgaaggaggtgcttattaaatacagttcctatgcctgttttataggtggggttaggccagatgcagagaaagctaaataaatagaaaagcattagaaataacttctaaccatcctctgaaaaaacagaaaaaatatcgaatccctctttcatgagaagtcttttggataattggaaaccttcatcactgaggttggccagcccctgccaagtgttgtgtaggcaaagcacttgttagtggcttcctatgaaatgttttagagatctcttcaccatactggtttcttctctttggttggtgtgggtaaaagaaaacaaaacatttcctataagctgaaagctgaccagcattctcttcttggtaacatctactactccaacctagaaaatttggattctagaccaaaaatcaggaaacatggctccttataaatctgtgcagctgccttatagtaccatcaaaggaatttcaggtgggctgggcggggccccgatcccagaattatcaactccacccatcatcatttggtcatgaagcatcctttcattcttcttcttcttttttttggggggggcggggcgggggagggatctcaaagttttagtcttccagaatccaaattaaaggttgcccctgatgggggccaggttccgccacagaacatcttagatgtcagccttgacctcacttagcagggattacagaaatgagatacattttgaaggagagttgtctgttatgttcactgtattctaagtgcctgggataaagctgtctcatgggtgctccatatatattcatatatatttgttgagtgaattaatgaattaagagtggctggcagagtaggcagaaaaagacactgcaaatggcataaaaattaaagtcctagctgagttctcaatggtaaaggcatcagatgtcttagcagtcaagctagaaattcatgacaatgagtattactatttgcctaatgacaactcattgctctccatgtaaatgtaatcaacagatgaagagaatataattgctctgcttttccactaaaactccatcttagtgaattttaaattatccagagatgtcaaactgccaaataaaaatatttcagtagtctttgcatcagcttaccttgtaccagaaacatttccaatttactatcaaattatagtaactgagcctgtgtgaagtatctcatcattttcgaaaggaacaccttgtgtgatgccagtgagcatttctaaaaagggtgtgaggtagaggtaaaaataaggtgagagaccatttcagaatgcactgttgctcaaaaaggtgatctggttctttcttcagagatttctacggggatagaaaatcgggagtctgccctcattaatctgtgactccacctcttgcatcaaatcaatatctatttgttgagcacttattgattaagaccttgcatatgtctgtccattttgatttgagatacaactttttgtgtgggttgaatgacaaatcactccaaacaaagctgggcacagagaatcagctaggagaccagttattcagggtccatttctcttggatgtaaaggagtcctgggtaaaatgtggctgtaacctaaaccaactagtccttgtgatttgtttctgccctctgtgtttcctgttgtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacagggtcagctgcctggtgttttctttttttccgttttacctaatattttggcatataaaatgcagaagaaatcatctgataagcacttatgagccactgccatgtttaataaaacttgacaactacaattgaagtaccctcagtgccctttactcagaagaccatgaccttggatttggggtttatcatcccaggcattccctcatacttttattacatgtctctgtaagccctgagttccataaagtgtttttaaacttcatttaaattgtatcacactattttcactcaacattaaatatttcagtttcatctgtgcagacacatgcagctccagtttatttctttttcactgatgtatgatattccattgtatggatatgccacagtcctatgcagttgatgtatatctacatgtttctttttcttttttttttttttactgttacaagaaatgctgctatgacattcctctgcatgtctccttgtgc

SEQ ID NO: 460230 - DNA, 5448 bp, Homo sapiens
ggcggcgggagagctgctggctcgcccggatcccgggagctgcctggaggcgggcccggcccggggaaggtgagcggctgcgggacccagcccctcgccgggagcgggcaccatggtgctgtcggtgcctgtgatcgcgctgggcgccacgctgggcacagccaccagcatcctcgcgttgtgcggggtcacctgcctgtgtcggcacatgcaccccaagaaggggctgctgccgcgggaccaggaccccgacctggagaaggcgaagcccagcttgctcgggtctgcacaacagttcaatgttaaaaagtccacggaacctgttcagccccgtgccctcctcaagttcccagacatctatggacccaggccagctgtgacggctccagaggtcatcaactatgcagactattcactgaggtctacggaggagcccactgcacctgccagcccccaacccccgaatgacagtcgcctcaagaggcaggtcacagaggagctgttcatcctccctcagaatggtgtggtggaggatgtctgtgtcatggagacctggaacccagagaaggctgccagttggaaccaggcccccaaactccactactgcctggactatgactgtcagaaggcagaattgtttgtgactcgcctggaagctgtgaccagcaaccacgacggaggctgtgactgctacgtccaagggagtgtggccaataggaccggctctgtggaggctcagacagccctaaagaagcggcagctgcacaccacctgggaggagggcctggtgctccccctggcggaggaggagctccccacagccaccctgacgctgaccttgaggacctgcgaccgcttctcccgtcacagcgtggccggggagctccgcctgggcctggacgggacatctgtgcctctaggggctgcccagtggggcgagctgaagacttcagcgaaggagccatctgcaggagctggagaggtcctactatccatcagctacctcccggctgccaaccgcctcctggtggtgctgattaaagccaagaacctccactctaaccagtccaaggagctcctggggaaggatgtctctgtcaaggtgaccttgaagcaccaggctcggaagctgaagaagaagcagactaaacgagctaagcacaagatcaaccccgtgtggaacgagatgatcatgtttgagctgcctgacgacctgctgcaggcctccagtgtggagctggaagtgctgggccaggacgattcagggcagagctgtgcgcttggccactgcagcctgggcctgcacacctcgggctctgagcgcagccactgggaggagatgctcaaaaaccctcgccggcagattgccatgtggcaccagctgcacctgtaaccagctgcccagctgcctcccttcttggacagccctgacccgtcctctgcaacctcctttctgtgcccctttcctcattctgacacccagaagacagtgacagatgtgtttgcaaggctgggatggctctctcatcatactcttgtttcttagaaataagcaagacagagcaggaaatggaatatgcgggtcacactgaggaatgcattttgctcatctgtgttattgaaggaggtgcttattaaatacagttcctatgcctgttttataggtggggttaggccagatgcagagaaagctaaatgtgggaatcatggatgcaaagaagaatttggctttttgaaaaacaagcatttcaaaaatgatgaaggaagtgaaagtatcctggatcaactcctagagttagagattgcccaggtggaaagaaaccttagccagcgttcaatcaagctcaccatgcagggcagtcacccggcagttctcaaactttagcatgtgaagagtcaccagcagattcctgggctcgcctggagacattcctagtcggtattcctggtcgaagcccaggagccttcctttttaacaagctgatgtagagggtggagcactgtatgtggagaaattccttctacaatattccacacaggtttttggccacagtccttgatggagtcccaaaaccatggtgcagccagttccaatgctggacacctcaaccatcagggtgaaatctggggcctcagctttttaatttaattattttaattcttaatactttaatttgtgcatttcataagccccctgctcttggactgaattttgtgctttttattgaagaattttattgtttttatcttaaaatcagtttctattatccttggggagaccatccctaacaaagtacaggtgggatctcctgtgagtcattggctgggttctgattgctagatgtcacacccaccagcatcaccaaagtgactctgagatagaccggtcccttctcagcgttccagtcacttcaggaggaatttagttattgacttagtctatgacatctggctacatgtaggtagagaagaaagacaattttaaaaaggaaatcaggtcttttgcaactgtgcctccctctgtctgttttcacttgaatgggtaaataaccagcagctaggttttgaattcctaccttgttattctaaacagatgtccacattgttaattaaatctaaattatgagccttgctgagtggatacggtacttacacctgaaccaggattcctgggttctgttgttgacattgcccttcagcacctgtttggccagctgtataagataggactaatgactaggaagcctaccccaatgaatgatatactagatgaaatagtgttcaaaacctgtaggcactctctggctaaaaacaaactctgaggccaccagcagatcatctttaagctaagttactatttttcacctttttttttagacggagttttgctctttgttgcccaggctggagtgcagtggcacgatctcggctcactgcaacctccgcctcccaagttcaagcgattctcctgtctcagcctcctgggtagctgggattacaggtgcccaccaacatgcctggctaatttttgtacttttagtagagatggggtttcaccatgttggccaggctggtcttcaactccagatctcaggtgatctaccctcctcggcctcccaaagtactgggattacaggcctgagccaccgcgcccggcctatttttcactttaatttggcagctgagaatgcccaaaaagtgccagaagcatcgtggcatttccagaaccatggattctgcctttggacccctctctattaatattaaaactctgggccttcagatgtcaccctaatccactgccctaagacagaatttctggacaagatgggtaagggcttcattccttcaacaagtcaagtcatacttggcctctccctgagaatctgagcaggagccttataacctgtggtcattattttttctttctgtacagaaatagaaaagcattagaaataacttctaaccatcctctgaaaaaacagaaaaaatatcgaatccctctttcatgagaagtcttttggataattggaaaccttcatcactgaggttggccagcccctgccaagtgttgtgtaggcaaagcacttgttagtggcttcctatgaaatgttttagagatctcttcaccatactggtttcttctctttggttggtgtgggtaaaagaaaacaaaacatttcctataagctgaaagctgaccagcattctcttcttggtaacatctactactccaacctagaaaatttggattctagaccaaaaatcaggaaacatggctccttataaatctgtgcagctgccttatagtaccatcaaaggaatttcaggtgggctgggcggggccccgatcccagaattatcaactccacccatcatcatttggtcatgaagcatcctttcattcttcttcttcttttttttggggggggcggggcgggggagggatctcaaagttttagtcttccagaatccaaattaaaggttgcccctgatgggggccaggttccgccacagaacatcttagatgtcagccttgacctcacttagcagggattacagaaatgagatacattttgaaggagagttgtctgttatgttcactgtattctaagtgcctgggataaagctgtctcatgggtgctccatatatattcatatatatttgttgagtgaattaatgaattaagagtggctggcagagtaggcagaaaaagacactgcaaatggcataaaaattaaagtcctagctgagttctcaatggtaaaggcatcagatgtcttagcagtcaagctagaaattcatgacaatgagtattactatttgcctaatgacaactcattgctctccatgtaaatgtaatcaacagatgaagagaatataattgctctgcttttccactaaaactccatcttagtgaattttaaattatccagagatgtcaaactgccaaataaaaatatttcagtagtctttgcatcagcttaccttgtaccagaaacatttccaatttactatcaaattatagtaactgagcctgtgtgaagtatctcatcattttcgaaaggaacaccttgtgtgatgccagtgagcatttctaaaaagggtgtgaggtagaggtaaaaataaggtgagagaccatttcagaatgcactgttgctcaaaaaggtgatctggttctttcttcagagatttctacggggatagaaaatcgggagtctgccctcattaatctgtgactccacctcttgcatcaaatcaatatctatttgttgagcacttattgattaagaccttgcatatgtctgtccattttgatttgagatacaactttttgtgtgggttgaatgacaaatcactccaaacaaagctgggcacagagaatcagctaggagaccagttattcagggtccatttctcttggatgtaaaggagtcctgggtaaaatgtggctgtaacctaaaccaactagtccttgtgatttgtttctgccctctgtgtttcctgttgtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacagggaaaaaaaaaaaaaaaaaaaaacaaaaaactttttgcgcccgccgcgggcccctagaaaaaagccttctaaaaacccagtctcgtgtgcggcggcggcgggcccacatcaagctatcacggcaccctggcccatgcgtgggccataagaggacccggcggccgctggcatatgcggtgggttctccaccacaatcaaaaatggtcggctgcgcccacggccgtttggcaacacacagccaggagtctcgagcgcaaacgggaccatacgaggcgccagcgacgcgataaagtagccccagaggat

SEQ ID NO: 460231 - DNA, 3759 bp, Homo sapiens
ggcggcgggagagctgctggctcgcccggatcccgggagctgcctggaggcgggcccggcccggggaaggtgagcggctgcgggacccagcccctcgccgggagcgggcaccatggtgctgtcggtgcctgtgatcgcgctgggcgccacgctgggcacagccaccagcatcctcgcgttgtgcggggtcacctgcctgtgtcggcacatgcaccccaagaaggggctgctgccgcgggaccaggaccccgacctggagaaggcgaagcccagcttgctcgggtctgcacaacagttcaatgttaaaaagtccacggaacctgttcagccccgtgccctcctcaagttcccagacatctatggacccaggccagctgtgacggctccagaggtcatcaactatgcagactattcactgaggtctacggaggagcccactgcacctgccagcccccaacccccgaatgacagtcgcctcaagaggcaggtcacagaggagctgttcatcctccctcagaatggtgtggtggaggatgtctgtgtcatggagacctggaacccagagaaggctgccagttggaaccaggcccccaaactccactactgcctggactatgactgtcagaaggcagaattgtttgtgactcgcctggaagctgtgaccagcaaccacgacggaggctgtgactgctacgtccaagggagtgtggccaataggaccggctctgtggaggctcagacagccctaaagaagcggcagctgcacaccacctgggaggagggcctggtgctccccctggcggaggaggagctccccacagccaccctgacgctgaccttgaggacctgcgaccgcttctcccgtcacagcgtggccggggagctccgcctgggcctggacgggacatctgtgcctctaggggctgcccagtggggcgagctgaagacttcagcgaaggagccatctgcaggagctggagaggtcctactatccatcagctacctcccggctgccaaccgcctcctggtggtgctgattaaagccaagaacctccactctaaccagtccaaggagctcctggggaaggatgtctctgtcaaggtgaccttgaagcaccaggctcggaagctgaagaagaagcagactaaacgagctaagcacaagatcaaccccgtgtggaacgagatgatcatgtttgagctgcctgacgacctgctgcaggcctccagtgtggagctggaagtgctgggccaggacgattcagggcagagctgtgcgcttggccactgcagcctgggcctgcacacctcgggctctgagcgcagccactgggaggagatgctcaaaaaccctcgccggcagattgccatgtggcaccagctgcacctgtaaccagctgcccagctgcctcccttcttggacagccctgacccgtcctctgcaacctcctttctgtgcccctttcctcattctgacacccagaagacagtgacagatgtgtttgcaaggctgggatggctctctcatcatactcttgtttcttagaaataagcaagacagagcaggaaatggaatatgcgggtcacactgaggaatgcattttgctcatctgtgttattgaaggaggtgcttattaaatacagttcctatgcctgttttataggtggggttaggccagatgcagagaaagctaaatgtgggaatcatggatgcaaagaagaatttggctttttgaaaaacaagcatttcaaaaatgatgaaggaagtgaaagtatcctggatcaactcctagagttagagattgcccaggtggaaagaaaccttagccagcgttcaatcaagctcaccatgcagggcagtcacccggcagttctcaaactttagcatgtgaagagtcaccagcagattcctgggctcgcctggagacattcctagtcggtattcctggtcgaagcccaggagccttcctttttaacaagctgatgtagagggtggagcactgtatgtggagaaattccttctacaatattccacacaggtttttggccacagtccttgatggagtcccaaaaccatggtgcagccagttccaatgctggacacctcaaccatcagggtgaaatctggggcctcagctttttaatttaattattttaattcttaatactttaatttgtgcatttcataagccccctgctcttggactgaattttgtgctttttattgaagaattttattgtttttatcttaaaatcagtttctattatccttggggagaccatccctaacaaagtacaggtgggatctcctgtgagtcattggctgggttctgattgctagatgtcacacccaccagcatcaccaaagtgactctgagatagaccggtcccttctcagcgttccagtcacttcaggaggaatttagttattgacttagtctatgacatctggctacatgtaggtagagaagaaagacaattttaaaaaggaaatcaggtcttttgcaactgtgcctccctctgtctgttttcacttgaatgggtaaataaccagcagctaggttttgaattcctaccttgttattctaaacagatgtccacattgttaattaaatctaaattatgagccttgctgagtggatacggtacttacacctgaaccaggattcctgggttctgttgttgacattgcccttcagcacctgtttggccagctgtataagataggactaatgactaggaagcctaccccaatgaatgatatactagatgaaatagtgttcaaaacctgtaggcactctctggctaaaaacaaactctgaggccaccagcagatcatctttaagctaagttactatttttcacctttttttttagacggagttttgctctttgttgcccaggctggagtgcagtggcacgatctcggctcactgcaacctccgcctcccaagttcaagcgattctcctgtctcagcctcctgggtagctgggattacaggtgcccaccaacatgcctggctaatttttgtacttttagtagagatggggtttcaccatgttggccaggctggtcttcaactccagatctcaggtgatctaccctcctcggcctcccaaagtactgggattacaggcctgagccaccgcgcccggcctatttttcactttaatttggcagctgagaatgcccaaaaagtgccagaagcatcgtggcatttccagaaccatggattctgcctttggacccctctctattaatattaaaactctgggccttcagatgtcaccctaatccactgccctaagacagaatttctggacaagatgggtaagggcttcattccttcaacaagtcaagtcatacttggcctctccctgagaatctgagcaggagccttataacctgtggtcattattttttctttctgtacagaaatagaaaagcattagaaataacttctaaccatcctctgaaaaaacagaaaaaatatcgaatccctctttcatgagaagtcttttggataattggaaaccttcatcactgaggttggccagcccctgccaagtgttgtgtaggcaaagcacttgttagtggcttcctatgaaatgttttagagatctcttcaccatactggtttcttctctttggttggtgtgggtaaaagaaaacaaaacatttcctataagctgaaagctgaccagcattctcttcttccgaaggtattacaactatggaccctactagggagtcctgga

SEQ ID NO: 460232 - DNA, 1827 bp, Homo sapiens
agctctgaaatgttcgtacgcgcgaccgaccatccttacgccctggtgaccgcggcggggcgggcgcagtccgggagctgctcccatctgtgaagacagcggcggtcagcggggcgggcggagggtccccgcggagggcagctcgcagccccgaccccgccagggagcagccgcggcccctgtcgctccctcccctccgcgggcggcctgggggctgcgcctggggctggcggaggcggtgccggtggggaccggtggggggctcggaccgaacgcgccagcggcagatgcgtctccttctccatatttaaaaatcaatctgcgccccactcccggctccggagccaaactcaaccatctcgggctgcacaaagccagaggcgcgccggggggtttgcaccgggaaccggcaccgagtgacccgcccgccccagcccggccgcggcgcctgctctgcctggatgtggctcgagctccgggccgggcgcgcggggcgggggccctggattatccgtggcgcctcccgccccagcggagccgaaagttactcggagctgctttcctcgcggccagcgtcacctcggggcgcgagcttttctgccgagccgcggccccgcgcgtccctcccgccgcccagacccgcgcgtccttcccacctgctgtggccgaagcggctgccggggcggccgggccgcgctcccggagacagacgcgctgcgctccccccgccggggacccgctctccattcgcgagggcagcggccgagctgggaccgagttatcaacagattgcggggctgcggcgccggccggtgagtcacagccccgcgcacgagcggcccagcccggccagcagcgccgccgcctctgcgcgcacctcccgcggcgacagcggggacccggggccggaggcaggcgcgtaaccatggggaccggggcgggcgatggcggcgggcgggctcctgccgcagggtggggatggctcttccagccgggcggccgccgtcacactgcagagcgtatttaaagagacacctcgctccgcgctcgctccccagcaccagaccctcgccggaaaacgccgccgggcggactgcacgaccctgtgttattcccaaagacaatctccatccgtggagaagctgcaggaacagaaatatacacaagaaaatggatttggaaggaattttccatcctttatttaacattctcaagtccagatatgccagaaccgaggtgcacctgtcgtgaacccgtctgagtgacctggccgccctgactccctggacaccgttcccttggagcctcggagccccccctggtgtcccctgggtgatggtcctggacaagagggctgggaagaagcgggcagcaaggggaggattctgccccagacgtccccaggccgggggtccccatgggctctgccctgacgtcttactcctgcacccagcggctcccaccacagagactgctccagttgcaggttagaccccacttgcggttgtgtgttccagaagtctccgggcgctgtgtggcaggatgaggagctgcccccctggaggatcacgcaggcctctgggtggcattcagcagggttggctgcggcaccggctgaccacagggcccacctttccagtcccggcaggagagaagcgtctcaaccatgttgcaggcacacgggtgagggtgctgcctgcctccctgactcttacctccccaagagaggaaaacaaaagaaaaaaagataagaccaggaaatggaaataagacaaagaagaatgaaattttaaaatccgaacaaacccaaacatgctgtttcaaaac

SEQ ID NO: 460233 - DNA, 2234 bp, Homo sapiens
ttgtggttattacctctttggttgtgatcatcacctccttcgttgtggttaccacctccctggtttcaccacctccctggtcatggttatcactcccccgtttgcagttatcacctccctgggtgtggttatcacctccctggttgtgatcatcacctgccttgttctggttatcactgccctgggtgtagttatcacctccctgggtgtagttgtcacctccctggtcatggttatcactcccctggttgcagttatcactcccctgggtgtagttatcacctccctggttgtggtcatcacctccctggtcatggttatcacttcccttactgtggtcattacctcctccattgtggtcatcactcccctggtcatggttatcacttcccttactgtgatcatcacctccctctttgtggtcatcactcccctggtcatggttatcactttcctgattgtggttaacacctctctggttgtggttcttatcactcttattgtctccctggttgtggttatcaccttcctggttgtggctatcacttccctggttgtggttatcacctccctggttgtggttatcacctctctggttgtggtcatccctccttcattgtggttatcactcccctgggtgtggtcctcattcccctggttgtggttctcacctccctggttgtggttcttacctctcttgtttgtggtcaccacctcccttgttgtggttctcacctctctgattgtgagcatcacctccctctttgtggtcatcattcccctggttgtggttatcacttccctgattgtggttatcacctctctggttgtggttcttatcgctgttattgtggtcaccccctccctcattgtggttatcagctccctggttgtggttattgcctccctggttgtggtttttatctctctcattgtggtcatcagctccctcattgtggttatcacttccctggttgtggttatcacctccctggttgtggtcatcacctccctcattgtggttatcacttccctggtcgtggttatcacctccctggttgtggtcatcacctccctcattgtggtcatcattcccctggttgtggttatcacttcctttgttgtgagagaaagctggctacaaggactcttattcccaagaatgctacaacagaaacccatcataaacggagaagcaacatgcaaaggacatgtagcttctacagccatcaccatgaagacagacactgccaggacagcagggggccacatatgaatagcaccatgttttaataaaagacacagtaataacgtcaccaattgtgttaacaagaacaggaacaatacgttccatttctctactaagtctcatcatcatgactggcagaacattctgcaacctcacaatcacaattatgaagacagcatggaaaatggctaatgatccaatattcgctgagaaacacagggccaagatgtaactatcctctcatcaaaaccgtaggaattctgtgaatacagaagttcaaacaccggatggaaatggggagaaaatgaaaactgccttttttttagagtagtgggttcgtggaggatttgtctttaggcttttggtttgcatttgatgctgacacaatattgtttatccagtgaatgcaagtttttgttttgttttgtttgtttgtcttttaaagaggagagtggagaagaggaaagttctcttctgccatcgttcctcatttgtctgagaaacaggcaccgcacctggcccaatggaaaagaaattccagaagaagggaagagggaaggaatggagttgagtgtgtctggatctaaaggcttgctgctccgccctggcttcctgtccccacaggaagcacaccaggcctctctctctccccaactcactccaacgggtgacctccactgggcagcctgcctcaggaatgcctctcctctcatccttcttcaggcacagaggcccgccctccatacaacttccagaaagacagctctgcacacctaaagaacctcccagacccctgcatcaggacaacagcctctcctggcactcaggaccagcctcctcctagctgcctgcaaatttgttcccgaaacacacctgtcggtctgaacccatgcctttcaatcttgggtggctctctggtcagagaacctccacaaccctgggtgcaggtgccagcaacggcacgttggatgaagtgaacccccct

SEQ ID NO: 460234 - DNA, 4471 bp, Homo sapiens
ttgtggttattacctctttggttgtgatcatcacctccttcgttgtggttaccacctccctggtttcaccacctccctggtcatggttatcactcccccgtttgcagttatcacctccctgggtgtggttatcacctccctggttgtgatcatcacctgccttgttctggttatcactgccctgggtgtagttatcacctccctgggtgtagttgtcacctccctggtcatggttatcactcccctggttgcagttatcactcccctgggtgtagttatcacctccctggttgtggtcatcacctccctggtcatggttatcacttcccttactgtggtcattacctcctccattgtggtcatcactcccctggtcatggttatcacttcccttactgtgatcatcacctccctctttgtggtcatcactcccctggtcatggttatcactttcctgattgtggttaacacctctctggttgtggttcttatcactcttattgtctccctggttgtggttatcaccttcctggttgtggctatcacttccctggttgtggttatcacctccctggttgtggttatcacctctctggttgtggtcatccctccttcattgtggttatcactcccctgggtgtggtcctcattcccctggttgtggttctcacctccctggttgtggttcttacctctcttgtttgtggtcaccacctcccttgttgtggttctcacctctctgattgtgagcatcacctccctctttgtggtcatcattcccctggttgtggttatcacttccctgattgtggttatcacctctctggttgtggttcttatcgctgttattgtggtcaccccctccctcattgtggttatcagctccctggttgtggttattgcctccctggttgtggtttttatctctctcattgtggtcatcagctccctcattgtggttatcacttccctggttgtggttatcacctccctggttgtggtcatcacctccctcattgtggttatcacttccctggtcgtggttatcacctccctggttgtggtcatcacctccctcattgtggtcatcattcccctggttgtggttatcacttcctttgttgtgagagaaagctggctacaaggactcttattcccaagaatgctacaacagaaacccatcataaacggagaagcaacatgcaaaggacatgtagcttctacagccatcaccatgaagacagacactgccaggacagcagggggccacatatgaatagcaccatgttttaataaaagacacagtaataacgtcaccaattgtgttaacaagaacaggaacaatacgttccatttctctactaagtctcatcatcatgactggcagaacattctgcaacctcacaatcacaattatgaagacagcatggaaaatggctaatgatccaatattcgctgagaaacacagggccaagatgtaactatcctctcatcaaaaccgtaggaattctgtgaatacagaagttcaaacaccggatggaaatggggagaaaatgaaaactgccttttttttagagtagtgggttcgtggaggatttgtctttaggcttttggtttgcatttgatgctgacacaatattgtttatccagtgaatgcaagtttttgttttgttttgtttgtttgtcttttaaagaggagagtggagaagaggaaagttctcttctgccatcgttcctcatttgtctgagaaacaggcaccgcacctggcccaatggaaaagaaattccagaagaagggaagagggaaggaatggagttgagtgtgtctggatctaaaggcttgctgctccgccctggcttcctgtccccacaggaagcacaccaggcctctctctctccccaactcactccaacgggtgacctccactgggcagcctgcctcaggaatgcctctcctctcatccttcttcaggcacagaggcccgccctccatacaacttccagaaagacagctctgcacacctaaagaacctcccagacccctgcatcaggacaacagcctctcctggcactcaggaccagcctcctcctagctgcctgcaaattgtcacagaacacaccggcgagtttcacccggggaagaccctgcctgccagtgccagccacgcacgttggatgacagctgaccccctctgcaaccaaaaccttccaaaccatggccaagcagatggctcccttctctctcccatcccccatgactgtaaggacctcaaatacacagattgatcaagtgtacacttatggatgataaaatgacagggtctcttccctcattgtcccaagtgagggagacaggcaatgtacatataaaccagcaattaagcaagtataaattgcaacacacgctatgaaggtcctcagtattttcttggaataattccctttctccgccttatagtgtcaatgtcaggactttctccttcctctcctcctcccttctccaccccaaccacctgcagcttcccactgcctggaactgtgccttgcaagtcagtgctctctgcaaaaaaagtcccctcattatcttcctcgtacaaggcaataaggttttctattttcacttcttgcttcctgcttctgtttctcatttgttttttgtttgttgtaaatgtctctttcaatagtaggaaaaatgaacaagtttttcctgagggagaaagatttctacagtaacctagcagactccatatggggaagttgctcaaaatattgacttctttcccattcccaggagccaggaatccaaatggcaaatcatttctggcttgaacactcttcaggattgatgggcgctctcctggacagtctctagttgataactgctgagctgtgggatcgcacaggggtctcccagtgtcacccaagggggctgcactgattatccaaaggtccctcttggctccagtagtgatcagtcgcctagagtaatgaagcatactccgcttgctttccttgtaagaaaagagccccaagtctccatgcatgacaactatttacagataacagctacctagagtctctgtgcaattcactcattttaaatgcattgggatttattgcttttgacattaattgcactgagttgatatttgtctcatttctgagctcaagaagctgtcctgagatgtccagtgagcaaagcggagttaacacaccagtgctccataaaatggaatggcaagcagagccatataaataccctcaaaatgtagagcagcagggatgattcacagccctcaagtccaaacacattctcttgatttctgaagagcaagacagcaagaagatttcttagcacatcccacctctaagtctgtgctgacaggtgtctggaagctgtgtgtgagtatctcaagttagatcacatcaagacaaaccgggcttgttcattccatgggattggagctccgcttaattactctgacctcagaaacatcttccacatttgtagtggatggctgctcccctcccttagcacctacaagccctccctttgagtcatgttaatttgcccttgctgaatccttgttctgtaaatgtattcagaaggacatttctgcatgttctgtctcttcagattcttagctctctaaggatttctcatttgccagctcctccccatgctttctagcacatgctgggggtgggcacagaacaggatttcataggcaccgcacttagcgtaggtactgcctttttagcttgtcctaataaacacaccgtcccttcccccttctgcactcggtatgcaaatgctgtcaaaagctcagaactattgggtttctataattaaatctggggaaaaatctcatctgggattgtcttttctttctaaaaatactaagagctatgaagctattaaccagtagttctgaaacctggctggacagcagaataacaaaaagaggatttaagaaatctggatccccaggcccctgtctcctaaggattctactttaattggcctgagacggggctcaattatcagtagcttcacaaattttcccaggtgattccaatatgcaaccaagattgaaactctgagaaactgaataataaggggtagtgctatagtctctcagtgctgttttcccatctgtagataacaataacaacagtccctacccttctagagttattaggaggactgaacgtgatcatgtatgtaagttgatcctatgtgaatatttcccactattattatctatgtcatcctagatcctttttcttcttcaactctgcatatgaccaacatccttaaatcagtgatagcactcaaaaacacaataattctcaagacctagaatattaactgagaagaacctggattcaaattgtgtttcaacaatctgccagccaggaagccttcctctggtcacctgaacccagaatcttgaaatgacaagcattt

SEQ ID NO: 460235 - DNA, 1870 bp, Homo sapiens
ttagccaaaagcctgatagtgatatggacaataaggttcaggctgaggtggtctcagatggagatgaggaacttgttgggaactggagcaaaagtgattctgttattgtcctggaggcagcggtttctcttgggggtgaagacttgaccccattctatggtctgctgtctggtggccgggaaggaaaattctacagggagctagaagactacttctactattctcagctccgcagtcaaggcatcgacacaatggagaccagaaaggtgtcagaacacatttgcctgtcagagcttccttttgtcatgagagcaattggcttttacccatctgaagagaaggtgttaatggggcacctttggaagctgggtgcttgtctggactgtggagcacggagggtgcagccgtccctcatgaccgtgctgcagaagcacccctagatgcaagaagccccaagcagagtcaagaagcatctcagggaaatgttcctcatgtaaactgttgtttaaagtgcagttcgctttccttgtgtatatcgtctcttgagcatctcttcacatggcccagaccttaatagacactgaataaatatttgctgaccccagtgactaagattgaaaaccagaatgcagaactgttctagtaataattgagagacttgtatttcattggctttgcactaaaccaaatgctcagtaactactagtaaatcgagtaaaattaactagggcactaaatgattattctaagcttcttcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtgaagttaccaggaatgtttaaagcacaaaggactttgggtgtgtgtgcatgcacatgtgtgtgttttccatgaggcactgctttttatgcatttccctcccccctctcatctttagaacatttagacattaaagcaagtttctggtgagcaatggaattcacaaagttggacattccactgtttctgaaat

SEQ ID NO: 460236 - DNA, 1942 bp, Homo sapiens
gggttaatccaacacattctcggggtggtcggagctgtgcttcatgccctgggcaaagcccaccatctctggcctatctctgtgggctgtgattgccatggagttaggcaccattgttgcattactgagttttcttaatgcaaagccgaccatctctggcctatctccgtgggctgtgattgccatggagttaggcaccattgttgcattactgagctttcttaatgcaaagcccaccatctctggcctatctccatgggctgtgattgccatggagttaggcaccacatctcccaggaactcagggaaaggtgctcgagttgttaatacagatgctgttaatacatcctgtgtgccatccagggtgctggtgacagagggacacattgaaggattgtgccgacgtgctgtgaatgacttggagcatcacttttcaaaagtagcaaggtgctccatgaagagcactggcctaagagcccagagttcagaatttcaagtctggttcatccacacatccacacatgtaggctatgacagcacaaaagaaggagtgaaaactcagtttcgaagggacaaagtcaaggagacttcaaagatgagaaatgattgcactgggccttagagaggaagttcagcagaacaaggtgggaagggcacgatatcagagctgcttgtgcattcttcacctcccattgtctctgtctctctctttctcctctgcttcccctcaccccacaaccaaagtcaagagcgcagaccccatgatcacctgatacttccaagcaagcaggtgttcttttcagaagccagaagctgataacctgggctttctgatctaaccccagcccaaattcattgcaatggaggaattggggaggagattcttcctactgagaagtgggtgccaactctccctttcaaatttgttcatcaacaaactaaaggggatgccagaaatgtctggagcaatggaagaaccactggaataatgctcctgcctgattgtatctacttaacccactctccaagagccagaatcagatttcaaccgtatggaatcatctacaatgcagcagatgggtttacaagtctcttggtctcttcatgaagaaggcgcagcaatcgtgtcccaagtccttgaggacttcacagggtgttctagtgtcctgagaatatacctgcctaaggcactgtggtgggattctgccattcgagaatctcagactaagatcatctgtttcaacaagcatcgatcaagcacccacattgcagctggcactctgcttgatggtgagatgagtgtcaagaccagttccttattttacagggaaggccatcaaggttgaaagtggaaatttcccaaggtcagagacagagtggtagagccagtccatgcattctggtctcctgtctcctgttccagtgctcattcgtgacactgctgctctccctaacacttcatcccacgagaatactcttgagaatattgttcttggctgttccaaatagaaagatcatctgtccattattcaggtgatatgggctgaggtcttgcctcttctagtcacttggagaaagttccagaagcaaagactatgtacctaatattcctttaactctgttttcctggggccatatttaactgtgggtgttttctgtttcaactggtggcctgtgggaaagaggtagtgcctggcaggctggccaaggacacggggactaaagaacaatgttggaaggagatgggggcagcgtgagggaggaggcgaagacatattgtgggggagtcttcaccccaattgaagtcacctaaaatcactcctttgtaactagaagactaagaaacacttgtgaaagcaggtgaaagctgaaagcacatctgtgtgtgtgtcggggggaagtgactcaggagttgaggaagactgagctctacacccctcac

SEQ ID NO: 460237 - DNA, 1320 bp, Homo sapiens
gggttaatccaacacattctcggggtggtcggagctgtgcttcatgccctgggcaaagcccaccatctctggcctatctctgtgggctgtgattgccatggagttaggcaccattgttgcattactgagttttcttaatgcaaagccgaccatctctggcctatctccgtgggctgtgattgccatggagttaggcaccattgttgcattactgagctttcttaatgcaaagcccaccatctctggcctatctccatgggctgtgattgccatggagttaggcaccacatctcccaggaactcagggaaaggtgctcgagttgttaatacagatgctgttaatacatcctgtgtgccatccagggtgctggtgacagagggacacattgaaggattgtgccgacgtgctgtgaatgacttggagcatcacttttcaaaagtagcaaggtgctccatgaagagcactggcctaagagcccagagttcagaatttcaagtctggttcatccacacatccacacatgtaggctatgacagcacaaaagaaggagtgaaaactcagtttcgaagggacaaagtcaaggagacttcaaagatgagaaatgattgcactgggccttagagaggaagttcagcagaacaaggtgggaagggcacgatatcagagctgcttgtgcattcttcacctcccattgtctctgtctctctctttctcctctgcttcccctcaccccacaaccaaagtcaagagcgcagaccccatgatcacctgatacttccaagcaagcaggtgttcttttcagaagccagaagctgataacctgggctttctgatctaaccccagcccaaattcattgcaatggaggaattggggaggagattcttcctactgagaagtgggtgccaactctccctttcaaatttgttcatcaacaaactaaaggggatgccagaaatgtctggagcaatggaagaaccactggaataatgctcctgcctgattgtatctacttaacccactctccaagagccagaatcagatttcaaccgtatggaatcatctacaatgcagcagatgggtttacaagtctcttggtctcttcatgaagaaggcgcagcaatcgtgtcccaagtccttgaggacttcacagggtgttctagtgtcctgagaatatacctgcctaaggtttctcatctcttaaataagtataataagattcccctcgtctattgtgcagagaaaatttgtgaaggaaaaaataccattctgtgtgtcaagctgctctgaaaacataaagttgtctgtgattatgaaagat

SEQ ID NO: 460238 - DNA, 1362 bp, Homo sapiens
gggttaatccaacacattctcggggtggtcggagctgtgcttcatgccctgggcaaagcccaccatctctggcctatctctgtgggctgtgattgccatggagttaggcaccattgttgcattactgagttttcttaatgcaaagccgaccatctctggcctatctccgtgggctgtgattgccatggagttaggcaccattgttgcattactgagctttcttaatgcaaagcccaccatctctggcctatctccatgggctgtgattgccatggagttaggcaccacatctcccaggaactcagggaaaggtgctcgagttgttaatacagatgctgttaatacatcctgtgtgccatccagggtgctggtgacagagggacacattgaaggattgtgccgacgtgctgtgaatgacttggagcatcacttttcaaaagtagcaaggtgctccatgaagagcactggcctaagagcccagagttcagaatttcaagtctggttcatccacacatccacacatgtaggctatgacagcacaaaagaaggagtgaaaactcagtttcgaagggacaaagtcaaggagacttcaaagatgagaaatgattgcactgggccttagagaggaagttcagcagaacaaggtgggaagggcacgatatcagagctgcttgtgcattcttcacctcccattgtctctgtctctctctttctcctctgcttcccctcaccccacaaccaaagtcaagagcgcagaccccatgatcacctgatacttccaagcaagcaggtgttcttttcagaagccagaagctgataacctgggctttctgatctaaccccagcccaaattcattgcaatggaggaattggggaggagattcttcctactgagaagtgggtgccaactctccctttcaaatttgttcatcaacaaactaaaggggatgccagaaatgtctggagcaatggaagaaccactggaataatgctcctgcctgattgtatctacttaacccactctccaagagccagaatcagatttcaaccgtatggaatcatctacaatgcagcagatgggtttacaagtctcttggtctcttcatgaagaaggcgcagcaatcgtgtcccaagtccttgaggacttcacagggtgttctagtgtcctgagaatatacctgcctaaggaatttggctatagctggtattgggttcctcaaaccagcccacctgcgctatgggaatgtcaaaattgtcctggcaagctgagggggcatccagaggtcacccagctttcccctgaagcgttgctcagaggccactgtaccataaaagggagttcccatcccacactggttctga

SEQ ID NO: 460239 - DNA, 1266 bp, Homo sapiens
gggttaatccaacacattctcggggtggtcggagctgtgcttcatgccctgggcaaagcccaccatctctggcctatctctgtgggctgtgattgccatggagttaggcaccattgttgcattactgagttttcttaatgcaaagccgaccatctctggcctatctccgtgggctgtgattgccatggagttaggcaccattgttgcattactgagctttcttaatgcaaagcccaccatctctggcctatctccatgggctgtgattgccatggagttaggcaccacatctcccaggaactcagggaaaggtgctcgagttgttaatacagatgctgttaatacatcctgtgtgccatccagggtgctggtgacagagggacacattgaaggattgtgccgacgtgctgtgaatgacttggagcatcacttttcaaaagtagcaaggtgctccatgaagagcactggcctaagagcccagagttcagaatttcaagtctggttcatccacacatccacacatgtaggctatgacagcacaaaagaaggagtgaaaactcagtttcgaagggacaaagtcaaggagacttcaaagatgagaaatgattgcactgggccttagagaggaagttcagcagaacaaggtgggaagggcacgatatcagagctgcttgtgcattcttcacctcccattgtctctgtctctctctttctcctctgcttcccctcaccccacaaccaaagtcaagagcgcagaccccatgatcacctgatacttccaagcaagcaggtgttcttttcagaagccagaagctgataacctgggctttctgatctaaccccagcccaaattcattgcaatggaggaattggggaggagattcttcctactgagaagtgggtgccaactctccctttcaaatttgttcatcaacaaactaaaggggatgccagaaatgtctggagcaatggaagaaccactggaataatgctcctgcctgattgtatctacttaacccactctccaagagccagaatcagatttcaaccgtatggaatcatctacaatgcagcagatgggtttacaagtctcttggtctcttcatgtaattaacagccaagaagtctaaagcttgcattgtttacgtggaagatgtttcttgcccattcccatgccatgccatctgaaatcgctcctttttttattttttctgtgcagtttttttaactttgtgggatcctctgcatataaaactccattcaact

SEQ ID NO: 460240 - DNA, 1401 bp, Homo sapiens
gggttaatccaacacattctcggggtggtcggagctgtgcttcatgccctgggcaaagcccaccatctctggcctatctctgtgggctgtgattgccatggagttaggcaccattgttgcattactgagttttcttaatgcaaagccgaccatctctggcctatctccgtgggctgtgattgccatggagttaggcaccattgttgcattactgagctttcttaatgcaaagcccaccatctctggcctatctccatgggctgtgattgccatggagttaggcaccacatctcccaggaactcagggaaaggtgctcgagttgttaatacagatgctgttaatacatcctgtgtgccatccagggtgctggtgacagagggacacattgaaggattgtgccgacgtgctgtgaatgacttggagcatcacttttcaaaagtagcaaggtgctccatgaagagcactggcctaagagcccagagttcagaatttcaagtctggttcatccacacatccacacatgtaggctatgacagcacaaaagaaggagtgaaaactcagtttcgaagggacaaagtcaaggagacttcaaagatgagaaatgattgcactgggccttagagaggaagttcagcagaacaaggtgggaagggcacgatatcagagctgcttgtgcattcttcacctcccattgtctctgtctctctctttctcctctgcttcccctcaccccacaaccaaagtcaagagcgcagaccccatgatcacctgatacttccaagcaagcaggtgttcttttcagaagccagaagctgataacctgggctttctgatctaaccccagcccaaattcattgcaatggaggaattggggaggagattcttcctactgagaagtgggtgccaactctccctttcaaatttgttcatcaacaaactaaaggggatgccagaaatgtctggagcaatggaagaaccactggaataatgctcctgcctgattgtatctacttaacccactctccaagagccagaatcagatttcaaccgtatggaatcatctacaatgcagcagatgggtttacaagtctcttggtctcttcatgaagaaggcgcagcaatcgtgtcccaagtccttgaggacttcacagggtgttctagtgtcctgagaatatacctgcctaagggcgtatctgttagggagactcccatgagggaggggagccgagggaagaggctgagtgaggtgaagagagtgtgtttgtccctccagctgtgccagggtcttctcagcccttctcacagagggctgtctgtggacctctgttcctggaatcacccctctgcaccacccaaactccctgattatgaattacacaatacatccctaattcaagcat

SEQ ID NO: 460241 - DNA, 2487 bp, Homo sapiens
tccccagagcagcagcatgtcatctcctggagctgttagaaatgcaagttctccggtcccctttggatcagaaactaggagtggagccaagtgttcaacaagccctcctggtgattctgatgagaaccatcactttaaagagaaaggaactgaggctcagagatggcgcctacatcacaactcctcagtgcatcctgtggtcaagtaccagactgagtggctggaggactgctgagcatggtgactgcctagaggccttaaaaaaaaaagtgcttgaaagagaaggggacaaaggaacaccagtattaagaggattttccagtgtttctggcagttggtccagaaggatgcctccattcctgcttctcacctgcctcttcatcacaggcacctccgtgtcacccgtggccctagatccttgttctgcttacatcagcctgaatgagccctgggaggaacactgaccaccagttggatgagtctcaaggtcctcctctatgtgacaaccatgtgaatggggagtggtaccacttcacgggcatggcgggagatgccatgcctaccttctgcataccagaaaaccactgtggaacccacgcacctgtctggctcaatggcagccaccccctagaaggcgacggcattgtgcaacgccaggcttgtgccagcttcaatgggaactgctgtctctggaacaccacggtggaagtcaaggcttgccctggaggctactatgtgtatcgtctgaccaagcccagcgtctgcttccacgtctactgtggtcatttttatgacatctgcgacgaggactgccatggcagctgctcagataccagcgagtgcacatgcgctccaggaactgtgctaggccctgacaggcagacatgctttggtaagaaactcatcaaagatgaaaatgaatgtgagcaaaacaacggtggctgcagtgagatctgtgtgaacctcaaaaactcctaccgctgtgagtgtggggttggccgtgtgctaagaagtgatggcaagacttgtgaagctatgctgctggtccaaggagcacacctggactggccaggtaatagaggcagtagcataaccactggccgacagctgtgtttcccaaacttccctgctgctgagaagcacctggggcttttacgcttagcccctcccagaccctctcctggagccttggcttcagaggagctaagatggggacttcgagtttgtgtttttaacaaattattcccttttctgttggtttctactgcagacgttgaaggatgccacaataacaatggtggctgcagccactcttgccttggatctgagaaaggctaccagtgtgaatgtccccggggcctggtgctgtctgaggataaccacacttgccaagtccctgtgttgtgcaaatcaaatgccattgaagtgaacatccccagggagctggttggtggcctggagctcttcctgaccaacacctcctgccgaggagtgtccaacggcacccatgtcaacatcctcttctctctcaagacatgtggtacagtggtcgatgagtccagtcaagggacaaacacaggagcagtcaagacaagtgggacttggatccaggtggaagtgtgtgtgtggtttacacagcagagaggaaaagaaagggcctttcagataggaaacaacttcctcattatcttcatcattatcatcattatcttcatcatcatcttcatcttcttcatcgtcatcatcatcatcatcatcatcttcctcagcagcaagtttgttgaagatcagagagttgtggtgaatgacaagattgtggccagcaacctcgtgacaggtctacccaagcagaccccggggagcagcggggacttcatcatccgaaccagcaagctgctgatcccggtgacctgcgagtttccacgcctgtacaccatttctgaaggatacgttcccaaccttcgaaactccccactggaaatcatgagccgaaatcatgggatcttcccattcactctggagatcttcaaggacaatgagtttgaagagccttaccgggaagctctgcccaccctcaagcttcgtgactccctctactttggcattgagcccgtggtgcacgtgagcggcttggaaagcttggtggagagctgctttgccacccccacctccaagatcgacgaggtcctgaaatactacctcatccgggatggctgtgtttcagatgactcggtaaagcagtacacatcccgggatcacctagcaaagcacttccaggtccctgtcttcaagtttgtgggcaaagaccacaaggaagtgtttctgcactgccgggttcttgtctgtggagtgttggacgagcgttcccgctgtgcccagggttgccaccggcgaatgcgtcgtggggcaggaggagaggactcagccggtctacagggccagacgctaacaggcggcccgatccgcatcgactgggaggactagttc

SEQ ID NO: 460242 - DNA, 1621 bp, Homo sapiens
accactttctcttctcagaagccagacctgtcctcagaatgctacaaggtcccagtctcattccagacaccagaccaacttggactgtgcccccaaataacgtgtcatccctactatcttctgtccagtcatactcctattcacctttttcaattcatacaaaaccatatccaggccatcaccaatcattctatacgacaaatgtttcttctaacaacctcacaatatcaccccttaccacaagatcttccttcagcttaatctctcccactctaggttcccacaccgccactaatcccgctcgaagcagccctgagaaacatcgcccattctctctccataccacccccaaaaatttgcgccaccccaacacttcaacactattttgttttatttttcttattaatagtatacgatgtggaatggggttaaatcaagctaattaatatatccatcaccacaagtacttataattgttttatgagctcagattctcgactctcattccttgcgacactgaacctgatgttgtcacctcacctatctgcatgaaacagtgtatgaagtatgcatactgctagaggcaagtgagagcttggcatctggggaaggaggatgtatgagtgggcaggtgtgtgtgtgtatatgtgtgtatgcatgtgtgtgtgcactcatgtcttcagctgtgggaacatagcgttcaaggtgccatcttagaagcagaaagcaggcctcaatagacactaaacctgctagcaacttgttcttagacttccatccccagtactgtgaggcatacgtttctgttcttattaactgtccagtatcaggaatgttatgctgattaaatgagttaatgtatgtaaggtcttttgaaagttcctgggttttcgggcaactcaaagaatatgtgtaacctctactcaccaaatggccacttggctctattttaaatttaggcccagttagctacttgggatccatcatgaaggactggctctttcaggttcacatttgttcaccaagtgatgaacctcatttttgagtgtggagattggaacttagggaagtgatttgtaactttgctccagcttgagacttggcttggaaataacctccaaggcctggaataccagcattgacagccttacctgggtgcacctcaggagtatgctcaaagagtgagaaaggagtttggagacagaaagacggaagagttgatattccgctcacagatgtcaattttcaaagaaatttctgcccattatggatgcaccacaaatactaaagtctatgcaatatatattttgaaaagaatttttttcgtgaaactgtaattttcgttcataagagtatatttcctgacttagcattttattgactagattaaaattttgttccccaaaattagatgttctaaaggaaaggttcatttattgttgtttggagaataactttaaaatgctcatgacattagacccagggatcttattgaaatatattttcttaaagagataattgcacaagtgtattagtccattcttaaactgacataaagaactacatgacactgggtaatttataaagaaaagaagcttaatcagctcatggttccatgggc

SEQ ID NO: 460243 - DNA, 1291 bp, Homo sapiens
tgcctttttccaggacaagaagcagagatatattttcatttttccctctttttttcaagggcgaagcccagttgatatccaagagaagacctgatcaattctcatttaaagctagataatccttgctaaaaatcattttcataaaaggagtactacgctttcacccaaagaaaacaagaaaagggttcctgcaaggaagcagcattcattacctctcatcagggaacagcctgcacttctggtctggtgcaccacacggggaacagcccacctcagcaaaaaccggacactgggttttaagcagcaacgccgtctgaaacacaaaaccatcattatgtcttccagggctactgtcagttatctgaatggtatgacagccaaacttagaggtctctcttaaatcatctttttacaatcctagtctgctctccttcattaagaaatgctgtgctacttagaccacttaacattattttacttaatgctgtaatggaatgcatcatttatattagctactattagctggcaaggactcaggagacaaactataatggtaggtttttggtagcattgtatattagcatttttatagctgatcagccatgaacacttgctaaaaggttgcagttagtaatttagtcaaacaaataaaatgttttcccttattatttatttttatgacatgatatttttcttcattccatcattatttcccttggtttctgaaaggcaggattatgtttattctgtcttcagtgaaagcaaacagccatcctgtgaagcaggttggccaaaaagcagttcactttggcacaccaaggatcatacctggctgtgtatttacctgaaagacaacgagaatgcagcgtataatacaggtatctccattaaccatggccttctccataatgtcacaaatactgctaagatgatgtgcttcaattggatgctgcttgcccaagacacttgtgattggaagattggggttggtggcaagaagattgagttggtgtatgcacatcgcaccaacgtgccccctctggcagcaaagctgctgcttttcactatcttctccaccctgagagaaattactgtgctgaccaagcttgaggtggtcagcatagtaattctctcaatgcagactgaggtggaggataggagcagttctagctaagaacaccatggacttccactgttcttacccaaagttcaaggttttttaaaatgaataacaactctcaatttagtgtatgccttggcaatttccagggcctggaaatggttgtttttg

SEQ ID NO: 460244 - DNA, 701 bp, Homo sapiens
ccggatagcccagctatccttcgccactgccgtttttatgcacatgtatacatttagggtcggaagcccagttcgaatccaaaagaagacctgatcaattctcatttaaagctagataatccttgctaaaaatcattttcataaaaggagtactacgctttcacccaaagaaaacaagaaaagggttcctgcaaggaagcagcattcattacctctcatcagggaacagcctgcacttctggtctggtgcaccacacggggaacagcccacctcagcaaaaaccggacactgggttttaagcagcaacgccgtctgaaacacaaaaccatcattatgtcttccagggctactgtcagttatctgaatggtatgacagccaaacttagaggtctctcttaaatcatctttttacaatcctagtctgctctccttcattaagaaatgctgtgctacttagaccacttaacattattttacttaatgctgtaatggaatgcatcatttatattagctactattagctggcaaggactcaggagacaaactataatggtaggtttttggtagcattgtatattagcatttttatagctgatcagccatgaacacttgctaaaaggttgcagttagtaatttagtcaaacaaataaaatgttttcccttaaaacaaaaacaaaaaatgggcctagttggtcccaag

SEQ ID NO: 460245 - DNA, 378 bp, Homo sapiens
tgcctttttccaggacaagaagcagagatatattttcatttttccctctttttttcaagggcgaagcccagttgatatccaagagaagacctgatcaattctcatttaaaggtactcagaaaaaaaaaaaagatactgtaaaggatctttaagattggccactttgcaaatcccacagggttagcatcctgtaaacatttccttttgttgatatctacatgacaattgttgaaaactccaggagtctacatagctacttttcaccataatttttactaaagaaaggtgccttcaaaggttctcttacctactgtaattgaactctcaaggacgacatggagcctgaggttgtggaatacaaactcctaagacttaaac

SEQ ID NO: 460246 - DNA, 1421 bp, Homo sapiens
cagacatcagaaacaactctaaaaatgtggttctcccgcctgtcgattggaccttgcaggaagccccgcctcatcaactcagtcaagggctttagttggcccggcgtcggtgagtggcgggtcttagctccgccctggccgtccgctgcgctgcctgggtcggcgccgtttccagttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtgagcgagcgcgcccggaggctccggggagggcggggcggcgctggcgtgtgggagccgccggcgggcaggccgccggggcagcaggcgagttacctcaactcccggccgctccggaggttgccgggcaccgaggagccgccgactggggacaccagggcggggaaggcacgggacttgaacctctccccgactcgcccccaatcgcgttccctcccttcttcgttcttaacagccctgccccaaggctccctgaacggagccagatggaagttatagaggaatagatatagaagaaaccatctaagacctgaggacattgttacttcatttaatttttactataaccctatgagaggtattaacccagttttatagatttaagtgtcataaactggtttagtgctagggatgcactgaaaggcaggacgcatgttttggatttaagcctgagtctggctagagtgagaactgtactgttctgggtgtcagtgtgggtcatccttccttttcctttctgctcctttagcatgttcttcctcaagtatctgctgctgttttccttcaagagatctcgacatccttcctactgactacatttcttgttgttttgagacggagtcttactctgtcgcccaggctggagttgcagtgagctgacatggtgccattgcaccccagcctggacaacaagaacgaaactgtgtctcaaaaaaagaaagaaaaaaaaaaaagcaaacatttggaaatataatgtgactggaaaagtgtggtcagcattccgggcagcaccaatctgacatgacctcatgagggagtaagatgtatttgagaagcagccactggtttgttacaactggagtatgcgcaagaatagctggagattaggctggacaatagtagttataccaatgataatatttttcaagtatatcatgtgccaagaattttacatagattatctcatttaattcttgtgatacactatgacccaggtactgtttttatcctcattttatagatagtgaaactaagttacccactgagttaaatgatttgcccagagtcacagctgttaagtgacacaca

SEQ ID NO: 460247 - DNA, 841 bp, Homo sapiens
aggtggcgctgttgctttagccatcaagaaaggcaaggctggggacgccgcatccccgggtgcggagggcgatgcctaggggcgatgctgtgcctgtggcggccaaacagtgccacccactccgggaaacaaagccaagcgccggacgctagcttcctaggtcttccacgtgttcaacggaaattcacaaattctctagtagcagaagccaagaacaagttctctggatcacataggctcctctgctgcttcctcagaaacagagatggtacttggtgccgaagaaagagacagagactgggaaggagaaggaagtcagcagaaagaagaaagacgcacaggaaagagagaagggtagctaaaagaaagagtcagggagatggttccaggagaagaaaagaaagtcagttgctttctgagatcaggtgggaagtttatcctgtcaactccacctttagagtgctagtctctggagccacaaggactgaaactctgcttcagagacccaccactgatgacaaccatcaggctcaggaactgaaaagaaatggtgcaaatgtggccgagggacttgggttttacatttattgccgagtctggttttcttgagtttcagatgataaaattgaagcccagagaagcttgggagcctcaactattaatggaaaaaccataactagaactgagttttcctgagacattttttactattcattcccctgctcttgggccactccagggcactgagcacacttgctttggctatttggagaagaggccaatagacacaactggcttcatcttcagggacacccaatatctggcagccctcagccccagc

SEQ ID NO: 460248 - DNA, 3193 bp, Homo sapiens
gtcaaagttgattgaatcgggatggtattcaaaattcggagtatggttaatcctggaagatgccatcagcagtgttcagtgagcatgatggcaaaatcctggtatctcatgaaaccacaggaagatcatctttcagaacaaacaagaaataaagatagggcatttcttctaagacgctcaaatatccaaatcaccttgccttgtgccgtgggctacccagcggaggtatcaggctccaggctggtattggggagtgtctgcaaagagccctgtgatgtgacctgttatcagctcccacacagcctgcatcctgaaaggctggtctcactcctactgtgctcctgcaacagcaccaagtatatttccaggcaactggtgagcagggctgagaacttgccccagaccacaagtctcccagctgagaaagcacagctcctcagttgtcccacagagcctgcagtggcaatccacctccttcaaaagttctgtgaattctctcagctttcctggaacacttcatacaggatgggccaataatgcaaggactaatgggacttggtagagagacaacggcatccaatactggaagatcatctgtcagtggtgtgcaggatgcaagaagttgccgaggatgatggccggagggtagcttaggagcctactagcatagtccgtgtacaaaatgagggactgactaggggaaggctgtagagaaacacagaaacggaggaagatatgaaatatttaggagatagaattgagtggatttggtacctcattagatataatcaacggggaaggaaaaggtatcgaggataaatgtcaggtttctggcttggttaattgcattctcagtgttttcactcataacaataagaaatgcaggatcttgtagactgaattttgaccatccccattcatgtgttggagccctaaccctcaacatccctgggtttggagatggggcctttaaggaggacaggctagatgctgacagcttgatcttggacctcaagttttccgaattgtgataaatagatgtttataataaagccacccagtctgtggtatcttgttgtgatagctggacctgactaatacacagggcatgtggcaagtttaaggggaagatgtctttctgaaacatttgaatcaatcagaagttcttttggaacaactaaggaaagatgtcagcttgctgcctcaaaatgctgtttgatgacactggtttagaaaatagaaaacagatttttcttttctccgaagaaatagaaaactttcctctgtactccaagggatatacaggaagaatagaaatatgaatttgaactgtgactaagagtcagcatgtactttcccttctctggaaaaagaaaagaaaaaagctggagaagtaaagctcagaagcacggttgggtatggctgagttaagtagactacatgaaaaataaacagtcaacaatcttacagagaaaatgaattttgctctttgatgtaagaaaaagcccactcacctttatttttaaaatgtcctgagttgaggtaaacaatatctatttttgctattaaaaaattctatttctgtctgatatttttcccaattgatagaaatcagaagaacactcctagagaaattaacactaaaatgcaaaagcactgtaatagctcctctttgatattatgaattgactttaacctgatttgctctctaaatttcttaggttatttctgaattttgtttatagtttattagcatgttaaatattttttgtggttttgatttgcatacatatacaatattttggttatattaaaaataaaataactggtatgtgtttcctacctcctgatttgctttctgttactggtataagcctatttttacattgctgtcaggcctgtttagttaataggatgtgttagccagtgttttctgtatatacttcagaggctttagagttttgcagttcagcccattgcctttttaaattactaggttagagtggttttaggtttacagtgaaattaagcaaaaagtgtggagtttccacatactgcaacttctcccccttcccctaccccatccctataatacacagtctgcctcaccattgagatgccctaccatgaacaactataagccaataaattggaaaaactagaagaaatggataaattcctggatacatacaatctaccaaaattgaataattaagaaacagaaaatctgaacagatcaatatcaagtaacaaaattgaatcagtagtgaaatgtctcccatcaaagaaaaccccaggacccgatgccttcactgctgaattctgtcaaacatttaaagaagaacaatctgaacagatcaatatctagtaagaaaattgaataagtaataaaatgcctcccgtcaaagaaaagcccaggacctgatgccttcactgccacattctctcaaacatttaaagaactaacaccaatactctgtaaactattccaaaaattgaagagaagggaatacttccaaactcaatctatgaggacagtattaccctaatacaaaatcagacaaggacacaaccaaagaagaaaactacaggccaatatccctgatgcacatagatgcaaaaatctcaacaaaatattagcaagccaaattcaacagcacattaaaaataccattaaccatgatcaagtaggattcatcccaggtatgcaagaatgattcaagaatatggaaacccagctgggtgcggtggctcatgcctgtaatcccagcactctgggaggccgaagtgggcagatcacctgaggtcgggagttcgagaccagcctgaccaacatggagaaaccccatctctactaaaaatacaaaattagccgggagtggtggcgcactccagcctggacatcaagagtgaaactctttctcaaaaaaaaaaaaaaatggaaaccagtaaacttgatatatcacattaacaaaatcaagcacaaaacccatgtggttatttcaaaaatcagtagcattttatacaccaatagtaaactatatgaaaaagaaagaaagaaggcaatcccatttataacacctaaaaaaatacataggagtaaattcaaccaaggaggtgaaagatctctacaattaaaagtataaaacattgatggaagaaattgaatgaaaagatattttatgtacaagaa

SEQ ID NO: 460249 - DNA, 1408 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(10): n is a, c, g, or t
  misc_feature (14)..(15): n is a, c, g, or t
agntncntnnatgnngggaaacggcgggtgaaggcctggtgcatccaggtgaacagacagtctcacggactgcgaggcgcttgccagagcccagcgccgcagctcggagcacccccgcggtgcgggcagtcccgggacggtgccggctctttgggctggagctccgcaggctctttccgcccgtctgggccatgcagggccgggtagggccgggctgagtctactgagccggccgcgccgcgggggaaggagtttccggcggactcggctaggtgccgcttcctgtccccttctccgcgctgcctcacggtgcctgcacgggacgccgctcgatccccgagccccctcgccgtccccgacagcccccccggcgccatgcaatcccggcttctactcctcggggcacccggaggccacggcggcccggcctcgcggcgcatgcggctgctcctgcggcaggtggtgcagcgcaggccgggtggcgacaggcagcggccggaggtcagactgttgcacgccggctcgggggccgacacaggtgatacagttaatattggagatgtatcctacaagttgaaaattcctaagaatccagaacttgtgccacagaactacaatttgcctctaggcccagcaggtaatttgagtgtaaactcaggagcctattcatatccaccaaatccacactatacagcctggtgtccagggtacacagcagagataggagtttgcagaaaaggaatcttagaatataggatcaagctctttgggattattttgacatcggtttattattatgtggactcctggaaggagctgaccaaacgggaggtcgaatacattgccctgtcaagggacaccactgaaactgatctcaaacagcgacgagagatccgtgcaggcacagccttttacattgatcaggcaagttctgtcacactctagcccatgactgtgtactccaggtctatacaagattgatttttaaagtagaaagagagtagctcatataacagtaaaagattcaaagttcttacattaaaatgcaaattaaaaattttaaataatttatagtcaaattttaaaacaaagaatagaattatcagatataattttatagtataattttaccagggaatttttaaagagctctttgtgctcatgtacattacctataaatggtaatagcttcctcagtacttttacaccgtagctattttgagtaaatttgaagctttatggactctatttttattaaataatgactacattaataatagtttatattttagtaggttcagttactttaaatttttttttgcagtactgctttgactcttaaactgttacactgtataataccccttgaggatattctaattttgtaaatgaggacaaagacatccag

SEQ ID NO: 460250 - DNA, 650 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(10): n is a, c, g, or t
  misc_feature (14)..(15): n is a, c, g, or t
agntncntnnatgnngggaaacggcgggtgaaggcctggtgcatccaggtgaacagacagtctcacggactgcgaggcgcttgccagagcccagcgccgcagctcggagcacccccgcggtgcgggcagtcccgggacggtgccggctctttgggctggagctccgcaggctctttccgcccgtctgggccatgcagggccgggtagggccgggctgagtctactgagccggccgcgccgcgggggaaggagtttccggcggactcggctaggtgccgcttcctgtccccttctccgcgctgcctcacggtgcctgcacgggacgccgctcgatccccgagccccctcgccgtccccgacagcccccccggcgccatgcaatcccggcttctactcctcggggcacccggaggccacggcggcccggcctcgcggcgcatgcggctgctcctgcggcaggtggtgcagcgcaggccgggtggcgacaggcagcggccggaggtcagactgttgcacgccggctcgggggccgacacaggtgatacagttaatattggagatgtatcctacaagttgaaaattcctaagaatccagaacttgtgccacagaactacatttcagactctctggctcaatctgtagttcagca

SEQ ID NO: 460251 - DNA, 2289 bp, Homo sapiens
ctgtttccccaggctgctccccttgactgctatacgaggatgcctttcatcgtcagggcccctgtgtccactgctgtgacatttggtgaggaacagctcccttcctggagccaaagagcattcattgtctggccacaggaaaagcacgccacatgtcccctgacgacctgaagatgaatcctgactgcctggacatgcctgggcgggtgtacccatggcctgtggttgaaccagccacaccttgtctcttggccagaggctgccctgaggctgagggctgtgagtcctgggatctgctggggaagtccaaggcatatcgcaccagctgcccctagctgctgcctgcagctggaggccacaggccccccatgttgaagaagtgtcaccttcaaagggaggtcaccatgcagcagcatcatggctggaaaggaccagaggggaagtcacagggcagcagcagtttcctaaactcatcctttgccttctttctgagcctggcccttatctcctccaaggagacacaaaagcgcagcctcatcaccagccacatggtgatgcttccgaagagcctcctggtagctcaaagtgggatcaaagtgccccagggcgggcagcattgcagcgagacacggaacaacctcccgggcagtatgtgcaggagctcggcacttgctgggggcctcagcaagtcatttcgagagagcacagctgtcctctgcttgggggtttgcgacacagggcaacgggagtggctgaatatgcaacagcaaaggagactgcagccgtggagtcagggtcagggcaccgcagtcctcattctaaccaacgccactgacaagcagtgtgaccttgggcaagtcactctacctctctgagcctcagtttcctttcctgcaaaatgtcaataataaaaatacagttcctacctggaaggttgtttctgtgcataaatgttgtcagctgtcaaaatcataaaattcatggctgctccatcccagatcaagtgaatcagaatctctgggggatgggaccaggtctggttggtgttttttgtttgtttgttttgttttgttctgtttttgttttttaggtatcctgggtaatttttgttttctggttgtaaatatgaagactttttaaaaattttattttactttaagttccgggacacatgtgcaggtttgttacatagaaatttgaattgttctattgtcttttggcttctaatggggagagactcaatgccattataatcttggtcctttgcatgtagatatttcccctctttcctagtgggaagcttgtagaattttgtctcagtctgaaatgtaatcatcacatgccttcatgtaggtgtgctttcatccattatgctggtacctggtaagccttttcaatcggaagctcaaggccttcgtcttgaattatttctttgatgttttcttcctctgttttttctgttctgtcattctggggtgcctattattttcatgctggacttcttgaagttgtcccctcattttctgtatttttctttaccgtttgctctgcttatctttaacttctaagtcttctattgagtttatttctgctatcttaaggttatttttggttcactaaatgtttctttttttaaaaaacagtgtcttgttcagatttcctggagttaatatttttgctattctctttgaaaatctaaaactgaaaaattagtggttcctcctcctccaaagattttccctccctgcagtttgttttcttcaagttgtttttatatacttgatttttttttttttttggtctgtctttcgtgtacaaagttttacttcgctatcctggcaacccttgcctatccagtcatatttaaaattatgtactaagatgctgactgggcactctgattgcaggagtggtcttatcaagtgcaggcctcactggatgacagtgatgttcaatttttgctgcatgttggaatcacctggggagcttttattttttaggagagggagcttttcaaacccggatgtctgggccctccccagattaattaaatcagaatctctggagggtggggctctgggattggtattttttaaagctcccagagtggttctaattgcagtcagttgagaacgttgctccagggtgattgagttcagctgttttgagaaacaaccataacagtagaaacgtaagtagactctggaaacttgtagtcgtacctgtcaagtatggtatactgattcccaccctctaaaatagaaaatgtgggaaataatacagagtggg

SEQ ID NO: 460252 - DNA, 2170 bp, Homo sapiens
tgcactctggtactaacagacatgatgctgctgcatggtgacctccctctgaagatgaatcctgactgcctggacatgcctgggcgggtgtacccatggcctgtggttgaaccagccacaccttgtctcttggccagaggctgccctgaggctgagggctgtgagtcctgggatctgctggggaagtccaaggcatatcgcaccagctgcccctagctgctgcctgcagctggaggccacaggccccccatgttgaagaagtgtcaccttcaaagggaggtcaccatgcagcagcatcatggctggaaaggaccagaggggaagtcacagggcagcagcagtttcctaaactcatcctttgccttctttctgagcctggcccttatctcctccaaggagacacaaaagcgcagcctcatcaccagccacatggtgatgcttccgaagagcctcctggtagctcaaagtgggatcaaagtgccccagggcgggcagcattgcagcgagacacggaacaacctcccgggcagtatgtgcaggagctcggcacttgctgggggcctcagcaagtcatttcgagagagcacagctgtcctctgcttgggggtttgcgacacagggcaacgggagtggctgaatatgcaacagcaaaggagactgcagccgtggagtcagggtcagggcaccgcagtcctcattctaaccaacgccactgacaagcagtgtgaccttgggcaagtcactctacctctctgagcctcagtttcctttcctgcaaaatgtcaataataaaaatacagttcctacctggaaggttgtttctgtgcataaatgttgtcagctgtcaaaatcataaaattcatggctgctccatcccagatcaagtgaatcagaatctctgggggatgggaccaggtctggttggtgttttttgtttgtttgttttgttttgttctgtttttgttttttaggtatcctgggtaatttttgttttctggttgtaaatatgaagactttttaaaaattttattttactttaagttccgggacacatgtgcaggtttgttacatagaaatttgaattgttctattgtcttttggcttctaatggggagagactcaatgccattataatcttggtcctttgcatgtagatatttcccctctttcctagtgggaagcttgtagaattttgtctcagtctgaaatgtaatcatcacatgccttcatgtaggtgtgctttcatccattatgctggtacctggtaagccttttcaatcggaagctcaaggccttcgtcttgaattatttctttgatgttttcttcctctgttttttctgttctgtcattctggggtgcctattattttcatgctggacttcttgaagttgtcccctcattttctgtatttttctttaccgtttgctctgcttatctttaacttctaagtcttctattgagtttatttctgctatcttaaggttatttttggttcactaaatgtttctttttttaaaaaacagtgtcttgttcagatttcctggagttaatatttttgctattctctttgaaaatctaaaactgaaaaattagtggttcctcctcctccaaagattttccctccctgcagtttgttttcttcaagttgtttttatatacttgatttttttttttttttggtctgtctttcgtgtacaaagttttacttcgctatcctggcaacccttgcctatccagtcatatttaaaattatgtactaagatgctgactgggcactctgattgcaggagtggtcttatcaagtgcaggcctcactggatgacagtgatgttcaatttttgctgcatgttggaatcacctggggagcttttattttttaggagagggagcttttcaaacccggatgtctgggccctccccagattaattaaatcagaatctctggagggtggggctctgggattggtattttttaaagctcccagagtggttctaattgcagtcagttgagaacgttgctccagggtgattgagttcagctgttttgagaaacaaccataacagtagaaacgtaagtagactctggaaacttgtagtcgtacctgtcaagtatggtatactgattcccaccctctaaaatagaaaatgtgggaaataatacagagtggg

SEQ ID NO: 460253 - DNA, 1738 bp, Homo sapiens
tactgacgtcagctcactgtctccatagccggcagccctgggagctgaactcactagatcaatgaaaacatcaaccatgccagacgtgcctgccctgctccaagcctgccaaggagccaggggttcaggtgcagagccgggccatctgtcattaggctctgctgttaattgctgtgctaatgaacaagtcatccatctactcaacaaatactggcttggtcgtggccaccatgtcaaatgccagggctccagagatgacaacaacagggtccctaccctcaggggatcatatcctaccaggggagatagagaggtgaacaaacaggacaaatacaggttgacaagtgctaagagagaagtcagaggctgtgggaacagagaggaggagtatctaaccagcctggagtatctggaagacttcctgaaggaggagaaaacacctgggctaaatcttaaaggaagaccagaagctacccagggaaagaagtgaaggaaggcattataaacagagaggccaggagattccagcctcagcattcccagagaaggcccaggatctccctgagaggcccagttggtgtttgtggaatcatcactcctctggtgatcacgcagtttgcctcactttctaccatggagctctttgctaaaggacattctcctccagctgtgaaggaaaagcccaacaaaaggcagggtactttgttctaactgaggatgtctactgacacagccaagctgtaaagcagaccacggacggcagtgcagcggggagaacaactctacatctggttggaggtggagtaatgtccagtctgggcacagagagatggcaggtgtgcagctgcactcagcatgggatagagcaccacctgccaggccagaacagaaagaagggcgacggagactggcagagaaacagcaattactgctcagtgagaagtaaacagcgtctgcttccagaggctttacggaccagaaagcccacaggaaatagctcctgcttcccagcctggaggtcctcatgcactagccctccctgctgcaattttgatggtttttcgcatatttacagaattgtgcaaccatcaccatgatcagtcttagaagagttaatcacccctgaccccagaaaactctgtattcattagcagtcactccctttcccctttccacccctctccaacattaggcaaccactaatctactctctgtctccataaactggtctattttggacatttcacataagcctccctggatcccagtttaagcatcctggggtttgtctgcctgccagagccatggtgccactggggctacctgtcctgtgggatgacaaggcaggtccaaacctttgcctgctctcccatccattccttttgtgttagtccatgtgtctcccgactgttctctccaacaacaacacagactgacaaaacctactgacttggagtcaggaacagactttgctattttctggctgtgtgatcctgatgagtcccttgaacctcctggacttgttcctcagcctaaaaaccaagactaataaatcaagtctatctcacagccttacgtggggatcaaaaaacatggagcatgtgaacacacattgtacatcacgaagctgtgtgcaaataaatatcgtgtaactccagccctttttgagtttataaataaaagtgaaaacctcataaccctaagtcctccccttccttgcctctattcctctgtgctc

SEQ ID NO: 460254 - DNA, 1986 bp, Homo sapiens
tactgacgtcagctcactgtctccatagccggcagccctgggagctgaactcactagatcaatgaaaacatcaaccatgccagacgtgcctgccctgctccaagcctgccaaggagccaggggttcaggtgcagagccgggccatctgtcattaggctctgctgttaattgctgtgctaatgaacaagtcatccatctactcaacaaatactggcttggtcgtggccaccatgtcaaatgccagggctccagagatgacaacaacagggtccctaccctcaggggatcatatcctaccaggggagatagagaggtgaacaaacaggacaaatacaggttgacaagtgctaagagagaagtcagaggctgtgggaacagagaggaggagtatctaaccagcctggagtatctggaagacttcctgaaggaggagaaaacacctgggctaaatcttaaaggaagaccagaagctacccagggaaagaagtgaaggaaggcattataaacagagaggccaggagattccagcctcagcattcccagagaaggcccaggatctccctgagaggcccagttggtgtttgtggaatcatcactcctctggtgatcacgcagtttgcctcactttctaccatggagctctttgctaaaggacattctcctccagctgtgaaggaaaagcccaacaaaaggcagggtactttgttctaactgaggatgtctactgacacagccaagctgtaaagcagaccacggacggcagtgcagcggggagaacaactctacatctggttggaggtggagtaatgtccagtctgggcacagagagatggcaggtgtgcagctgcactcagcatgggatagagcaccacctgccaggccagaacagaaagaagggcgacggagactggcagagaaacagcaattactgctcagtgagaagtaaacagcgtctgcttccagaggctttacggaccagaaagcccacaggaaatagctcctgcttcccagcctggaggtcctcatgcactagccctccctgctgcaattttgatggtttttcgcatatttacagaattgtgcaaccatcaccatgatcagtcttagaagagttaatcacccctgaccccagaaaactctgtattcattagcagtcactccctttcccctttccacccctctccaacattaggcaaccactaatctactctctgtctccataaactggtctattttggacatttcacataagcctccctggatcccagtttaagcatcctggggtttgtctgcctgccagagccatggtgccactggggctacctgtcctgtgggatgacaaggcaggtccaaacctttgcctgctctcccatccattccttttgtgttagtccatgtgtctcccgactgttctctccaacaacaacacagactgacaaaacctactgacttggagtcaggaacagactttgctattttctggctgtgtgatcctgatgagtcccttgaacctcctggacttgttcctcagcctaaaaaccaagactaataaatcaagtctatctcacagccttacgtggggatcaaaaaacatggagcatgtgaacacacattgtacatcacgaagctgtgtgcaaataaatatcgtgtaactccagccctttttgagtttataaataaaagtgaaaacctcaaaagaaaaaaaaaaaaaaaagaaaaaaacactttggggcggccggggcccttggaaaggttttcgaagacacaagtacgaggggcgcacgggccccagaagggtagcagaaccggggaccataaggatcccgaggggaacaccggggcaggagaaaagcgaccaggactaccaccaaaaacaaacggcccggggggaacacaagggttcgagaaaaatcccgacggacacgagagcaaagcggggaaccacgaacgaaggtccgagagactccaaatcaataggccgcgcgg

SEQ ID NO: 460255 - DNA, 484 bp, Homo sapiens
ccaagactataaccacagctgaaatctaaggtttctgatggagaagaagaccttagtaatttggtttttgttttgtttcatagaaagaacactgaccataagatctgccctcttaacacatttttaagagcgtgatacaggattgttaacaataaggaacatggttgtttgtttttctcttaattgcttttttattacgaagctaaatgatttttaagagcgaaatttgaatataaagaaaataatagggcttttgacttttctactacaagaaggtggcttcctcaaggcatatgattgcaatccaagcgatgctatttccagatggtaaacaaccctcttttttacaatcatgttgcctacaagtctaggcagacaacccttggtacttacatacaccaggtactagagaaaagctggaaaatgcagccagtggtctcaaggctttcaaaaatgagaccttaataaagagttaatatgaact

SEQ ID NO: 460256 - DNA, 1434 bp, Homo sapiens
aattatgttttcacttgggccataaagacatttgggctaagtcacaggaaataggacgctgataaatgaggactgcagtttcttctcttgaaccattgaataccccccgcaggaagtacacgggagaaaataggagggagattgtttgcggagggctgcagctgagcaaaagaacactgaccataagatctgccctcttaacacatttttaagagcgtgatacaggattgttaacaataaggaacatggttgtttgtttttctcttaattgcttttttattacgaagctaaatgatttttaagagcgaaatttgaatataaagaaaataatagggcttttgacttttctactacaagaaggtggcttcctcaaggcatatgattgcaatccaagcgatgctatttccagatggtaaacaaccctcttttttacaatcatgttgcctacaagtctaggcagacaacccttggtacttacatacaccaggtactagagaaaagctggaaaatgcagccagtggtctcaaggctttcaaaaatgagaccttaataaagagttaatatgaactgagtgtttatccttgagcagggtctctctgaggttggccaaggatgggctaccgccactgaaggaggagaagggggatctgcttccaagatggtgtgctcactgggctctgaacgcttgcatgtcctcgtgacatggcccctgacttctcccagagggagtgatccccagagagagcaagaaggagactaccctgacttccacgacctagtcacagaagtcacacaccattgcttctgccatgctttatttcttaggagtgagtcactgagtctggcccacactcaagggggaggaattagttttcacctcttgaagggtggaacatcaaataatgcattatattttaaagccaccagagatctctttagaaaatggggctccacattggcctgtggggctagtgagctggtgaagggctccgcctccacccccgaggcgggaggcacctgcggaaactcagcgaggtcacacgatgtgcacatctccacttgacatgagacaccatggagatcaggggccatagtgttttccctcctccctgtgcttttagcagtttctagtcatttccttgtcatcctcacattgctatgaacacttagtaatgtgaacacaaacctcccagtggactcacatgctcagagggcactcaagactgggggaagcaatgcaatcacagcagcataaatattcatgaagtctgggagcctcaagacagaaactaggtcaccagggcctgctagtctggaggagctggtgtgctccctttagtgtgcatgtgaatgaagacaccgtcagagatattcctaggggccacaaattctcctgcatccttgcttgctcctccgaagggagggtcagatgac

SEQ ID NO: 460257 - DNA, 1488 bp, Homo sapiens
gcgcagccttaagagctgtaacacacaccgcgaggtggccattctaactggagtgagaggtctcattgtggttttcattgcatttctctggtgattagtgatgttgggcatttccttactggccatctccacagaaggcagaactctcattttggaaggtttggaaaaggcagagaggaatgttttgcctgttttgaacaacttgctggaaaacagagagatgcagcttgaagatggacgcttcctgatgtctgctgagcctttgactgacccttgtgtttacggtgtgcgagtgaaaagggtgttgttccaagaagatggagtagtgttggtgaagcagcatcatgtgtttggagagctgcagttgggagatggattggagcacagggatcataccaaaaaagagttggattcttggaaaattgtccgagttagtgaaaatttccgagtgattgccttgggcttgccagtgccaaggtattctgggaatccattagacccccctcttcgttctcgatttcaagccagggatatttattatttacccttcaagaaagacctacagcaattgctgttggaagagaaagctaggaggcacaagagagaatgcaaacagatctgaggggatctgatagagtacagacattgtccactacagtttcacaaagggcatggcggtcatgtctggagtgataaaaggcccaggaagtcaaagcacaggcaaatgtgtttaatcacaaaagggcctagtatctttggagaatgagaataagttgtatccctaaagcaagtgtgtgtggtagagggagaagtcagaccgctattgtgaaatgttttgcatgatgaatgaagtttcctggattttatgatatggaaaaagtggcttatcagacaatattaagttggtgggctatgaatgtgaccagacttatgttggaggaagacacctttgttggaagtgagggaatgactaggaagcttttgtaacactcagtgagaccctgtggaggagggcaccatccaagatagtgggaatactatcttaggcaagagacttatttttaaacttgtatgtatgtatgtatgtatgtatgtatgtatgtatgtatgtatatatgtatgtttcatgtgagtcagggagcctaggtattgttgacattgttctatacatccagaacagaatttctcctcctgtttatcaaatcttatacttttatcaaatctttttgtttttgcttagaacattttattttgaaaattcttatgaaatcttttgtttttgcttagaacattttactttgaaaattctcaaatgtaaaaaaaagttgaaaaacagtaaaacattcataatcccctcacctacaatcacccattattaatatattgccacatttgtttgcatgtgcttttttctttttttttttcctgaaccatttggaagtaaattgcagtcagtactcttaaatacttcagtgtgtgtatcagttc

SEQ ID NO: 460258 - DNA, 2395 bp, Homo sapiens
  misc_feature (5)..(7): n is a, c, g, or t
  misc_feature (12)..(14): n is a, c, g, or t
tttcnnnaaacnnnagacacccccaaaacacacaatctaagtcaaataatctctgcaaatgcaacctgcagacaagtcccccaactcttcctggaagagacagattctggaggcgcagaggcactgccaagggggccgcaacagaccccgaaagaccttgcgagcctgccatgtcccggtccggaacgccgcacgcggggcggggcggggcacatgcgcacgcgcggccccgcctcccaggcgtggggcggggcgggcgccggggcggggccgtgacgtcagttgcgcgcgtggctctggctgcgcaggaacagctggtgcctccgagggcggtcggcgagcgcgcgggcgtggggcgctggggggccggtcgggcagcgctgcgggagcagccgccggcaccgccgccttgcaccatcgcatcatgtccgggcagctggagcgttgcgagcgcgaatggcacgagctggagggagaatttcaagaactgcaggtagggccaggccacctggtcccgcaactctgctgcccgcggtgcagcgccttgcccttcctgagccccccggcccgggcggtggggacagtcagggcctagggagtgccccggagaggccctgggggcggacgggaggcatggaccagccccctcccatcacccggcgcttcagctcttcgtccacgtggggcgccgggtcgcagccccctcttccgccgccctcccactggctctctgctccacgcacccccttcgctgcagaaagttggtctgtggcctctgaggcaagttccaggcgtgttcatctgtgggggtggttcaaagagaacagcccagcccccacctctgcagggtctccccagatctcaccccgccccctcccatctgcttttggtagctcagctcccaccccgtgctctggcggggcagcactatcctgcagctctgttttgggaggtgtacttaagagctgttcaccttgaacctctaggttgtgcttggggattagggacccctatttcctgtctttgggggctctgacgctgctgcaggctgattttggcgtggagagcatctgtcagttcggacagctgagtagcctcacccagtgataggggaaactcccagctctatccttctggcccggagccttacacggggtggagtgagggcgggtgtaaggcgggggtcccctgagagaatggcattgctgctggtcacgggattgtttttcggggggttggctttgcctgaaattacattgcacactatcaccccagtcctctcatttggagcagtgacattgtccctgtccatgtacctctttgatgcaagggccttgaaggccatggtaaagattttggcttttactgctaatgacatgtacatccgtctggctgctgtgtatagaatagacatcagggagacaggctcgaagcaagaagatcagcattatttcattaataaccctatgaaattgatcctagaatctctgttttacagagtcactgtggcactgattggccaggtcacggtcacatatctgctcctgaagcctaaaagtgggatcagtgccaccacactacatgaaacgagttggggagggatggtcccatgaaggaaaatcaaaaagctgggttatgggatccagtttttcggacccaaggagtattatgagggtgactggtgtggcagccagcgcagtgatgtgggccgcatgtattacagcaacggcgacatctacgagggacagtgggagaacgacaagcccaacggggagggcatgctgcgcctgagtcaaaatcctagaccctgatggtgtgctggcggagccttggccatgttcaggaagacagaggaaggagattgatgccagagaacacaaacgcttcaggagaaattcaagcctgtgtcacccgatcgctcagaccagtgcggctctggctggaggagtcagcagcagctccaggcatgaccccggcaccctcatagggcccctcactacccccagcactgggtcatttcttgccaataggaaggctggtgcttctctcccaggctgtcctcgggaccctcttcattctctgatctcatcctggaatgcatgagaataaagaataaccaagtggtataagcctgggcctatgggataaggatggggcactcgagggggctcagcagggctttcaggtttagaagagggaagacctgccttggctgggctgcctgggtttagcttgggggagtaagggcaggtcttaggccgggtgcagtggctcattcctgtaatcccagaacttgggaggccaaggtaagaggactgcctgaggccaggagttcgagaccagcttaggcaacatagcaagaccctgactctacaaaaaaaaattttaaaatata

SEQ ID NO: 460259 - DNA, 671 bp, Homo sapiens
atgcgggacgatgatcgactttggccgtgacgaggcccctgagcccactcagttccccattcctgaggtcaaaatcctagaccctgatggtgtgctggcggagccttggccatgttcaggaagacagaggaaggagattgatgccagagaacacaaacgcttcaggagaaattcaagcctgtgtcacccgatcgctcagaccagtgcggctctggctggaggagtcagcagcagctccaggcatgaccccggcaccctcatagggcccctcactacccccagcactgggtcatttcttgccaataggaaggctggtgcttctctcccaggctgtcctcgggaccctcttcattctctgatctcatcctggaatgcatgagaataaagaataaccaagtggtataagcctgggcctatgggataaggatggggcactcgagggggctcagcagggctttcaggtttagaagagggaagacctgccttggctgggctgcctgggtttagcttgggggagtaagggcaggtcttaggccgggtgcagtggctcattcctgtaatcccagaacttgggaggccaaggtaagaggactgcctgaggccaggagttcgagaccagcttaggcaacatagcaagaccctgactctacaaaaaaaaattttaaaatata

SEQ ID NO: 460260 - DNA, 1063 bp, Homo sapiens
tgatttagaaggactaatagggccatggtattcaggatagatttgaagagggagaggctagctctatacctgtgtgccctcccctcacgcacatgcacctgctcacacatgcacataggcccccagtacctagcaaactgtcaggctactgtatggcacctaaattataatgtccttcgggaattatatctgcctttgcatgttttagtggccctgccccaattatcataccatcttggtgaaaacaatgtctggctagtagttccatggcaccaacattgtgccatagttggccaagcatttaatggtctatgggtcatgaggttggggggtgctggtgttggtgatgcacacacggttactttgccctggattctcccctctgtcaatattgacctgcctctgtttcccctagggacatggttgggcaggtaccggatagatgctgtcactgctgaaaaagaaaaaaatatccaaagtattcacgttgtacctgctgagtgccagtactgcatgctctggggattccattcctgcccctatggaagaggggtcaacttttccaaaacatcatcttctagaggaagaagctgaagcccagcaaggaaaagtaacataacgaagatctcagcagaatgacggttatctgagcatctatattctggggttgcaaaaagaacaagaacgtagggttcaatggacctgagttccaggcctcactctgtcaccagctgactgtaagaagcccacccacctccaccttctctagatcacatgttttatggccgcctcaaaggcgtgaagcaggtgagtcgtgctgcctctgccaacatctgctttgtgagcctgggagtatttcacggagatgtttctctcgacaggtttatggctggtcttggctcagtgccttgaaaacactgatcatgtgatgaaacgagaatgtcatgctgcgggccatcaataaaccacactggcattcccgctcccaccccgacaccactccacccatgcaatttccctccccttcagcctcctccctccccacctcccaaagatatccaga

SEQ ID NO: 460261 - DNA, 706 bp, Homo sapiens
acatttccaccatttcccgcctcaccatgcctcagaggactacaggctccccaagacgggacatggttgggcaggtaccggatagatgctgtcactgctgaaaaagaaaaaaatatccaaagtattcacgttgtacctgctgagtgccagtactgcatgctctggggattccattcctgcccctatggaagaggggtcaacttttccaaaacatcatcttctagaggaagaagctgaagcccagcaaggaaaagtaacataacgaagatctcagcagaatgacggttatctgagcatctatattctggggttgcaaaaagaacaagaacgtagggttcaatggacctgagttccaggcctcactctgtcaccagctgactgtaagaagcccacccacctccaccttctctagatcacatgttttatggccgcctcaaaggcgtgaagcaggtgagtcgtgctgcctctgccaacatctgctttgtgagcctgggagtatttcacggagatgtttctctcgacaggtttatggctggtcttggctcagtgccttgaaaacactgatcatgtgatgaaacgagaatgtcatgctgcgggccatcaataaaccacactggcattcccgctcccaccccgacaccactccacccatgcaatttccctccccttcagcctcctccctccccacctcccaaagatatccaga

SEQ ID NO: 460262 - DNA, 1509 bp, Homo sapiens
ggattagtgtttatatgcggcaagtactgcagttagttaataatgtcaagatcattgagcttccctaatgaaagagatacacaacatcaactctccatttcacaggatttcaggggagaaacggtggattttcacaagagccgcaaaactgccggttctgtgaaaaagaaattgcttcagcagctggaatccaggaggacaaataggtacactgattatatcttcattgttcaccagagccacagcactcactatcattcatcctcacctagccacgaattctgcccttttattcaacagccatcatcttcagtcttgagctgctctttgggccaggagtgggccaatgtggaggccatatgcctgcttcccccttccctttctcaggactctgcatccttaaaatacacccctgctatttgctcaactggatcccatctgagagaagagacccggacaagtcactgataggaagagtgaattggttgtcgccttttaattttttcagtgaggatgggaagagcttttattgacaaggctgtaatgcaaatgtgattctatcacaatgcgttattggcattcttattatctggctctgctgtaatcttgccctcagctccctccccaacctatcttcttttatcctttcactgattgttctagtagaaaaactgcagactacaatactctgtggattcatggttagaaatatatatccacacttctgattaaagactagatgcaacggattgtagtttcgtattttttcttccctccgtattgatcacatttttctcccgtcattgagagcaagagctaacatctatgggcacttcctatggctctgtgatgtcatttccttttgtagctattagttccctgcagcgtctgtactttactccacccaggctgcctgataacagatgtgatttccagctgtgtctatataccaaccatacacacagataatgaagctgttcacaatggcatgagagtacagaagagaaactagagcccatgaaaaggatgcttacctgccagagaactctgcaagtctgtgctgttggaagaaagagagaagtctatggaaagccctctcttatacacagagctgcatttttcttcttaggtgtgtgaagtacagaagacgcttatcaaagtaatgcattggacacatcaaaattgacaaacgacttacttaacaaaagatatttgaatgcatctgtttctacacttgtgtgatgccattccttctgccccactcttcacctgaataatttccatgggggctcagccatgttgaagcatgtatgtcaaactgatgtaagagtttgacagaaatgtatttgcatgaattgctgaagagcctcctgagagaatactcgtattagggtagaaagaatacaggtgctgaaatgagctcaacccattaacactatttattgaaataaaaaagtgattctgaggatagcatgagtttatcactagcagttgtctcattccaattcc

SEQ ID NO: 460263 - DNA, 271 bp, Homo sapiens
ctcatggtctgatcttgagtatcctgaagtccaggaagggcgtcctgaactccttcttcaacctggaatgctgtgtgagcggcacccacagcatggacctggtggccctggcaccctttggggagtataccgtgctgccggggctggactgcaccttttctaagtgcgtgcctgagcccctgccccgccagtcctcccaccaggctccccagggcaccggggctggctgagctccgctcttgcttgggtatgggagggacaggagaccatt

SEQ ID NO: 460264 - DNA, 1851 bp, Homo sapiens
agcggccgctcgcgatctagaactagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggccgaggctctagctgggcccagcctactctgttccacccgtgtcgggggtaggctgggaccgtcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagccaca

SEQ ID NO: 460265 - DNA, 1600 bp, Homo sapiens
tcgctccgcctccggcctcctccgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggccgaggctctagctgggcccagcctactctgttccacccgtgtcgggggtaggctgggaccgtcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagccaca

SEQ ID NO: 460266 - DNA, 1511 bp, Homo sapiens
tcgctccgcctccggcctcctccgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggccgaggctctagctgggcccagcctactctgttccacccgtgtcgggggtaggctgggaccgtcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagccaca

SEQ ID NO: 460267 - DNA, 1832 bp, Homo sapiens
tcgctccgcctccggcctcctccgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggccgaggctctagctgggcccagcctactctgttccacccgtgtcgggggtaggctgggaccgtcatttcttctgacagatttcagtctggcttgaaatttggggatgttaatgagggtcctctggtttttggtaaccagggccaccttctcagttcttgtgtctgttattggagtctggccagggttgacttgagctgagacaccattatctgggcgaacacaagtccgc

SEQ ID NO: 460268 - DNA, 494 bp, Homo sapiens
gtggggaacagaggctcacgcctgtaatcccagcagtttgggaggccaaagtgggaggactgagccagggaggtcaaggctgcagtgagccctgatcatggtgctgcatgcactctagcctgggcaacagagcaagaccctatctcaaaaacaaggacaaaaaagtaaaactgcttgtgtgaatgtgtctgtaggataaacaccagcaggggaaattgctggatccaaggtctggacagacaggacttccgtggagggctttatgtgatgtaagaagagtccaattctgaattccaggttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgag

SEQ ID NO: 460269 - DNA, 2463 bp, Homo sapiens
tcgctccgcctccggcctcctccgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggccgaggctctagctgggcccagcctactctgttccacccgtgtcgggggtaggctgggaccgtcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagccacagctcccagagccatctttcctgccttgaggctgtcctgtccttcctgccttggggctccagcatctgctgctgttgtctttgtcttgctccgggcccagcctggatctgcagggctcctctcttctcaccctctggtctctgttcaaattgcccctcctaggatgttccctgaccccaccctcccgagccccagcctccctctgtagccagcagccccacctgcatttgctgtgtcaccagactgttctctctggggacacctgcccatcagacgcctgggagagaaattcagattccacagggttttattgtggttttgtgctcctaggaccatgagggaatgcagcttccttaaagtacaaaaatctttatcattgacatttagggtttcatcaattctgtatcccagggagaaaggcagcaagacccaggctgccccctctgggtgtgagggaccggcttggtgaggagggggcttgggggcattgacctagcaggaggccctgactgcccccactcagcccagaaaccacctgggaggcttctgtcttccacggaggggccactctctcatgcccaaaaatatttacagctaggcgttagggtatt

SEQ ID NO: 460270 - DNA, 1853 bp, Homo sapiens
tcgctccgcctccggcctcctccgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggccgaggctctagctgggcccagcctactctgttccacccgtgtcgggggtaggctgggaccgtcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagccaca

SEQ ID NO: 460271 - DNA, 1695 bp, Homo sapiens
tcgctccgcctccggcctcctccgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacagctccagatcctgtttgcgggggaagccacacatcgcacgttttactccacgacgcacggggctctgctgtcgggatggagggaggccgaccgcctcctcagtctgtgggccccgcaggtgcagcagcccaggccgaggctctagctgggcccagcctactctgttccacccgtgtcgggggtaggctgggaccgtcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagccaca

SEQ ID NO: 460272 - DNA, 1364 bp, Homo sapiens
gcatgcctgtaatcccagctactcgggaggctgaggcaggagaattgcttgaacctgggaggcggaggttgcagtgagccaagactgcgccattgcactccaacctgggcgacagagtgagactccatctcaaaagagaaaaaaagaagaagagtaaagacttctcttgctcctgtatttatgaggggcttcaactgcagagggggccagacaggccctctccctgtggcagggtggctgccaggtaccaggtgcaggggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggccgaggctctagctgggcccagcctactctgttccacccgtgtcgggggtaggctgggaccgtcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagccaca

SEQ ID NO: 460273 - DNA, 2527 bp, Homo sapiens
attttttcctcttatcagtatgaagagagggatacactggctcacagtgccccacttttaactgaaaaagggaacaatgaggtcttgacatggttttacaaagagaaatgcaaattgtcaccctcactcagtggagcgagaagataggagaactgcagttggccatgcaatcaacctttaatcggttggggtttaggatccagtggagaccaggcctgggttctccaagttaataaaacccagtcaggacctgggagtccaagaaggaaaaggtctctggaaatacttgctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaagttgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagagtcacaccaagcctaggctggtcttgaactcatgggctcaagccttgggcacctaaagtgttgggattacagatgtgagccactgcacccagctagaaccttccttctgaaatgtttgtcttcttctcagtcgtcgtgggatctggaatggtagaaatttaagaagaagaaaaaaaggcctctgctttccaatagctttcgcctggccagagtccaggcttctgagaatttcaatttaatctgtggtggggacaaaggatcattataaactaattatcacttcattgctgcttctggtgacttaatatgatcagcacttcactaatggagagaaatgtaaaaaacctaaacaagtaaacaaacagaatttcctactagagttactgatgatgagttgtaggggagataaagatgataaatcccctcacattcgatcatttcagtcagtgcaccccttggccccaactgctaccatcacagtctatggcgcttctgccccgggagagccccttccatcccctctctcagggttcattccgcacgccccttcttctcctgctccgtgctagcatgcaccctttctcttctccttgtctggcatctgtttccaaatcctgcattacttttttgtgctcatcctccctgcctcctgtcatcctgctgccctgctcagccaagagcagagagaccccgattcgaatcctagctaatcactacctgcttgctggatgacgccaggcaagtcccttcacttctcggagcctcagttcctccaactcttaaatgggactgctaccaccaagttcagaccattcctcctcctcctcatccagggagcgtttacagagcacctactgtgtgcttgccacagggctgagctttagctcctttccagaagtactgtatggattgctgggtacagagcaggttttcaataagtgtcatttcccttttgtgccctaatgacctcttttctgttgcaagtgttagaaacacaattt

SEQ ID NO: 460274 - DNA, 2437 bp, Homo sapiens
agcctgtatctagagtatccccggcagtgaactttaacagcttatacactcgagacacccttgacgggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaagttgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagagtcacaccaagcctaggctggtcttgaactcatgggctcaagccttgggcacctaaagtgttgggattacagatgtgagccactgcacccagctagaaccttccttctgaaatgtttgtcttcttctcagtcgtcgtgggatctggaatggtagaaatttaagaagaagaaaaaaaggcctctgctttccaatagctttcgcctggccagagtccaggcttctgagaatttcaatttaatctgtggtggggacaaaggatcattataaactaattatcacttcattgctgcttctggtgacttaatatgatcagcacttcactaatggagagaaatgtaaaaaacctaaacaagtaaacaaacagaatttcctactagagttactgatgatgagttgtaggggagataaagatgataaatcccctcacattcgatcatttcagtcagtgcaccccttggccccaactgctaccatcacagtctatggcgcttctgccccgggagagccccttccatcccctctctcagggttcattccgcacgccccttcttctcctgctccgtgctagcatgcaccctttctcttctccttgtctggcatctgtttccaaatcctgcattacttttttgtgctcatcctccctgcctcctgtcatcctgctgccctgctcagccaagagcagagagaccccgattcgaatcctagctaatcactacctgcttgctggatgacgccaggcaagtcccttcacttctcggagcctcagttcctccaactcttaaatgggactgctaccaccaagttcagaccattcctcctcctcctcatccagggagcgtttacagagcacctactgtgtgcttgccacagggctgagctttagctcctttccagaagtactgtatggattgctgggtacagagcaggttttcaataagtgtcatttcccttttgtgccctaatgacctcttttctgttgcaagtgttagaaacacaattt

SEQ ID NO: 460275 - DNA, 2421 bp, Homo sapiens
atctttgcaggacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaagttgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagagtcacaccaagcctaggctggtcttgaactcatgggctcaagccttgggcacctaaagtgttgggattacagatgtgagccactgcacccagctagaaccttccttctgaaatgtttgtcttcttctcagtcgtcgtgggatctggaatggtagaaatttaagaagaagaaaaaaaggcctctgctttccaatagctttcgcctggccagagtccaggcttctgagaatttcaatttaatctgtggtggggacaaaggatcattataaactaattatcacttcattgctgcttctggtgacttaatatgatcagcacttcactaatggagagaaatgtaaaaaacctaaacaagtaaacaaacagaatttcctactagagttactgatgatgagttgtaggggagataaagatgataaatcccctcacattcgatcatttcagtcagtgcaccccttggccccaactgctaccatcacagtctatggcgcttctgccccgggagagccccttccatcccctctctcagggttcattccgcacgccccttcttctcctgctccgtgctagcatgcaccctttctcttctccttgtctggcatctgtttccaaatcctgcattacttttttgtgctcatcctccctgcctcctgtcatcctgctgccctgctcagccaagagcagagagaccccgattcgaatcctagctaatcactacctgcttgctggatgacgccaggcaagtcccttcacttctcggagcctcagttcctccaactcttaaatgggactgctaccaccaagttcagaccattcctcctcctcctcatccagggagcgtttacagagcacctactgtgtgcttgccacagggctgagctttagctcctttccagaagtactgtatggattgctgggtacagagcaggttttcaataagtgtcatttcccttttgtgccctaatgacctcttttctgttgcaagtgttagaaacacaattt

SEQ ID NO: 460276 - DNA, 718 bp, Homo sapiens
ttttgctaagaagccgcagtgatgttgacgcggctggtcctcagtgcacacctgagtagcacgacctctccgccctggacgcacgctgccatcagctgggagctggacaacgtgctgatgcctagtcccagaatctggccccaggtgactccaacaggcaggtctgcctctgtcaggagtgagggtaacacctcctcactctggaatttctcagctgggcaggatgtgcatgccatagtaaccagaacctgtgagtctgtgctgagctctgccgtctacacccacggctgtggctgtgtgaggtctgccacaaacattacctgtcagtcctcaggacaacaaaggcaggcggcccggcaggaagaggagaactcaatctgcaaggcccatgatagtagagagggccgcctgggctaccccctcagtgcccatcagcctggttccggtggtcctaactagccctgtctccttgccaatagccctgtgctccccagccccctcccccatgcagacggctgctatgacatccctgttccttaaagtgcggggttcctcgctgccttctcctccctaactggcaccctgtgcaaacctgctgcagagaacagtgtcttgggcagtgcgatagtcctccagttcaccaacagtaaaaatggtctcaatggggagagatgtctgactgcaagcgctgagtccttccagaggagggctggaggga

SEQ ID NO: 460277 - DNA, 2151 bp, Homo sapiens
ccctcccacccttcacccccagggtcacacgcgccgcgcgtccctgggagcgcagagcgttcagccggtattgcccagcgggtgacctgcctgcgcgctgctagagccacgccacctccctcctctcctctttctggtcctctcctgccacctgagcgcagtgcccaacttaacaccgcttcttctcactttttaggaccgcgagtaacccagtacccgcggtgaaggttttgggtcgactttagagtttagttaggagctgcatttctgagacagcttgataacttctttctgaagaaagaaaaaggtgctttcgctggggttgctgaaaatgttagaattctggctgcttttccacaggactgttgcggtttgctgggggtccactgcagtccttagtcatttcgggttttccagtacctacctgaagggcctgcaggctggaacagctgagtcatccaaacagcaaagatggtggcctctactccccacaggaactctgtcccaggtaggggtgacactgttgcccctggttagctggaattccaagccagtgggtcttatcctctgtggtgccatggaagtggggtccgcagaccgttactgcctgcttccctggattcagcccccttcccagggaagcttcttggtgggagcagacaccagacaaacaggccaatgtggggacaggggcggggccctacctgttggtgccactgggctcagtgaggttgcccaggccttggctgcagcactggttggtggagaatttgacttggagatgaactttattatccaggatgctgagagtataacatgtatgacagagcttttggagcactgtgatgtaacatgtcaagcagaaatatggagcatgtttacagccattctacgaaaaagtgttcggaatttacagactagcacagaagttgggctaattgaacaagtattgctgaaaatgagtgctgtagatgacatgatagcagttgatatgttgggggttcttgccagctacagcatcactgtcaaggagttgaagcttttgttcagcatgcttcgaggagaaagtggaatctgggcaattgccttgcctcctattgcaaagtggccttatcagaatggcttcaccttaaacacttggtttcgtatggatccattaaataatattaatgttgataaggataaaccttatctttattgttttcgtactagcaaaggagttggttactctgctcattttgttggcaactgtttaatagtcacatcattgaagtccaaaggaaaaggttttcagcattgtgtgaaatatgattttcaaccacgcaagtggtacatgatcagcattgtccacatttacaatcgatggaggaacagtgaaattcggtgttatgttaatggacaactggtatcttatggtgatatggcttggcatgttaacacaaatgatagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataagagtaccttcaagtttaaatctgagagtgatattcatttggcagaacatcataaacaggtgttatatgatgggaaacttgcaagtagcattgcctttacatataatgctaaggccactgatgctcagctctgcctggaatcatcaccaaaagagaatgcatcaatttttgtgcattccccacatgctctaatgcttcaggatgtgaaagcgatagtaacacattcaattcatagtgcaattcattcaattggagggattcaagtgctttttccactttttgcccaattggataataggcagctcaatgacagtcaagtggaaacaactgtctggtaagttttctttgcatgtacaattgctggtattttatacacacttaagactatgcatgatgtactcagtgctgtgtaaatgtattacagtatttgggttctgcccttaaagtgtaataaaaaattttttagaactaatggagatagatatttatacaataaataaagaaaacgctgacatttaggttgttatatcataaaggaatgccttccttgataataaat

SEQ ID NO: 460278 - DNA, 4837 bp, Homo sapiens
tttgtttttcagcctcagaaagcatggtctccggccccgccatcatggaggatgatgaccaggaagtcgattcagcagatgaatctgtctccaatgatatgatgacagcgacggatgagccctccaagatgtcatcggccaccgggcgccgaatccggcgctttaagcaggaatggctgaagaagttctggttcctgcggtactccccaaccctcaatgagatgtggtgccacgtctgccgccagtacacggtgcagtcctcacgcacctcggccttcatcattggctccaagcagtttaagattcacaccatcaaacttcacagccagagcaacctgcacaagaagtgcctgcaactgtacaagctccgcatgcacccggagaagacagaggagatgtgtcgcaacatgaccctgctcttcaacaccgcctaccacctggccttggagggcaggccctacctggacttccggcccctggcggagctgctgaggaagtgtgagctcaaggtggtggaccagtacatgaatgagggagactgccagatcctcatccatcacatcgcccgggccctgcgggaagacctggtggagcgcatccgccagtcaccttgcctcagcgtcatcctggatgggcagagcgacgacctgctggccgacacggtggctgtctatgttcagtacaccagcagtgatgggcccccggccacagagttcctgtccctgcaggagctgggattctctagcacagaaagctatctccaggcacttgaccgggccttctcggccttgggcatccggttgcaggatgaaaagccaactgttggcttgggtgtagacggagccaacatcacagccagcctccgtgccagcatgttcatgaccatccgcaagacgctgccctggctgctgtgcctgcccttcatggtgcaccggccccacctggagatcctggatgccatcagcgggaaggagctcccatgcctggaggagctggagaacaacctgaagcagctgctgagcttctaccgctactcaccgcgcctcatgtgcgagctgcggtccacggcggccaccctttgtgaggagacagagttcctgggcgatatccgggcagtgcggtggatcatcggcgagcagaacgtcctcaacgctctcatcaaggactacctggaggtggtggcccatctcaaggaggtcagcagccagacccagcgggcagacgcctcggccatcgcactggccctgctgcagttcctcatggactaccagtccatcaagctcatctacttcctgctggacgtgattgctgtgctctcgcgtctggcctacatcttccagggcgagtacctgctggtgtcccaggtggatgacaagatcgaggaggccatccaggagatcagccggctggctgactccccgggagaatacctgcaggagttcgaggagaatttccgagagagcttcaacgggatcgccatgaagaacctcagggtggctgaagccaagttccagtccatcagggagaagatctgccagaagacccaggtcatcctggctcagaggttcgactcccgcagccggatctttgtgaaggcctgccaggtgtttgacctggctgcctggcccaggagcagtgaggagctgatgagctatggcaaggaggatatggtgcaaatatttgatcacctggaggccatcccgaccttttcccgggatgtctgtagggaagggctggacccccggggtagtctgttgatggagtggcgagaactcaaggccgattactacaccaaaaatggcttcaaagacctgatcagccacatttgcaagtacaaacagaggtttccactcttgaacaagatcatccaggttcttaaagtcctccccacttccaccgcttgctgcgagaaaggccgcaatgccctccagcgagttcgcaaaaaccaccgctcccgcctgaccctggagcagcttagcgacctgttgacaatcgctgtaaacggaccgccaatcaccaactttgatgccaagcgagccctggacagctggtttgaggagaagtctgggaacagttacgcgctgtctgcagaagtcctcagtaggatgtctgcgctggagcagaagccagcactacagaccatggaccacgggacggagttttaccccgacatttagggagctggcgctgcagagttcactaagctgttgaatatttttttaatctatactcataagctttgatatattatataaatatatattatattatattatattatatatatatatatatataaactcacactgaaaatttttaaaaaccaaggtgacgcgtccaccagaagccactgggagatttcagaaaggaaaaatgttggaaactgactcttgtctacaaaatttggcagctgcaacatacatggcaactcattttcactcacagaagcacgtgctggggcctcctgtgttcccaccttactgtccaccaacagcataagctaaaatgacaggtctctgtcatcacctttaggtagctcattttgtttatgttttcatttgcgggtggcggggctctgggtttgggtttatgttcttgccttttcttttttcatttggttttatgatgggagggagctcctcagcctcctcattgacattctggtccggctgaatcagatctctgacttaagtcagggtgggttgtctgtctgcatttgggaggcaggggggttgacctttctccctccccacctgacttcagcttgagatctttttttattcatttcctgatgagggttccttcactgtcctacaaacaaaagtgtcggtcaaactgtgacactgccacacctcacctctgttgcctcgtccatccctgggttgtggatcccttccttccagccccccctggaaactcacaatattacccattatactgaaggcaacattgcctcaccgctgagcttgaaatcctggggaagggagaaggggtaagcttttagcattcctgtttttacgaggtggaggataaaacaatataattccattccaatccagggcttttggggagatgaagagccaagaagtccagaccccaacaggggagtgatttttggctaaaaaacaaggaaaatgaaaagtacatattcgagttacatggattatttatactttttctttataatcatatcctgtgttgagggtattttttttcctttaataatcaagaaatgcctgctatagttcagtggcaggtagtgtcaatgcaaattgtgccctaagttatgcataactcaaatgagagtctgtagagatgtggtcctccttttgcaacaaggctgataacatgctacatggtcataggaaactggggaatgtgtctctgcctgtaaactcttccttttttgaacagggtagagatgtcctaaagaaatggagaaaagaagagaggactctcaaggcatcagcctacacagacacacacacacacacagacacacacacacacacacagacacacacacacacacacaatcacaatatacaatataagctttagaaatagccacttgcctattccctggggcaagtagtggtttaaactagaggagtctgatcaatgctctttcattcatttaactaccggtatacctcgcaagggagttttaaaaaatgtgcgtgagctgttaaaaacttctgttcatgttcctacatctgatttatgcatattttatatgcagagatcctatcacgtggatgcaggtcattttgggggagggaggaagatctgaattatatacatgtggtcagttctgctgagagcttcatctcttggttggcagaggggcttgtgcagccctgacgggacccagaagcccatttgctcgcagtttcctctctctgtttttttcctcctggaggtaggagagagggcctgaccaggcaccagatgatggagcaagggcagctgcatgctccctctctccagaccagccttctgcttttggggtccgaaggggcatttgctcccatcctgagcctcctctgcccctgtcttgctcttccccaccatcctacaagtacctcagtctccagcaggcccacccctccacctgcagcccagggcgggtctgttctgccaatgcccacctccttgagccacagttagctgccaactgggtcttgggacaccctccagtacctggctcaagagagaccaggccgggccgagccttcttcccactgcagtggactagacccacggccaggggatgggcatccccaggtagcaatcccacaatgcactgtacctcagagagagagcacgccaggggcaccaagggaccgagccctctgtccagagggggacagcggtcacaatactgctcaccaaaagacaaaggccaggctgccctcgggcacctctcagtcttcacttttgtctctccggaagaaccagcagtctgattccgtctatttcagcccccgtctctctcttctccacccccacgctgctgaaccattttcatgtcaatcacaaaggaaaaataagtggggatggggggaaatacctaggagtctattatcacatacatattaatatgttaatactttctttaaaaaaaacctcttgatgttattattttgcagactacgctttatagtacctgtgtgacgggacctagaacactggatacaaatagagctatgttggtttatcataatatgtacgcagaaactttctttttgtcatattatccttgtaatgtaagaagattgttaataaaagcatttaaatttactcaccactgttgaattgctgcctccttgcctct

SEQ ID NO: 460279 - DNA, 4135 bp, Homo sapiens
caacgagtttgcaatttacagtctctggacaggcactcagatgtgggcccgaaaacaaatcaaaacaaaagtcgtgacttcccagatcttaggagggccgaaatctctacctatcaggcaaaaggcaaaaagcccggaagggtcggggagaagcaagctggaaggctccaggaagtgggtggggaggaagctgccggggttggagccaaccctagcaacagcaggtttgcacacgcctagcagaggaagtcccgggcctaagcgtgcagcggtcacaagagcggcagtgctgtccccttcgattccggtcatcacccaaccatccagcccgggggggcggaaaaccggcttgtaaagtgggcggcggccggtgttcccacagctgagtcacagcccagccaacttttacagcgtttcccagaaagaaaatacaaagtctcagtcccggagcccaccgcttctaattcccgctcccctgtgtcacctgacccggggtaactccagccccactactgagatatttcccactcatggcgcaacttcttgcctgcgcaaagcctcgtggtaccccgagcgctctccaagtgctaccaaccccacagatgagagggcaggagagaggggaagggctgcgtcctcacctgcaggacacggacacctccacccgcgtggccgggatggcagcgctcagctggttcaagtccccgatgcccgcagtgctgttgtagcggctgtccatattgggaggaggcgccttggacttgtccggcgcccacaaccacagctcgggcggactgagggctagctcccgtcaggcggggatgggggttgagggtggaggcagaagaaggaggcggaggcagcgcgcgggatgggggagggaagggaggaggcggacctccgcgcagagccacgagggaaccgctagccagtcctgggtgaaactgacgctgccaggcaagtggcgcgcggggatcccggtttcccagcccccttccggcaggcagcagcccgggcgggggacacactccgtgatcccctcctggctggaggggtcaggcttggtggacccagcaagcagcctgatggagaaggtggcaccagacgcagacccctaccgtccaggaccgcaagccctcgccggctctgcgtgcttttaggttttgtctccacctctgcacacccacactcgcctcctgggccgcgacagcttccttctgtcaatcaggtgtggacgggaaggtctcgaagtttcctcgcctgagttgaaagctggaggtgggggcacctctgcccgttcctaactgccccgttataaggtccccctccccacaattggttctcacctcgccctcggagctcttgggagatccctccgtccctcctactgtgccctcgggcagatgagtctggtcccagcttctggactgcccactgtcggccacttgagagttggggacggtggggcattgtgacgctctccaaccttggaacacggtggcaaagtggccgatcaatatatgggacaagtgggggcgggggggcggactctaaggtggaaaaaacaatactacttgggatttaaggaagcaatctggattctgtctccccttggttcttcggagcttagaggtctaacggcgacattcctcctacagtaagggctcttctgggtccctcgtttccaaaggcatgaaagttctgacctgaaaatgggggccggggagggtgatgtcacaaccatataacgcagctccttcagccgactcccacccgcaagaactgagacctgacggataaaagcagagaggagtcagagtgagcgctgcgtttgggaaactgcattccagggcagcaagactggtgccaagacggagtcgtggcaaaagcatccggaggtcttccttaatatatgtcagcagtggagtggtgtgcttaaggagagagagacttggaaaaatacagaccgagaacaaggccatgtggagatagaggcagagactgaagttgtaccaccaaaggcaaagaatatcaagtattatcagtaaccacaggaagctggaagaggccaggaaaggtttttcttagagaccttggaaggagcctgaccctggaacaccttgattttagacttctgaccctcaaaattgtgaaagaataaatttctgttgttttaagcaattcggcttgcagtaatttgttacagcagccctaagaaaagtaatacatatcgataacatttattatttccattttgctgactctttcaagttctgtgcttataaattcatcatagtgaagtaagctttaaatgataaaactttgaaagtatactcaaattctgttgctatagttagcacaatacagaaaggaatataatttttaaaaataaattttaataatataaatataaattatgacatgtctaaacttttattttggagattttataataaaaagtttatatttattaaaattcatttaaattaataacataaagcccttggaatatgctaaaaatcaaagataagttacatttactataacgtaataaaccatcattcactgaatcagtgatttagcagacattaattcaatgtctgctatgcactaggcactgtactagatctaagagctaaagctccttctggcacttatagaccaagtaaaagttagcaaggagatacattattgggtaaagattatactgactgagtcatcgagctctgttttttaaatagtttcaacttttagatctctgacgtacatgtgcagtgtacaccgatgtgagtgaggtgctatgtggccaaggactgttaaaagtatctaaattcactttgatatgtttagttcagcaacagctgagcacttggatggactgtccaacaggcatttgggactggtgagaggacaagattgttgatattggaatcaatagcttagaattagcagttgatgccaagcattttgccaatctgttcctcctctgtatgtccataccatttacaattgctcacaatcatttagctctgctgacacagcctgtaattgtgtatcattttatctatttactattttattaatttctgttcttttcattttgctcttttcttatgtgtcttttgtctttactctgttttcattttttccaacttgctaagtttaatgcttagtttttcacaatctttttcatattataatacaagaacttaaagccatgaatttccctatagtactgctttagctgcattccacaagttttgatatagagtacagttgcctctcagtatccatgggagcttggttccaggacccatatggacaccaacatgctcaagtctctgatataatatgcatggtatttgcatataatctctgcacatcctcccatatattttaaagcatctctagattatttatattagtataataatacagtgtaaatgttatgtaaatggttactatgctgtgttttttagggaataatgacaaggaaaaagtctgtacataaatgaaatgcttttaaaaatattcttgatctgtgattggttgaatccatggatgtgaaactcacaggtacagaggactgactgtactttgactgctgctttataatattttacaaatttcattttaaccaattgattgtatggagtatatcttttttctcaaaagagtatcttatcatctttttattattgattaataatccaattacaatgttatctgataaaatggattatataataacagttttgagtgtatgaagacttcttttattatcttatacatgtttagttccagtaattatccgtacatcttcaaacatcagcataagaggtcttgacaggccacttagtgtttatctccatctcagactgtgaaagatagataaatagcaaagcagttgccactacagattgaatgcattcgggccatccgctggctactgggtcaaggatttttgatagaaaggctacgggttactgatggccttcgtgcttttgggtttcagacttttgagctggttaagggggtgttcagaaagccaatgccccctcctccaagaagcacttcccttaagggaaaaagagtttgagcaaactcttggagatactggggaaagggaaatttc

SEQ ID NO: 460280 - DNA, 4122 bp, Homo sapiens
ccacgttcagctgtaaccagagccgcccacggagccgggcgctgggcctctgcgggcacagccacttagcagccaaccttgctgccttgggctggcccccttgtccttgtggggaatctgaagccccagtcctgaggcttgtcctggaaggacccccgccccctccctcatctcccctgagcctgagtctccagccgtgcgctggggtgcggcctgggcagggcggcagctccaggaaggaagtatggctgcctgacgtgccagggtcaccggccgtttttctagagcggtcttgaaaattgcatctggtttgttaccagttacgcgtgttccctgtggaaacgtggattctgtggacccgttttccatggtctgtgctcgtgtggcccagcagggcaggacctgagggtgccaggtgggcagatggggatgagggctctctcggggccactgaaagcatctgggccatctccagagggctcagccccgggccacgcgcagccccaccccagacacacgtcatgcacctggaaccctgctcccacctgccggagcatgggtcgggggccttggctctgggggctggtgcgggtggcagatgtgccagggtcccttctcactgtggtttctctctctccattgccaggtccggcctctttggcctacccccgttggctccgctgccccaggtcgatgagtcccctgtcaacgacagccatggccgggctcccgaggagggggatgcagaggtgatgcagctggggtccagctccccccctcctgcccgcggggttcagccccccgagaccacccgccccgagccacccccgcccctcgtgccgccgctgcccgccggaagcctgcccccgtaccctccctacttcgaaggcgcccccttccctcacccgctgtggctccgggacacgtacaagctgtgggtgccccagccgccgcccaggaccatcaagcgcacgcggcggcgtctgtcccgcaaccgcgacccggggcgcctcatcctcagcaccatccgcctgcggccgcgccaggtgctctgtgagaagtgcaagagcacgctgagccccccggaggccagccccggacccccagccgcgcccagggcccgcaggaggctgggcagcggcccggacagggagctccgcaagccggaggagccggagaacggcgagcccacggctgcggccaccgccaggaggagcaagagggagaggcgcgaggaggacagggccccggcagagcaggtcccgcggagcccggtcatcaagatctcctacagcacgccccagggcaagggagaggtggtcaagatcccctcccgcgtgcacggctctctggagcccttccgtccccagcaggccccgcaggacgacggcagccaggaccccgaggtgctggacagagagtcccgggaccggccgtcctgcgcgccctcggcctccatccccaagttgaaactgacacggcctgtgccggccggcgcggacctgccgccccctaagatccgcctgaagccccaccgtctgggggacagcgagcacgagcccgtgtaccgggccgagctggtgggggagctgaacgggtacctgcgggacagctcgccggcgccctgtgcggacggccctgccggtgggctggcggacttgtcttctggaagttcgggtgaggacgatgacttcaagagctgtccccagggtccacagggacgcgagggcttggcttttctcgtcagctgccctgaggggagagcggactgtgccagtgagtcggcgtgcagcagcgacagcctggacgaggccagatcgtccggctcggaagggacgccggcagacacgggtgacctctcgcctggccacggcgcgtcagcgccctcggtgtccagagaggctcgccaaacggtgccgcccctgacggtcaggctgcacacacagagcgtgtcggagtgcatcacggaggacggcaggactgtggccgtgggggacatcgtctggggtaagatccatggttttccttggtggccggcgcgtgttcttgacatcagtctcggccagaaggaggacggagagccgtcttggcgagaagcgaaggtctcgtggtttggttctccgactacgtcgttcttgtctatttcaaaactctcccctttctctgaatttttcaaactgagatttaatcgtaagaagaaggggatgtatcggaaagctataaccgaggctgcaaatgccgcaagacacgtggccccggaaatcagggagctcttaacccagtttgaaacgtaactggttccctgaccaggtcaccgacgatgagggcgcacctgctgtcctggagcttccgatctctgttcggggaccctgtgagccttctggccggctgcgtgcagagcccactgggcacggtggtcggcctggtgtgaggccccccggggaccggcagtgtgtccagggaggggatggccctgagcccagcggctcctcccgctgagtgtatttcttcccaccactcagcgcatggctgccctggctcacgaggcagtcgggactcgtgacttgctggctgctggctgctgctgcctcgcgcgctggggttccatggaggaactgggcctgccgccccggcctcacctgctgcccgcatgctggggtcccatggaggaaccaggcctggcgccccggcctcgcccagcggctggtgtgggcagctgttccctgcctcgcagtgtcctggaggcagctgtctcgcagactcagcttggtctcccgcaggcttcagaaaaacccaattgcacgtgtgggattcttccccagcccttgggtgcggggtctctgtgcacttgagagctgggggacccacccaccgtctcccactccaagttcatcccagagcgtggggcccgctgggcacctggcacctggcctgcagatgctgctacgagtgaccagtgctgtgtggaggaggccaagggcggcccctgggaaaccgggcttcaacagtacaaggaaaagaaacttgctctgttttgtaagagcgtgttccttttcctcttttttgtcactttaaagaccaaaaagaataaagaaagaaaagaaaaaaattaatctgctctttctttgtttaaatgttaaaaacaaaaagagagagaaacatatgtcatagttgaagttgtgacttgtgcggccacagttcacactcatgcgtgtgtccctgtcggggctgacggggcctgagtcccctgggcactgctgggcggggcccatgtcgtacgggttggggtgacgccgccaccggctgcatctcgctgcctccaggggctgcccctgcctgatctgctgctcggggtgactccccctgccgcacaccccactttgcacccaggacctcctactgactagggttggctcccctttacgaaggaaggccttcgtaaagcttggcactgcttcaagaaatgtgtgtgtccaatggaaggagcaggcctcacccctgggacaaaatatgcgtgcagccctgggcacattcactcccagctgcccagcctgcaactagagctcagccactgcaggtgacagcaacgggacccgcctttgagcctgaggccaggactgacgccacagcctgcagctcctccccaagcccagccccagcccttgcccttcaatcctgagaccctgagatgcatgggtggggctttcatccgctggggaggctgagacccggggggccacagctggttcctggactccaaagcccaggacccttccaaatcctgcctggacggcaccgtggccaggaccccagccagcacttcccttttctgcgagggttttctgtttctttgattataaaataacccctgttggtggggggaaaaaattagcaaaataaagaaaagcaaaaaaaaaaaagaaaattagaatctcccgcagtctcacaccctgtgggccttttgcgtatttcttcccgggtgagttttctgggcattaacagatgtttgctctgcagacctggccttgtgtcaccctggaactctgtgcccagctcacccttccgtggcttcctgtggccgggggctccctccccttcctgccccaggtctgaggtgccaac

SEQ ID NO: 460281 - DNA, 547 bp, Homo sapiens
tctgcgtcacctccttgcctgggcttctcacagtgcaagccccgcagcctaggccctgctgggtggtggtgggatggctggggaggggcaagagcaggtgaggagtcctcactgggggtgcatactttgcattacagctggggaggctgagacccggggggccacagctggttcctggactccaaagcccaggacccttccaaatcctgcctggacggcaccgtggccaggaccccagccagcacttcccttttctgcgagggttttctgtttctttgattataaaataacccctgttggtggggggaaaaaattagcaaaataaagaaaagcaaaaaaaaaaaagaaaattagaatctcccgcagtctcacaccctgtgggccttttgcgtatttcttcccgggtgagttttctgggcattaacagatgtttgctctgcagacctggccttgtgtcaccctggaactctgtgcccagctcacccttccgtggcttcctgtggccgggggctccctccccttcctgccccaggtctgaggtgccaac

SEQ ID NO: 460282 - DNA, 2733 bp, Homo sapiens
acaccttctagtagctcctggaattccttggtttatggcagcatcactccagtctcttcctctgttttcacatggcttccttctctgtttctgtgtctcaaatcttcctctcctcattcttataaagtcatcagtcattggatttagggccctccctaaatccaggattatgtgtcagacatctgagtcaagcacagaaaagcagctcctcaaagttataacagacccacccagtgactacttcccaggggtcttgaggtgcctcctgccctgtggctgtacggagggcagcactggaacctcgggttcagggcctgtgtgggtggttcacttatgtaagacatcagctgccctgaaagagaactggtgtccttacgagagaagaaagaggcaggtccataaggtatggtcatgtgaagacaggggcagagactggtgttatgctgccacaaatcaaggtgttcctgaagccaccagaagctggaaaaagcagaagcaggaaaccttgatttcagacttctggcttctagaactgtaagagaatacatttctgtcattttaaaccactgactttgtggtcattcattatggaagccatgggacactaatacactcattaagaaaatatgacctatcagcagacaatttctgtattactaaaacaccccaactcttgtcacagaaacacacaggttttggagtcagagagacctgggtttgaatctcacctctaccacctttcaacagaatgtccttgggcaagctgtatagcctcacagcctcttcttgcctaaagaaaggagaatgtaagaccatccttcccagggggttctggagagcagatgtgagatctataaaatcacatccaaactttgtaacaaacgtagaagaccgttcacattttgcccaccactcacccattttccttttgaatcaaatttccatcaattttcctctaaaaacctgtactttagtattaactagctcccaacaccctccctctccactccccacaactcattcacactgtggtataaaacaatggcaacagcctaaaatattgccttccaaagaggactcaaaatcctaaacctaaataatgaattgaatgcatcatcaaacttggaaacacagggcctttccaatggcacccagccatcctgccgtccaggtgtgtttgcccttaggcagcctctggcaatacttggcatgctgccattcatttcttgtgccgataatggtttttttcctggaataggagcgattgacatgacaagaactgagatggggcagttctgatacaactgacaaagaattagcagtacagagcatgagaccctgcataaagacaaatgggagaagccgaagcgcaaggtgtcagcaggtttcgtctcttctgaggcctctctccttggcttgcagatggcctccttctcgctgtgtcctcacgtggccttttttctccatgtgcgtgcatccgtcgtgtctctcttattcttggaagaaaaacatgtgccttctgctaactgtctggtgtgtccagttctgaatgtcaagaccaagtcctgaaaatgggtactggggacgacttaagagcatttgtcaagcaccttgtatgtgtcaagctgatgataggcattgatgctacacagatggttataacctggtccagcaaaatctcttgctgtctggtagggaccaggcaaatacaaatggatgagttaaagtcctgcataatagatacctcattggaactatgaaccaatgactccagagaaagagccacacctgactgcctgtcatcttctgacagaggatgtcatgttgtatgcggtgtgatcatctaccaagatcctaggaccaattatatggctcattgacctgcacgggtacctggaacttcagctcaaacatttacgataaccaagcatccaaaagctatgaaaacacagaactggcagccaatccattaaatcactcaaacatctattaactagcaattgtataaaatttgctggatttgagcactgtaagggtatagaagggcaaatgaagatcaataacaggagaggaaagagaagagtaaaacagttagcatctgttgatggccaggcatcatattaagtatttcatatatattatttaattctgaaaggatctttttgtaagttaagaagctgaggtgacatgagttgctcaagttcacacagacagcaaagggtgagccattgcaatgcaaagcccatgtccaattcctcactccttgctactctagcaagagttctgggggtaagttttgtaaggagagaaagaaaagagagaaaatccttgacagtaagtgaagcaaaagcctggatatctgaatgggaggagacaccgttgcagagcccatccgtcctgattttcccagaggcacgggagcagagcacgtccccaccgaacctaagcacgcggaaagatgcccacagattgctgcatttgtatttttactgagccagcattgaggaattccacagacacatatgttgtgtacatacgtgggctatcactttttaggtggatgtacgtgttaggattatcgaaataagcatccatttaaaagaatgatttgaatttgtacctttctgtcatgaaaattctgttaatggatgtaataaagtcagtcactattctgtgtaaagcatgatgacatttttggatcttggcatcaaatcaggaaactcattttagaat

SEQ ID NO: 460283 - DNA, 2199 bp, Homo sapiens
tccttcctggctctgtgtatgagcacagcctaagctcactttagtgccaaggaggctggggacctgtctacactcttcgatgttggtggcatcatagatgttcctgtacaactacattggccaggacgggattgccagctccatagtgatgctgatcatctgtgggggcctggtcaatggcccatacgcgctcatcaccactgctgtctctgctgacctggggactcacaagagcctgaagggcaacgccaaagccctgtccacggtcacggccatcattgacggcaccggctccataggtgcggctctggggcctctgctggctgggctcatctcccccacgggctggaacaatgtcttctacatgctcatctctgccgacgtcctagcctgcttgctcctttgccggttagtatacaaagagatcttggcctggaaggtgtccctgagcagaggcagcgggtataaagaaatatgaggccccaattggaacagcagcatggagggtcccagttgggtccccaacgtgctccccatgggcaagacaatggaaacttccacaagcagggaaggcaaaccctctttattgaacattagccagcccagcccagaccccagggctgcctaaggacacagagattctccatgggaaggggactgccaagcatgaggaaatagaagattcaggggcctgagctctggaagctgcaagcaaaagggatgggactagggctgagttgtgtctccattttgataaggaaaggatatgctcacactcttgcttgttcagattccaagacagaaggcttcacaaggccaacgcctggaaaatgggcatctctccctcccatgttaagctttaacctctgtaatctgcctgtatctataggtgggcatctcactccatcaaaggagcccagcctctctttgtccctctatccatgcaacagtcttctctgtgcatttccccaagctgggccctcttctactctccatttaggcctgttgataactccattacccacccatcactgctgttcctccagggccagcactcgggcgaggcaggggagctgccttcggtacataatttgaaggggcactccctcttgggcacatgccggccctgagtgcctcccttgcctcactctgatcccggccccataatgtcctcagtggaaggtgatgggggccggtgctgtggggagagtagaaagaggggttggcatgactaaaaataccagtatgtgtattaagtattttgagaatgaaatgccaaggagtgcctactatatgccagctctaggaatggagtagacagtggacacaagaaggacttacgccctgagcacaggtgccaatggtgacaagactggcaagacgtgagggcatgaatggttcattcaggcagctgctgcagatgtggtcacctggtgccatctgctgctcccttttccacttttctatgtcctccttccaccccaagtcccggatcactcgctgttttctggctagctcttggcatctccatctgagcctaaagttgcccactggcaccaatagattctgtttgacctgctgtgcccatgctcatctttgtcggggcttggcttggcagcgagcgaggctggcatggggtgctgaagtggggtctcagtgaggggtgacagcgtgctggcagtcctcacagccctcgctcgctctcggcgcctcctctgcctgggctcccactttggcggcacttgaggagcccttcagcccaccgctgcactgtggggagcccctttctgggctggccaaggccagagcaggctccctcagcttgcagggaggtgtggagcgagaggcgcgagcgggaaccggggctgcatgcagcgcttgcgggccagctggagttccgggtgggcatgggcttggcgggcctgcactcggagcagccggccggcccttccggccccgggcagtgagggacttggcacccgggccagcggctgcagagggtgtactgggtcccccagcagtgccggcccacctgcgctgtgcttgatttctcgctgggccttagctgccttcccgcggggcagggctcgggacctgcagcccgcggtgcctgagcctcccacccgctccatgggctcctgtggggcccgagcctccccgacgagtaccaccccctgctccagggcgcccagtcccatc

SEQ ID NO: 460284 - DNA, 777 bp, Homo sapiens
cttttttttttttttttgaggcggagttttgctcttattgcccaggctggagtgcagtggtgtgatctcagctcactgcaatctccgcctcccaggttcaagtgattctcctgcctcagcctcccgagtagctgggaccacaggcatgcgccaccacgcccggctaattttgtatttttagtagagacagggtttctccatgttggtcaggctggtcttgaactcccaacctcaggtgactcacccgcctcggcctcccaaagtgctgggattacaggtgtgagccaccgcgcccggccaggttttaaatattaatctagcttgctatttcctgcctgagaggtgaaagggaggcctcattacagagaactgagatgaaagcaatgatgaagggaccctgggaccctgcctttcctctccctactcagcaggagcttatgaagtcatctcactttctcttctgtcccccctctcctcttcatgcaggtataaagaaatatgaggccccaattggaacagcagcatggagggtcccagttgggtccccaacgtgctccccatgggcaagacaatggaaacttccacaagcagggaaggcaaaccctctttattgaacattagccagcccagcccagaccccagggctgcctaaggacacagagattctccatgggaaggggactgccaagcatgaggaaatagaagattcaggggcctgagctctggaagctgcaagcaaaagggatgggactagggctgagttgtgtctccattttg

SEQ ID NO: 460285 - DNA, 3264 bp, Homo sapiens
gcagatgctgtcccttcctgcaggttccgaggcctcatcctgctgctgaccttcctaatttacgcctgctatcacatgtccaggaagcctatcagtatcgtcaagtggctgtcttccccaggagctccttttgagtttattccccaagacagctgtgtcggtggctgtggatggaataagcgtgcagggcccctgggctatgtggatgctgctcatgggtctgatgtggctgctttcccctgcagccagttcctgcaggaggagagccgtctgcaccagaactgctcggagcagatcaaacccatcaatgatactcacagtctcaatgacaccatgtggtgcagctgggccccatttgacaaggacaactataaggagttactagggggcgtggacaacgccttcctcatcgcctatgccatcggcatgttcatcagtggggtttttggggagcggcttccgctccgttactacctctcagctggaatgctgctcagtggccttttcacctcgctctttggcctgggatatttctggaacatccacgagctctggtactttgtggtcatccaggtctgtaatggactcgtccagaccacaggctggccctctgtggtgacctgtgttggcaactggttcgggaaggggaagcgggggttcatcatgggcatctggaattcccacacatctgtgggcaacatcctgggctccctgatcgccggcatctgggtgaacgggcagtggggcctgtcgttcatcgtgcctggcatcattactgccgtcatgggcgtcatcaccttcctcttcctcatcgaacacccagaagatgtggactgcgcccctcctcagcaccacggtgagccagctgagaaccaggacaaccctgaggaccctgggaacagtccctgctctatcagggagagcggccttgagactgtggccaaatgctccaaggggccatgcgaagagcctgctgccatcagcttctttggggcgctccggatcccaggcgtggtcgagttctctctgtgtctgctgtttgccaagctggtcagttacaccttcctctactggctgcccctctacatcgccaatgtggctcactttagtgccaaggaggctggggacctgtctacactcttcgatgttggtggcatcatagatgttcctgtacaactacattggccaggacgggattgccagctccatagtgatgctgatcatctgtgggggcctggtcaatggcccatacgcgctcatcaccactgctgtctctgctgacctggggactcacaagagcctgaagggcaacgccaaagccctgtccacggtcacggccatcattgacggcaccggctccataggtgcggctctggggcctctgctggctgggctcatctcccccacgggctggaacaatgtcttctacatgctcatctctgccgacgtcctagcctgcttgctcctttgccggttagtatacaaagagatcttggcctggaaggtgtccctgagcagaggcagcgggtataaagaaatatgaggccccaattggaacagcagcatggagggtcccagttgggtccccaacgtgctccccatgggcaagacaatggaaacttccacaagcagggaaggcaaaccctctttattgaacattagccagcccagcccagaccccagggctgcctaaggacacagagattctccatgggaaggggactgccaagcatgaggaaatagaagattcaggggcctgagctctggaagctgcaagcaaaagggatgggactagggctgagttgtgtctccattttgataaggaaaggatatgctcacactcttgcttgttcagattccaagacagaaggcttcacaaggccaacgcctggaaaatgggcatctctccctcccatgttaagctttaacctctgtaatctgcctgtatctataggtgggcatctcactccatcaaaggagcccagcctctctttgtccctctatccatgcaacagtcttctctgtgcatttccccaagctgggccctcttctactctccatttaggcctgttgataactccattacccacccatcactgctgttcctccagggccagcactcgggcgaggcaggggagctgccttcggtacataatttgaaggggcactccctcttgggcacatgccggccctgagtgcctcccttgcctcactctgatcccggccccataatgtcctcagtggaaggtgatgggggccggtgctgtggggagagtagaaagaggggttggcatgactaaaaataccagtatgtgtattaagtattttgagaatgaaatgccaaggagtgcctactatatgccagctctaggaatggagtagacagtggacacaagaaggacttacgccctgagcacaggtgccaatggtgacaagactggcaagacgtgagggcatgaatggttcattcaggcagctgctgcagatgtggtcacctggtgccatctgctgctcccttttccacttttctatgtcctccttccaccccaagtcccggatcactcgctgttttctggctagctcttggcatctccatctgagcctaaagttgcccactggcaccaatagattctgtttgacctgctgtgcccatgctcatctttgtcggggcttggcttggcagcgagcgaggctggcatggggtgctgaagtggggtctcagtgaggggtgacagcgtgctggcagtcctcacagccctcgctcgctctcggcgcctcctctgcctgggctcccactttggcggcacttgaggagcccttcagcccaccgctgcactgtggggagcccctttctgggctggccaaggccagagcaggctccctcagcttgcagggaggtgtggagcgagaggcgcgagcgggaaccggggctgcatgcagcgcttgcgggccagctggagttccgggtgggcatgggcttggcgggcctgcactcggagcagccggccggcccttccggccccgggcagtgagggacttggcacccgggccagcggctgcagagggtgtactgggtcccccagcagtgccggcccacctgcgctgtgcttgatttctcgctgggccttagctgccttcccgcggggcagggctcgggacctgcagcccgcggtgcctgagcctcccacccgctccatgggctcctgtggggcccgagcctccccgacgagtaccaccccctgctccagggcgcccagtcccatc

SEQ ID NO: 460286 - DNA, 2533 bp, Homo sapiens
actcttgtgtatccccaatgcagcggaatcggtgcaacggtgagccagctgagaaccaggacaaccctgaggaccctgggaacagtccctgctctatcagggagagcggccttgagactgtggccaaatgctccaaggggccatgcgaagagcctgctgccatcagcttctttggggcgctccggatcccaggcgtggtcgagttctctctgtgtctgctgtttgccaagctggtcagttacaccttcctctactggctgcccctctacatcgccaatgtggctcactttagtgccaaggaggctggggacctgtctacactcttcgatgttggtggcatcataggcggcatcgtggcagggctcgtctctgactacaccaatggcagggccaccacttgctgtgtcatgctcatcttggctgcccccatgatgttcctgtacaactacattggccaggacgggattgccagctccatagtgatgctgatcatctgtgggggcctggtcaatggcccatacgcgctcatcaccactgctgtctctgctgacctggggactcacaagagcctgaagggcaacgccaaagccctgtccacggtcacggccatcattgacggcaccggctccataggtgcggctctggggcctctgctggctgggctcatctcccccacgggctggaacaatgtcttctacatgctcatctctgccgacgtcctagcctgcttgctcctttgccggttagtatacaaagagatcttggcctggaaggtgtccctgagcagaggcagcgggtataaagaaatatgaggccccaattggaacagcagcatggagggtcccagttgggtccccaacgtgctccccatgggcaagacaatggaaacttccacaagcagggaaggcaaaccctctttattgaacattagccagcccagcccagaccccagggctgcctaaggacacagagattctccatgggaaggggactgccaagcatgaggaaatagaagattcaggggcctgagctctggaagctgcaagcaaaagggatgggactagggctgagttgtgtctccattttgataaggaaaggatatgctcacactcttgcttgttcagattccaagacagaaggcttcacaaggccaacgcctggaaaatgggcatctctccctcccatgttaagctttaacctctgtaatctgcctgtatctataggtgggcatctcactccatcaaaggagcccagcctctctttgtccctctatccatgcaacagtcttctctgtgcatttccccaagctgggccctcttctactctccatttaggcctgttgataactccattacccacccatcactgctgttcctccagggccagcactcgggcgaggcaggggagctgccttcggtacataatttgaaggggcactccctcttgggcacatgccggccctgagtgcctcccttgcctcactctgatcccggccccataatgtcctcagtggaaggtgatgggggccggtgctgtggggagagtagaaagaggggttggcatgactaaaaataccagtatgtgtattaagtattttgagaatgaaatgccaaggagtgcctactatatgccagctctaggaatggagtagacagtggacacaagaaggacttacgccctgagcacaggtgccaatggtgacaagactggcaagacgtgagggcatgaatggttcattcaggcagctgctgcagatgtggtcacctggtgccatctgctgctcccttttccacttttctatgtcctccttccaccccaagtcccggatcactcgctgttttctggctagctcttggcatctccatctgagcctaaagttgcccactggcaccaatagattctgtttgacctgctgtgcccatgctcatctttgtcggggcttggcttggcagcgagcgaggctggcatggggtgctgaagtggggtctcagtgaggggtgacagcgtgctggcagtcctcacagccctcgctcgctctcggcgcctcctctgcctgggctcccactttggcggcacttgaggagcccttcagcccaccgctgcactgtggggagcccctttctgggctggccaaggccagagcaggctccctcagcttgcagggaggtgtggagcgagaggcgcgagcgggaaccggggctgcatgcagcgcttgcgggccagctggagttccgggtgggcatgggcttggcgggcctgcactcggagcagccggccggcccttccggccccgggcagtgagggacttggcacccgggccagcggctgcagagggtgtactgggtcccccagcagtgccggcccacctgcgctgtgcttgatttctcgctgggccttagctgccttcccgcggggcagggctcgggacctgcagcccgcggtgcctgagcctcccacccgctccatgggctcctgtggggcccgagcctccccgacgagtaccaccccctgctccagggcgcccagtcccatc

SEQ ID NO: 460287 - DNA, 905 bp, Homo sapiens
gttgctccgagccctcgcctggcagctcactctggatctgcgggttctgaggagcctcgggacccacctgggtgcagttgccttcagggacagaccatcttacagatgcaataacctgcttgacattctcctctggaaaaggaaaagaactacgagaggaagcatggcacttggatgcagaaattgagcaccctccatgtgatccagagaacagcaactcatacgtcttctggaaccttctaccaacagtagaacctcttagctttatggagaaaacagagtcattctgtccagaggtgccaccccaagactgtggagcctctcctcggccctcgctgaggagcctgccaaagaaccaggggagtctcctccagtttgaccggcaagccccaggccgcatctccacctcgcccactttgaggagattaaggacccgtggctgtgggacaaggcaggatgcctggcaggtgaccacctggggaagctggggagctcctgtgggcttcccatgttacctttcgaagagcctgccaggaagcccaaaggattcttcacacttgctgtcacccttgagactccactcaagattgacctctgaacctgaaagggccctgaatgcagctgactcactggagccccaaacccggcccactgacaagtatctccctcctgagcttcagcctgtcaatgaagggtcccttcaccaggcctctcttcggcagcaagaaggccacttcctgcccagccccaccctacgacaccctagtcctcaggcactttgagaaaggatgcaccaaggccaggcttaccgatggtctgtcaggtacccgagagcaatgggggccctcttgcaaatgcacactatttaaagacaacgtcgtgtcactgatttaaaaggggagaaa

SEQ ID NO: 460288 - DNA, 3046 bp, Homo sapiens
  misc_feature (77)..(77): n is a, c, g, or t
  misc_feature (89)..(89): n is a, c, g, or t
  misc_feature (168)..(168): n is a, c, g, or t
  misc_feature (305)..(305): n is a, c, g, or t
gctccatgacctgcacccccaggcaacccggtggtagttctgtgtccacgcaggttctgtgtccacgcaggctatgngtccacgcaggntctgtgtccacgcaggctatgtgtccacgcagggtctgtgtccacgcaggctatgtgtccacgcaggctatgtgtccangcaggttctgtgtccacgcaggttctgtgtccacacaggttatgtgtccacgcaggttctgtgtccacgcaggctatgtgtccacgcaggttccgtgtccacgcaggttctgtgtccacgcaggttctgtgtccacncaggctatgtgtccacgcaggctatgtgtccatgcaggttctatgtccacgcaggctatgtgtccacgcaggctatgtgtccatgcaggttctgtgtccacgcaggttctgtgtccacacaggttatgtgtccacgcaggttctatgtccacgcaggttctgtgtccacgcaggctatgtgtccacgcaggctagtggattgagcggcggatgcttttacgatgccctgccccccaccagccccgcgggacgggacgactgcagtgaggccgtgagagtccccggagccctgaaagtcccagagccaaaggagcatttgagcgggaaatgcagtgccgcctgggcactctctgaccgctgagtgaagacacacctgggcataaaactttgcaaggctcctccgagcatgtgggggcccgaggccagggagtatttcttcttctttctagtttatatatttcccaatgttctacaatgaaatggtattacttgtaaaacggaattcactttagtttaaaactgaaaatcaaatcaaggactgaccaccaccttcacttgggaacaggcagcctgactgcttgtgagggggccccggaccccgcagagcctcagggcagcagggacactgaagaggatgatggacagaaaccgccccccgtcctccgcagcttcccaagcctgactctgtggccacctgcagctcaccggagagaagcatcgaagacaaaacaggacggagcacagggcccgggtctcttgcctgactcaccacgttccgtaaaagatgaacgagtccagtccttgcctttccccgcacctggaggtaaaccgtgaactgaaactctcgtaggcgcaacttcacggggctgctcctgagctggaggcctcggtccaccggcctcagtcagatttccacatgaaactaacttgtattttccttcagtcaacaggcccctaaggaaaatgtggttttccaaaaattgtctcaaaaggaaacctgaacactttaagagatgaataaccactgaatgaactgaaagggttttgccaaagaattatttccatacgtgatgccagaccagtacaactttataggtgggttagttcaaacttttaaggaacagagctccaatgccatatacattgaaaattcatagaaatatttggaaagctccccacttaattttatgaacctagtataactttgatattaaaacttggcaaagatagtatcacaagacgaattataatataatctcaattacgaatgtagatataagaattccaaataaattcttaaatgtaaattcagtcaccattttaaataaagaatatatcaaattcacagaatttattccttgaaggcaaggatgaattaatattataaaatctaataacttaattatatcaataggttaaatgagaaatataatcatttgattgtcaatagataacaaaaaggcatttgataatgtttgatatccattaaccttaattttaatcaaaaccataattaatgttaaaatttgaactgtgcggcaaggcttataaccaaatgctgtagccccttacctaatctgtctgacttctagaaagttcttcctcttcagaggccaccactttcagctctttgcagaaatttttttaggtatttacctacatatttctaaataacacacttaccttgttgttgcttggtttttgagttttatatattatctgttgaccgtagatgggaagatgaaagttaagttctcttacatggcctctatcaccacacagacccatgaacttcttttcttcctattttttttggataaatcacaattttttatttatttatttattttttgagacagagtcttactctgttgcccaggctggagtgcagtggtgcaatcttggctcactgcaacctctgcctcctgggttcaagggattctcctgcctcagcctcatgagtagctgcggctacaggtgcccgccaccatacctggctaatttttgtatttttagtagagacggggtttcactatgttggccaggctggtctcgaactccggacctcatgatctgcccaccttggcctcccaaagtgctggaattataggcgtgagccaccgtgcccggccatagtttttcattaaatcaaagttagtgtttgtgttaggtaaatatgactcagatctgggctatgacataaaatttgattacatttcctttgttgtataactatagtttcctgatgttaatattgcctttctttttcaccccccccccccattttctttttttctttgacacagggtctccctgtgttgcccaggctggagtgtagagactccatctctaaagtaattaattaattaattaattaattaaattattttttcagatttcaattctttgctgaagtttttcagctttttatttaacttattcgatccctccttgaattctgtaatactgatgtggtttggctctgtgtctgcacccaaatctcatcttgaattgtaatccccacatgtccagggagggacctggtagaaggtgactggatcatgggggcgattcccccatgctgttctcatgacagtaagttctcacaagatttgatggcttaaaagtgtttggcaggctgggcgctgttggctcacacctgtaatcccagcactttgggaggccaaggcgggtggatcacaatgtcaggagttcaagaccagcctgaccaacatggtgaa

SEQ ID NO: 460289 - DNA, 624 bp, Homo sapiens
  misc_feature (3)..(4): n is a, c, g, or t
  misc_feature (7)..(7): n is a, c, g, or t
  misc_feature (15)..(15): n is a, c, g, or t
tcnnttnccccaaancctaatgccatgtctggcacaagatttttacagctggttaacaatagctgtaaattccttggtgttactctcatctggagaaggaggttctggaattggttcccagaactgctgctgtcgttgcaggtttgaaatcctcagggaaatactgcagctgaccccagagaaacttgcaagaacatgcttgaaaatgggaaacatattagaagcagaggttcttagtggcaaagaatttaacgtaatgtcctcgaggttcatccatgttgtagcatttgtcagaattttcttcctcttgaaggctgaagagcagtccgttgtatgtacataccgcattttgtttatccattcatccattgatagacacttgagttgcttccacatttttgctattgcgcataatgctgccatgaacatgggcatcagttgcagctgttttttctccaagaaaatgacatcctgagctaagccagactgtctctcgcttacccctcaactgtgccatttatgagaaaattcaaactttgtctaatgctacaagctgggaaactatgtctacaaccaaaataaaggatttaaatcttgattactcatgggcttaaatcatacctg

SEQ ID NO: 460290 - DNA, 777 bp, Homo sapiens
ggacgagcacccggcggcggggcacatgctgcccccgcccctgcgcgcctgcggctcccggctctccctcccctgcgccgcgctctcgcctcgctttccgcgggagccttccaaccggttctcggctagggagaaggacgggagcggtgggaagagcgagggtgtagagagggaagttagggctttcgctttctccccccactccagcggcggcgttcggtcctctgggtggaatgtgctcgcagcagcagtgacggcggccacagcacgggaggcacccgagccatacaccctgcagctggagagaaaaggatggccgaggaggaagtcccagggccgcgaagctacgacggagatccgtcctggaaaagccttctccaccctgggcactttaagcggcggtggcggcaaacggcaggaggttgcagacccgacagcgagactccctcattccagtcttgctctgccctccggagatgacaagtgagaaagaagtgtccggccgggccatccccttcagagaagcaaccacttcacaagaagattctgaagttggccatttttgatcccagaacagtttctcatagattagaaatattggagtctacacaaaaatcgatattcatttacaagatcatcactaaacttatcttgcataacttaccaagaataactgtaaaatgtgctgggaatgcaatgtcctgagataaggaagaactgcctgaaacagcctggatcttattcctgtacttcctagggaatgtaacatctcaagtt

SEQ ID NO: 460291 - DNA, 1073 bp, Homo sapiens
agcacagggttccggggtcacagccttgggagttgagtttttgccagtgggattccctggcaggagggggaggaggtcagcttcctccctgatcagccaccatggatctggggctgctgtggctgtggactcgactgttccggctgggaacctacctgactcacacaggggctccctgggacatgcgtgggggccctgccatttccattcctttccccaaccgggctctgtcttttcaaagagccagccttgggggaggccgagccgaggaagctgtatccttgctgcagtggctctgttcccacgtgagcaccgtggccatcgtggactctcgcaccctcctgctcctgcagctattgaggcctccgggccggccccacctctctctcagaactgtgtcccctcctcctttctccccacactcccaggccccaggcaccctatccttcggctgcatataccactcccagggggaaccaggacccctcgccaccgggccttcgctgttgctgttccccacttgttcctgtccaagtcttgagccctccaaccacaagaaaatgaatccagccagcaacctgaatgagctgggagccgacacatcccagagcctccagaaaggagcgcagcccctggacatctctactgcagcctgtgagactctccgcggaggacgcggctgagccatgctgacgtgcagaacttccagctatggaatttgtgtttaggctgttcggtttgtggtcatttgttacagagcaatagaaaaataatacagtgagtatgtctcaaatatcgcacaggacatggactgaaaaagcatcagtcaaatttaactgggtcttctgtcattttgtctgctaaatctggcaacttaaatcccaggaaggggcccatggacttcggactgcatccatggcacaaaaagatgaagaaccgggctagaggccaggcccagtggctcatgcctataatcccagcactttgggaggccaagacaagtaaatctcctgaggttaggagtttgaaaccagcctggccaacatgctgaaaatacaaaattacaaaaaata

SEQ ID NO: 460292 - DNA, 1353 bp, Homo sapiens
tgagttcatgtcctttgtagggacatggatgaagctggaaaccatcattctcagcaaactatcgcaaggacaaaaaaccaaacaccgcatgttctcacccataggagcatgaaccctgttgtgaactgtgcatatgggaaatctagattgtgtgctccttatgagaatctaactaatacctggagaaaaaaaagcaagttgtttccagtaatactaacatctaaacatcttggtgatgatatatttgttacttttattgttaaaaacaaaatttctcattttattttgcattttgaaaaaggagacaggaggagagaagaatcatggactccctgggcacagcaccgcaggtggctttgccagttctcccagccccgcgctgctcctgcgcctgcgctgagcctccacgtgtcctcaggagacttagcctagcctgggtatcaccagcagtgggccaggccgctttgccttcaactcccaacagtaaccttgcagaggtcagcctggggccaccaggaggagttagtaagagcttatcctgtgggggcactcactggggctggtggccgggaaatcccaggtgttttgttggtttgagttttgttgtgtttttatttttcttccgctgagatcaggactgaagcagggacgcagtgctcagcacgcccagcccaccgcgggccactgcgcggagaacctctgccagggtcgcctgctcacgtcccctaatccgctcctggcgcgcgttcctgtcctcctcctgctgtgactagtgtgcatggaagggcacagtggtggcagaaagacttgtggcgagatatcaagatccacaggaagtcataagagaaaaagcattttgtttgaactccacccactgaccttttgtggtttggcagggccagctgctggcaggctcccccagtgctgaatgctccgcgctccactgtgctgggcctgctgaaaaagcagacagcgctccctctcccccagaatcaggagccaaatgccacaccgattgtgcaacttgtctctggttaccaggaaaacgtaaagaaatgccaatgaagcagaaaggtcgacaaaattctttccaacgcttgaacaaaaaaggtatttttagggccctagatttatggaagtcaattcttccactcctcgccaggctttcaaacctcctattctttgcactacattatttgaataaaccgtaaatacccttagttgctctaatagcaactgctggtccatattgtgcaaggcggccatggtctgaagaccttgttgaatttgaaagacagaagttccgtttctggcacataaacttgaatcagggctatagttaagagtgccagt

SEQ ID NO: 460293 - DNA, 1524 bp, Homo sapiens
tgagttcatgtcctttgtagggacatggatgaagctggaaaccatcattctcagcaaactatcgcaaggacaaaaaaccaaacaccgcatgttctcacccataggagcatgaaccctgttgtgaactgtgcatatgggaaatctagattgtgtgctccttatgagaatctaactaatacctggagaaaaaaaagcaagttgtttccagtaatactaacatctaaacatcttggtgatgatatatttgttacttttattgttaaaaacaaaatttctcattttattttgcattttgaaaaaggagacaggaggagagaagaatcatggactccctgggcacagcaccgcaggtggctttgccagttctcccagccccgcgctgctcctgcgcctgcgctgagcctccacgtgtcctcaggagacttagcctagcctgggtatcaccagcagtgggccaggccgctttgccttcaactcccaacagtaaccttgcagaggtcagcctggggccaccaggaggagttagtaagagcttatcctgtgggggcactcactggggctggtggccgggaaatcccaggtgttttgttggtttgagttttgttgtgtttttatttttcttccgctgagatcaggactgaagcagggacgcagtgctcagcacgcccagcccaccgcgggccactgcgcggagaacctctgccagggtcgcctgctcacgtcccctaatccgctcctggcgcgcgttcctgtcctcctcctgctgtgactagtgtgcatggaagggcacagtggtggcagaaagacttgtggcgagatatcaagatccacaggaagtcataagagaaaaagcattttgtttgaactccacccactgaccttttgtgggtgagctttcggtgaaacagcaacatcctcagaaatcttagagacacggctttgtaacccgggggagagacaccgcttccaaatataattgacgtggctttcctgccttaattcggggtatcctttttccaccacataatcttccctttgtccgcgctgattcctgtttagtttggcagggccagctgctggcaggctcccccagtgctgaatgctccgcgctccactgtgctgggcctgctgaaaaagcagacagcgctccctctcccccagaatcaggagccaaatgccacaccgattgtgcaacttgtctctggttaccaggaaaacgtaaagaaatgccaatgaagcagaaaggtcgacaaaattctttccaacgcttgaacaaaaaaggtatttttagggccctagatttatggaagtcaattcttccactcctcgccaggctttcaaacctcctattctttgcactacattatttgaataaaccgtaaatacccttagttgctctaatagcaactgctggtccatattgtgcaaggcggccatggtctgaagaccttgttgaatttgaaagacagaagttccgtttctggcacataaacttgaatcagggctatagttaagagtgccagt

SEQ ID NO: 460294 - DNA, 1569 bp, Homo sapiens
ctgagccatcattccttccaggggagcctctcgggaggcctacctgctggagcacagccacaatgggggaccagttcatcatgctgagctgcgagtggcctggcggcgagccccctgccacgctgggctggcttgacgaacagcagcagcccctgggcggcagcagctcctcgatggccgttcacctcctgcaggcccaagaagatctggctggcagagagttcacctgccggggcactcacctgctcaggacccctgacccccactgccacctccagctggggagcaaaggcaccaacagaggggttccagagaagatgctgaggcaccggcaggccttgaaacaccaaccaccaccccaggtttggatcctgcacaagaaaccacggattctccagtgaatgtcaccatcacagtgactgcaacaccataaggcccaaagaggaagatgcaaataggcttagggagggcaggtgggatttgggaagagcccttctgtcagactttggtcataaaaccaacgtagctaagacaccaactaccactttcacttaatacccagtcttcacaactggtacaaggcccagctgcagtgtccctaagtgacatggttacaagagaagccctggcccaccttgtggaagacagaggtggcaggacaaggaagaggacccacaatggggagacagggatctctgggtgtggaggtggtagacagggggcgtcaaggggagaaatgtggacctctggaagacgaagtcataagcagagctctgcccgcggaggccagagagcagcttctctggctgcggagttggagcctcggaggaattccacggcagggatagatcacagcatacggaacgggactggttccatccaaagagtgaaccacaatgcttttggaaagcagtatggaaaaatgggaggagcccagattatggctccagataaactagatgagttgtgggggttaaatgagttaacagtaacaagcaccgagcacagtgcctggtacacagtagttattcagcacgtgttagtgctgtctcccacactgtaccatgtcctctcatttcctggtgaagtgacattaggtaggactgtttgggtgcctgtgcagggcagagccaactcacgcttagggagaactcataccgcctaaatataaaggcaattatatatatatatatatatgtgtgtgtgtgtgtgtgtgtgtgtgtttatatatatatatttatatatttcaatatataaaggcattttttataaataaaatacaataaaaagaataacacttaaaacagcgttactaataatataaataaagcagtccacaatgagattgtcctaaaggtaaagccattttctcttcctcgtggacagatcccatattcaaactcaatctttaaaagcagttcatgacctaaggctcatgctaatacacctgtttcctaaatcaaaatggctgtctacggacaatgactccccagttttctaaaactccctttgtgacagcattgctgtaacttgattggctaacacagggtatgttttcatattctgtgc

SEQ ID NO: 460295 - DNA, 1098 bp, Homo sapiens
acaacatgtgaggcatttgggaatgtctcagttaacgtggtacataagttccttgctctaatagagctcacatttggatgtcttctaattctgaacctgaatgtaagagcacaatacaatcaatgaagcagtgagcccaggaagccatggatcttcacaagcctcaggaaaagtcaacatttaaaattttctatttaaagtccaagggcacagcaagctcttggtctatatgggaaggccatggactacaattcccacaagtccgtgcgacctctccgttctgcgcagcttcgcggtatgaggaagagggtcctgtcaggcgcactcttgttgcatcatcagcgtgcacctccacgatgaaacaggtctgggctacaaaagtatggccgcttctgaggcggcggtggtgtcttcgccgtctttgaaaacagacacatcccctgtccttgaaactgcaggaacggtcgcagcaatggctgcgaccccgtcagcaagggctgcagccgcggtggttgcggccgcggccaggaccggatccgaagccagggtctccaaggccgctttggctaccaagctgctgtccttgagcggcgtgttcgccgtgcacaagcccaaagggcccacttcagccgagctgctgaatcggttgaaggagaagctgctggcagaagctggaatgccttctccagaatggaccaagaggaaaaagcagactttgaaaattgggcatggagggactctagacagcgcagcccgaggagttctggttgttggaattggaagcggaacaaaaatgttgaccagtatgttgtcagggtccaagagatatactgccattggagaactggggaaagctactgatacactagattctacggggagggtaacagaagaaaaaccttacggtatgaagctcatctaatgtaggcctcttttctaacatttaggaaaagtttctgtgcaggtagcattttaaaacaaatctctgatattatcagccattttaattctcagtgtgtttctttgggctaagaagattggaaattgtttatcgcattgttgcttacttgataggagtttttgaataaagatttattg

SEQ ID NO: 460296 - DNA, 973 bp, Homo sapiens
ataagcatcagacaggcatttacaacatatgggcaacatatgttgaaatatgttagtgtttaaatgaaaacactaaaacaattcttagtatgagacaaaactgtaaggaaaaagagtgttaataccatgatgcattaacataaaatatcaaacacacaaagtcataaaatgaaaatttacagttttacctgttcatatctagtgccccacagtgtgtgtcaaccaaaggtggcagtggctacatctgcctgttggactggtacaggttacaatatgtcctcttccattgcaaattaaagtccaaatagagaaatacttaggttttagaacacatcagaggtatttctgctgtatttttcaccttaaaaattgacacagagtttactaatagaggagtagagattgttgaccatttttaaaaaacgatagccactctttttcttttatgtttaaaactgaagttttgccaaatgggaaaattactgttacctctaccatcttaatgtagtaactttagaatttaaatttttatattactattttcctttttgttgttcacatagtcttaaggcacctatacttttaaattgactttttcatttgatattatctatatgtatgtagttgtgataatgattattttaattatattactttatactcttaatttatttagagtatttctctattgctgaatacttaagtagttttaaattttattatgataaattcctgggagggggattatttagtgaaataatatgaagaactttatgacttatgtttgccttattgcattcccaaagagttgtaacattttacagtgttaccatttgagtaggggttttatatgttgttgctaatttagtaaacataggagagaaatcaaagtttttctgatttgcttttatgtgatttatctgtatactttgttcatttatataaataaatgtcttaatggtttctatacata

SEQ ID NO: 460297 - DNA, 1969 bp, Homo sapiens
acaacatgtgaggcatttgggaatgtctcagttaacgtggtacataagttccttgctctaatagagctcacatttggatgtcttctaattctgaacctgaatgtaagagcacaatacaatcaatgaagcagtgagcccaggaagccatggatcttcacaagcctcaggaaaagtcaacatttaaaattttctatttaaagtccaagggcacagcaagctcttggtctatatgggaaggccatggactacaattcccacaagtccgtgcgacctctccgttctgcgcagcttcgcggtatgaggaagagggtcctgtcaggcgcactcttgttgcatcatcagcgtgcacctccacgatgaaacaggtctgggctacaaaagtatggccgcttctgaggcggcggtggtgtcttcgccgtctttgaaaacagacacatcccctgtccttgaaactgcaggaacggtcgcagcaatggctgcgaccccgtcagcaagggctgcagccgcggtggttgcggccgcggccaggaccggatccgaagccagggtctccaaggccgctttggctaccaagctgctgtccttgagcggcgtgttcgccgtgcacaagcccaaagggcccacttcagccgagctgctgaatcggttgaaggagaagctgctggcagaagctggaatgccttctccagaatggaccaagaggaaaaagcagactttgaaaattgggcatggagggactctagacagcgcagcccgaggagttctggttgttggaattggaagcggaacaaaaatgttgaccagtatgttgtcagggtccaagagatatactgccattggagaactggggaaagctactgatacactagattctacggggagggtaacagaagaaaaaccttacgataaaataacacaagaagatattgaaggcattctacagaaatttactggaaatataatgcaagtgccccccctctattctgcattaaagaaagatggacaaagactttcgactttgatgaagagaggtgaagtcgtagaagcaaaacctgccaggccagtgactgtatacagtatctcccttcaaaaattccagccaccatttttcacattagatgttgaatgtggaggaggtttttatatcagaagcttggtcagtgacattggaaaagaactatcttcctgtgccaatgtgctagagctgacccgaaccaaacagggaccatttacgctagaagaacatgcccttcctgaagacaaatggacaattgatgacattgcacagtctcttgagcattgctcatctcttttcccagcagagttggcacttaaaaaatcaaaacctgagtctaatgaacaggttttgagctgtgaatatataactctaaatgagccaaagagagaagatgatgtaattaagacgtgttgagattggcctgggaatatcatcattttctagttgacatttgaatcctgtgtgcagatgcagaatgacaagctgcattcaaaagacaaacaatatgtcttttttttttttgcatgaagaaaaatgtctatcatttacagtttcaatagcacataatttattttctatgcattataaatggccttgcagttggctcagttgtttgttgtgttgtgaaatgttttaggattttttgtattgtgaaaatatgaatatgattggattcagaaaaattaactttctgaatttgatctgtcttcagtcttgtgaaaaagttgaacaaatttcctaatcaaagaaaaaagtatgagctccatgtttctttagtttcacaaaaatgaccataatttagtgttatttttactttatttaggcctctctgtccagtatttttggcttttgtagctctctcttttagacaaagcagcttcttcagtcatatcctcttcttctaagatacactcagtcttacagggaattcagactctatgaactatatac

SEQ ID NO: 460298 - DNA, 5175 bp, Homo sapiens
acaacatgtgaggcatttgggaatgtctcagttaacgtggtacataagttccttgctctaatagagctcacatttggatgtcttctaattctgaacctgaatgtaagagcacaatacaatcaatgaagcagtgagcccaggaagccatggatcttcacaagcctcaggaaaagtcaacatttaaaattttctatttaaagtccaagggcacagcaagctcttggtctatatgggaaggccatggactacaattcccacaagtccgtgcgacctctccgttctgcgcagcttcgcggtatgaggaagagggtcctgtcaggcgcactcttgttgcatcatcagcgtgcacctccacgatgaaacaggtctgggctacaaaagtatggccgcttctgaggcggcggtggtgtcttcgccgtctttgaaaacagacacatcccctgtccttgaaactgcaggaacggtcgcagcaatggctgcgaccccgtcagcaagggctgcagccgcggtggttgcggccgcggccaggaccggatccgaagccagggtctccaaggccgctttggctaccaagctgctgtccttgagcggcgtgttcgccgtgcacaagcccaaagggcccacttcagccgagctgctgaatcggttgaaggagaagctgctggcagaagctggaatgccttctccagaatggaccaagaggaaaaagcagactttgaaaattgggcatggagggactctagacagcgcagcccgaggagttctggttgttggaattggaagcggaacaaaaatgttgaccagtatgttgtcagggtccaagagatatactgccattggagaactggggaaagctactgatacactagattctacggggagggtaacagaagaaaaaccttacgataaaataacacaagaagatattgaaggcattctacagaaatttactggaaatataatgcaagtgccccccctctattctgcattaaagaaagatggacaaagactttcgactttgatgaagagaggtgaagtcgtagaagcaaaacctgccaggccagtgactgtatacagtatctcccttcaaaaattccagccaccatttttcacattagatgttgaatgtggaggaggtttttatatcagaagcttggtcagtgacattggaaaagaactatcttcctgtgccaatgtgctagagctgacccgaaccaaacagggaccatttacgctagaagaacatgcccttcctgaagacaaatggacaattgatgacattgcacagtctcttgagcattgctcatctcttttcccagcagagttggcacttaaaaaatcaaaacctgagtctaatgaacaggttttgagctgtgaatatataactctaaatgagccaaagagagaagatgatgtaattaagacgtgttgagattggcctgggaatatcatcattttctagttgacatttgaatcctgtgtgcagatgcagaatgacaagctgcattcaaaagacaaacaatatgtcttttttttttttgcatgaagaaaaatgtctatcatttacagtttcaatagcacataatttattttctatgcattataaatggccttgcagttggctcagttgtttgttgtgttgtgaaatgttttaggattttttgtattgtgaaaatatgaatatgattggattcagaaaaattaactttctgaatttgatctgtcttcagtcttgtgaaaaagttgaacaaatttcctaatcaaagaaaaaagtatgagctccatgtttctttagtttcacaaaaatgaccataatttagtgttatttttactttatttaggcttcctggtggcttcattttattgaaattctttaaattgtttaaagtggccattattgatctctttcttctgttttggagagtttattattaaaaacatttctttgataaaatggccatcatctagtaatacctgtgtttgtttagatcttggaaatgaataagctttgataatatttgtaaatgaaccaaattattactgctaccactaacaggttgtaaatagaagactaatacttaattaaagtcaccttcctaccattagagcagaagacagctcctatagttttgtattttggcagctatgagatattttcatggtaatgtcaacatggtcaagcactttgtaccaagttattaagtaacataatttttaaaatttaaagaatgtgtcttcaactaaaaactttattctttagcatttatttatatttctctgtagggtgttccctgtgacattgtctctttagtttgctctttcaagagatacttacagatgttgagatggctgccctgcatttccagctaatctcttctgctctaaatatttaaaaacagttcttctcaaacattttcattcagatagctttctgaaagttccctatccctctttaccataattttttaaatgtagccacattgtaatagtaaacttcatatataatgagtgcttcatatttttgttatgggaaagcaatatattatgcagccagtctgtagaaacattcagatccctcttcctttactcaaatacagtttcaaaaggaagactcatgagaaatttcataaaatacaagtttttagatgtttatgctttgcctttctttttaaaggtgttttcctgctttgtagtctctaactctgaaatttaaaatatgtaaactaaagtggttttatttgtgcttaacccaatttaaactcaatgtaaaatgttatatatgcatcagtacagcattttcaacatattggcaacatattttaaatgaaaacactaaaacaattcttagtatgagacaaaactgtaaggaaaaagagtgttaataccatgatgcattaacataaaatatcaaacacacaaagtcataaaatgaaaatttacagttttacctgttcatatctagtgccccacagtgtgtgtcaaccaaaggtggcagtggctacatctgcctgttggactggtacaggttacaatatgtcctcttccattgcaaattaaagtccaaatagagaaatacttaggttttagaacacatcagaggtatttctgctgtatttttcaccttaaaaattgacacagagtttactaatagaggagtagagattgttgaccatttttaaaaaacgatagccactctttttcttttatgtttaaaactgaagttttgccaaatgggaaaattactgttacctctaccatcttaatgtagtaactttagaatttaaatttttatattactattttcctttttgttgttcacatagtcttaaggcacctatacttttaaattgactttttcatttgatattatctatatgtatgtagttgtgataatgattattttaattatattactttatactcttaatttatttagagtatttctctattgctgaatacttaagtagttttaaattttattatgataaattcctgggagggggattatttagtgaaataatatgaagaactttatgacttatgtttgccttattgcattcccaaagagttgtaacattttacagtgttaccatttgagtaggggttttatatgttgttgctaatttagtaaacataggagagaaatcaaagtttttctgatttgcttttatgtgatttatctgtatactttgttcatttatataaataaatgtcttaatggtttctatacatatttgcatgagttatttgtgttgtaaatacctgatagaaggatttttcacggtctgttgtccttttagttttaattttcatttttgctaactaaatttgctaattctaataactcttccccttttatcattgtcagattaataagtatgaaaaattttaaatttattgagactttaaaatcttactaactctcataagcagttgaaactgagatactctgaaaagttcaagactcattcataaaacaaattagttttccctgatagtctggtatttaaataccaactcagtttttttttcatttttatcaaaatattcaagaaatttctgtgtcttatatttttctaggtctaaaccttcatgacatgataaagttgttttacttgtaagaaaacgataaaagatttaaaaaatcctgaaaatgtttcaacctggaacataccaaatcacttcattttgacactttaagttttttatatttgaaaaataatgtcttaaaagttgttaaaagtcatagaattattttatttatagtcttaaaatccaggacctttatgtaatagaaatttgctctttgcaaattcaaagttttgaaatgtgaataaaggctaaacacagtttcctctacctgtactgactagatatttttttcttaaatacttgaattaaaacaagccattgactcatcatcagaaatgagttactgtattaaataagagtgctttgtatcagatcttcagtacattttatgtcccctgaccagtttgaaatttgtatcagatttacaatgaacattttgaggttcaattagatggtgaattgttctgtttcaaagaaaagaaatataaatattttatctaggttttgctgatggcagtcaagcatgaacacaacccactgtttgagaagctgtaatttctgaatttctgcagagtgcacatctaggccagcaaatggcagtaagagtgaggtggatttagctcagtgtaaggatgaactccagaaccatcggctctgactgaaagtgaagcggcagccgcgttgtgggaaagctggctggagtctctctcataagcaggcattctttttctccagcccgtcactgtgttggtttgggcccacgtttgtggcacattctaggcactcgccatcatgaaataaacctctggagctgtgatattacaaacgtggaaagatgacgagcactcagcaactttcaatgaagcgaagagacaaggagcaatcccatgtgtaatagaaaaaggcagcctgaattgttgttgctgtttttgaaatttaagctggttttcgattaaattcagtaaatggtccaggactataaatgttgaacattttttaccgtgtgatttaaattttagtcttattgttttttttttttttgatggtttacattttccccatgggaagcagctatgtcatgtc

SEQ ID NO: 460299 - DNA, 3733 bp, Homo sapiens
acaacatgtgaggcatttgggaatgtctcagttaacgtggtacataagttccttgctctaatagagctcacatttggatgtcttctaattctgaacctgaatgtaagagcacaatacaatcaatgaagcagtgagcccaggaagccatggatcttcacaagcctcaggaaaagtcaacatttaaaattttctatttaaagtccaagggcacagcaagctcttggtctatatgggaaggccatggactacaattcccacaagtccgtgcgacctctccgttctgcgcagcttcgcggtatgaggaagagggtcctgtcaggcgcactcttgttgcatcatcagcgtgcacctccacgatgaaacaggtctgggctacaaaagtatggccgcttctgaggcggcggtggtgtcttcgccgtctttgaaaacagacacatcccctgtccttgaaactgcaggaacggtcgcagcaatggctgcgaccccgtcagcaagggctgcagccgcggtggttgcggccgcggccaggaccggatccgaagccagggtctccaaggccgctttggctaccaagctgctgtccttgagcggcgtgttcgccgtgcacaagcccaaagggcccacttcagccgagctgctgaatcggttgaaggagaagctgctggcagaagctggaatgccttctccagaatggaccaagaggaaaaagcagactttgaaaattgggcatggagggactctagacagcgcagcccgaggagttctggttgttggaattggaagcggaacaaaaatgttgaccagtatgttgtcagggtccaagagatatactgccattggagaactggggaaagctactgatacactagattctacggggagggtaacagaagaaaaaccttacgataaaataacacaagaagatattgaaggcattctacagaaatttactggaaatataatgcaagtgccccccctctattctgcattaaagaaagatggacaaagactttcgactttgatgaagagaggtgaagtcgtagaagcaaaacctgccaggccagtgactgtatacagtatctcccttcaaaaattccagccaccatttttcacattagatgttgaatgtggaggaggtttttatatcagaagcttggtcagtgacattggaaaagaactatcttcctgtgccaatgtgctagagctgacccgaaccaaacagggaccatttacgctagaagaacatgcccttcctgaagacaaatggacaattgatgacattgcacagtctcttgagcattgctcatctcttttcccagcagagttggcacttaaaaaatcaaaacctgagtctaatgaacaggttttgagctgtgaatatataactctaaatgagccaaagagagaagatgatgtaattaagacgtgttgagattggcctgggaatatcatcattttctagttgacatttgaatcctgtgtgcagatgcagaatgacaagctgcattcaaaagacaaacaatatgtcttttttttttttgcatgaagaaaaatgtctatcatttacagtttcaatagcacataatttattttctatgcattataaatggccttgcagttggctcagttgtttgttgtgttgtgaaatgttttaggattttttgtattgtgaaaatatgaatatgattggattcagaaaaattaactttctgaatttgatctgtcttcagtcttgtgaaaaagttgaacaaatttcctaatcaaagaaaaaagtatgagctccatgtttctttagtttcacaaaaatgaccataatttagtgttatttttactttatttaggcttcctggtggcttcattttattgaaattctttaaattgtttaaagtggccattattgatctctttcttctgttttggagagtttattattaaaaacatttctttgataaaatggccatcatctagtaatacctgtgtttgtttagatcttggaaatgaataagctttgataatatttgtaaatgaaccaaattattactgctaccactaacaggttgtaaatagaagactaatacttaattaaagtcaccttcctaccattagagcagaagacagctcctatagttttgtattttggcagctatgagatattttcatggtaatgtcaacatggtcaagcactttgtaccaagttattaagtaacataatttttaaaatttaaagaatgtgtcttcaactaaaaactttattctttagcatttatttatatttctctgtagggtgttccctgtgacattgtctctttagtttgctctttcaagagatacttacagatgttgagatggctgccctgcatttccagctaatctcttctgctctaaatatttaaaaacagttcttctcaaacattttcattcagatagctttctgaaagttccctatccctctttaccataattttttaaatgtagccacattgtaatagtaaacttcatatataatgagtgcttcatatttttgttatgggaaagcaatatattatgcagccagtctgtagaaacattcagatccctcttcctttactcaaatacagtttcaaaaggaagactcatgagaaatttcataaaatacaagtttttagatgtttatgctttgcctttctttttaaaggtgttttcctgctttgtagtctctaactctgaaatttaaaatatgtaaactaaagtggttttatttgtgcttaacccaatttaaactcaatgtaaaatgttatatatgcatcagtacagcattttcaacatattggcaacatattttaaatgaaaacactaaaacaattcttagtatgagacaaaactgtaaggaaaaagagtgttaataccatgatgcattaacataaaatatcaaacacacaaagtcataaaatgaaaatttacagttttacctgttcatatctagtgccccacagtgtgtgtcaaccaaaggtggcagtggctacatctgcctgttggactggtacaggttacaatatgtcctcttccattgcaaattaaagtccaaatagagaaatacttaggttttagaacacatcagaggtatttctgctgtatttttcaccttaaaaattgacacagagtttactaatagaggagtagagattgttgaccatttttaaaaaacgatagccactctttttcttttatgtttaaaactgaagttttgccaaatgggaaaattactgttacctctaccatcttaatgtagtaactttagaatttaaatttttatattactattttcctttttgttgttcacatagtcttaaggcacctatacttttaaattgactttttcatttgatattatctatatgtatgtagttgtgataatgattattttaattatattactttatactcttaatttatttagagtatttctctattgctgaatacttaagtagttttaaattttattatgataaattcctgggagggggattatttagtgaaataatatgaagaactttatgacttatgtttgccttattgcattcccaaagagttgtaacattttacagtgttaccatttgagtaggggttttatatgttgttgctaatttagtaaacataggagagaaatcaaagtttttctgatttgcttttatgtgatttatctgtatactttgttcatttatataaataaatgtcttaatggtttctatacata

SEQ ID NO: 460300 - DNA, 348 bp, Homo sapiens
tccgaagccagggtctccaaggccgctttggctaccaagctgctgtccttgagcggcgtgttcgccgtgcacaagcccaaagggcccacttcagccgagctgctgaatcggttgaaggagaagctgctggcaggtactgcagcccgggtggggaccaggctgaggcggtcgctgcgagaggggaagcacattaggctttttgcgacgctcgtgattcaagagacaaaaggaggggaaagggagactgaccattgaattagctctggacaggaatctcgggcatctcgggcttggacttgccctggcacgaactcttgtagcctacttggcagttgtagttctcaacgg

SEQ ID NO: 460301 - DNA, 1097 bp, Homo sapiens
tgctttgcatgagaaagcgcagcggcccggggcagcctcctccccgccgccccgccgcgggctcccgggccccgcgggggccgatcccccccggcctgcagcccagcctgcggggggcgcagcgcctagtcccgcccgcgtcgcccgccagccccgggacagcccgcctggcgcgcggggctctgcgcgctgcgaccctccccggcagtcccgcccgcctctcctcgccctctctctgcctggcctccaactttgcctctcgctatcctctccgccggcgccccctttcccggcggtccccgggatggtccccggcaccccgaggacgccgaggttacgggaagttcggggactggcgggagaaggggtttgggggtggtccgcggcgaggggcgcggggtgcatcttctcttccttttatggtgagtcccgggcggagggcgctttcaaagggaggtgggatttgcgttttatagcctgggccataaagtaggcccttgcttgtaaacctgcccgcatcttcctgaggctggggaggtgctaccagccccgggctccgggctccgaggagggattttctttgaaatttcaaagagacgagctaaggggagggggaggggctcgagaatccggattttagggccgctcatccgaggtctcctctaagaaggcgggaagggggaggggcgggaagcgtcccgggactttgaacaccgcctcccaccccgcgggaagtgcgggcttggtttgtaccgcggtgacccccgccccctccgaagccgcagagccggggcctcgcgccagagggctggagatgccttcttggcggctgagtttatttattataggaagtcattcgctcgtggggtatttatgtgatttggcgagtgatgtgcccggccagcgccctccttggctgcagccccgcaggaggacccggagtagggtgggatggagtgggtcgtgggaggagcgcgtcagcgcctgcccggggacccccagctcccgcgaggacacggaggcgcgcacgccgctcggttttcctggaaagtggagaaggagcgtcctgggcaggtcctctgagctcatcccccctc

SEQ ID NO: 460302 - DNA, 1477 bp, Homo sapiens
ggtactgctacctagggggtactgctacctaagtgggtactgctacctagtggggtactgctacctagtggggtacttgctacctagtggggtactgctacctagtgccaagatggcttactaatagcatcacttacgagtctttctcttttctatagggctgccacacttgtgtatcccttcttccttgaatttaaccaggagtgagcagtggacagcttcttccctatgagaaggaggtgaagcaggacctgaaatcccgtgctcagctcccacatgccccgtgtccaggacaagtcctttgctgaatcagcggcagacaccacccggagccctgcgggagcctttccctgttcttccagcatggatctgaaactcccttcccactttctgcagcctcccagagatagttcaggctccagcctcatgtgatagcatgaagagaaactggttccaacagctgtgtgctctgctgccctcatcccaaacaacagtttaaatgcacaattacgcttttctctaaggcccaaaataggataggaaagatcgttttgctatccctgaatgcctgtcacccttgtttcgtaaggtaagattgggaagggcttggccattgcccttgcggctgagaaaccaactttaggaataaagacactctctccatgtctgacaaatgtctgcccatctgctggcaggaagtcagtcccagaatagttgttctgctccctcccttctaataagtgctgcgctgagtgtgcttgctttgccagatggttaaaacagagcaggggatagaaggacagatgtcttcaccctcatggagttcaccttccagtaggaggaggcgataggccggggtctgcacatgtgcgtgctacagcctgttccacgtagagacaggatttcaccatgttggctaggatggtctcgatctcctgaccttgtgatccgcccctccctcagcctcccaaagtgctgggattacaggcgtgagccactgcaccctgccagaaaactcattcttctactccatcctacagttttccctaagagagaaacaataaaacgccaccacgaccaatggcaaaaagctggcacccactccacgacttttcatatctacacgtttgtacagctttatttttaagcattctgaaattctatgcaggagagaccccagctaggtttagggagtcctagggtttgtggagtaaatgaagtttctccctagaattagggagggtagagacaggcagagaactgacaatcctaacagctgctgtcctcagagccactgtttctgagagctgctcgctgagtgcttctagcgagttaaatggtgttcgcccaaaagacctgttcacgtcctgatcctgggaacctgtggctgtgatcttatttggaaaaagctctacattacgtctttgcagaagtaatcatgttaaggatcttgagaggacgtgaccctgaattatcc

SEQ ID NO: 460303 - DNA, 1607 bp, Homo sapiens
tgtgaccccaggcaagttacttaacctctctgagattctttctgtttcctctgctgtaaaatgggaacaatgacacttacttgatcaggttcggggtaggaatgaagtgagataactcagtaagctctgagaaccgagttggcacataatgctagccctgtgggattcactggtctgtaaactttctggttagttgacttttctttgttaaattcatttgtcttcactggccggaagccaagatggcttactaatagcatcacttacgagtctttctcttttctatagggctgccacacttgtgtatcccttcttccttgaatttaaccaggagtgagcagtggacagcttcttccctatgagaaggaggtgaagcaggacctgaaatcccgtgctcagctcccacatgccccgtgtccaggacaagtcctttgctgaatcagcggcagacaccacccggagccctgcgggagcctttccctgttcttccagcatggatctgaaactcccttcccactttctgcagcctcccagagatagttcaggctccagcctcatgtgatagcatgaagagaaactggttccaacagctgtgtgctctgctgccctcatcccaaacaacagtttaaatgcacaattacgcttttctctaaggcccaaaataggataggaaagatcgttttgctatccctgaatgcctgtcacccttgtttcgtaaggtaagattgggaagggcttggccattgcccttgcggctgagaaaccaactttaggaataaagacactctctccatgtctgacaaatgtctgcccatctgctggcaggaagtcagtcccagaatagttgttctgctccctcccttctaataagtgctgcgctgagtgtgcttgctttgccagatggttaaaacagagcaggggatagaaggacagatgtcttcaccctcatggagttcaccttccagtaggaggaggcgataggccggggtctgcacatgtgcgtgctacagcctgttccacgtagagacaggatttcaccatgttggctaggatggtctcgatctcctgaccttgtgatccgcccctccctcagcctcccaaagtgctgggattacaggcgtgagccactgcaccctgccagaaaactcattcttctactccatcctacagttttccctaagagagaaacaataaaacgccaccacgaccaatggcaaaaagctggcacccactccacgacttttcatatctacacgtttgtacagctttatttttaagcattctgaaattctatgcaggagagaccccagctaggtttagggagtcctagggtttgtggagtaaatgaagtttctccctagaattagggagggtagagacaggcagagaactgacaatcctaacagctgctgtcctcagagccactgtttctgagagctgctcgctgagtgcttctagcgagttaaatggtgttcgcccaaaagacctgttcacgtcctgatcctgggaacctgtggctgtgatcttatttggaaaaagctctacattacgtctttgcagaagtaatcatgttaaggatcttgagaggacgtgaccctgaattatcc

SEQ ID NO: 460304 - DNA, 1741 bp, Homo sapiens
tgctttgcatgagaaagcgcagcggcccggggcagcctcctccccgccgccccgccgcgggctcccgggccccgcgggggccgatcccccccggcctgcagcccagcctgcggggggcgcagcgcctagtcccgcccgcgtcgcccgccagccccgggacagcccgcctggcgcgcggggctctgcgcgctgcgaccctccccggcagtcccgcccgcctctcctcgccctctctctgcctggcctccaactttgcctctcgctatcctctccgccggcgccccctttcccggcggtccccgggatggtccccggcaccccgaggacgccgaggttacgggaagttcggggactggcgggagaaggggtttgggggtggtccgcggcgaggggcgcggggtgcatcttctcttccttttatgggctgccacacttgtgtatcccttcttccttgaatttaaccaggagtgagcagtggacagcttcttccctatgagaaggaggtgaagcaggacctgaaatcccgtgctcagctcccacatgccccgtgtccaggacaagtcctttgctgaatcagcggcagacaccacccggagccctgcgggagcctttccctgttcttccagcatggatctgaaactcccttcccactttctgcagcctcccagagatagttcaggctccagcctcatgtgatagcatgaagagaaactggttccaacagctgtgtgctctgctgccctcatcccaaacaacagtttaaatgcacaattacgcttttctctaaggcccaaaataggataggaaagatcgttttgctatccctgaatgcctgtcacccttgtttcgtaaggtaagattgggaagggcttggccattgcccttgcggctgagaaaccaactttaggaataaagacactctctccatgtctgacaaatgtctgcccatctgctggcaggaagtcagtcccagaatagttgttctgctccctcccttctaataagtgctgcgctgagtgtgcttgctttgccagatggttaaaacagagcaggggatagaaggacagatgtcttcaccctcatggagttcaccttccagtaggaggaggcgataggccggggtctgcacatgtgcgtgctacagcctgttccacgtagagacaggatttcaccatgttggctaggatggtctcgatctcctgaccttgtgatccgcccctccctcagcctcccaaagtgctgggattacaggcgtgagccactgcaccctgccagaaaactcattcttctactccatcctacagttttccctaagagagaaacaataaaacgccaccacgaccaatggcaaaaagctggcacccactccacgacttttcatatctacacgtttgtacagctttatttttaagcattctgaaattctatgcaggagagaccccagctaggtttagggagtcctagggtttgtggagtaaatgaagtttctccctagaattagggagggtagagacaggcagagaactgacaatcctaacagctgctgtcctcagagccactgtttctgagagctgctcgctgagtgcttctagcgagttaaatggtgttcgcccaaaagacctgttcacgtcctgatcctgggaacctgtggctgtgatcttatttggaaaaagctctacattacgtctttgcagaagtaatcatgttaaggatcttgagaggacgtgaccctgaattatcc

SEQ ID NO: 460305 - DNA, 1181 bp, Homo sapiens
gtaagagcagggaagccaggaggtgtgctccgcttttgtgctactggcatatgaagaaactggggctctgaatggcatattaacgcgtgcagctccagacagcgaggaagtgatggcaactctatccgaactcaaatctgccagacctataccagtaggtgcctgtgtgcagttggggactcacctctgccagtgctggcatgagctagctgtcttgaactgaaaacagacactcaaagatgggctgtgggatcccagagaggtggcagaatggtcaaagctatgaagccaacagctgctgccaagaagaaagtcctgagccctgagtgattgtaatttaaaaaacttaatgctgggagtgggtgtttattttggaggagtgggctgcttatttttggtttggggacttgttcattcatcttttctcagcggcgcctactgctgccctggcccgaagttaaagctcaataaatcactgttgcacaactgagtgcccacgcctagattgtaagttcctggaaggcaaggatttgtgtcccacacttgttttgtaccctccaggatcttgcacagcacttggcgaatgggtattgaatgaattcattcactgaagcgtctctctggtgccaggcccagtgctaagtgatgggaatacacagatgaatacgatatggtccctgctcttgggtaactcattattctggagtggaggttcccagagggatgactgggtgcctggagctcttcgcatcctttccgccaagctctcttgggaccaaggactgccaggggccataggaggcaggccaggagaccagggacttttccctggtgtgaagctaactgtccctcagccagcacagtggggagtcactgtgattcctactgtggagagccagccagactggattcatggctcagaggctctgaacctccactgtggaaccacatggggagccacagggaccagtcccacggaaaagccaggacatgctccaaaagatggcccaaggaggctaagcctaccacatatcagaacagacaccaaaataaacaaaatatcagaaaagatgaccaaaattcttaactaaatggacagtttggatactgctccatggtagaaaaggctgtactgtgtagctagtgttctgtagattctggaaaggaaatctcttgtttac

SEQ ID NO: 460306 - DNA, 796 bp, Homo sapiens
  misc_feature (7)..(8): n is a, c, g, or t
  misc_feature (11)..(12): n is a, c, g, or t
tggcttnnacnnggtgatggtagaagaaagagcacacaaatcagattcaagttacatgttggaggtaaaattgacaggaccctgtgacagatgggatgtagtggatgaggaaggagaaggtgtcaggatggtgtcctgtggagctgactggctgggagagcctttcactgaggccaccatcaatgccactgtcaaagaagacatcctgctctcagttgagtactcctgtcatggagtgcccaccatcgaatggacatattcatccaattggggaacgcagaagatcgtggagtggaaaccagggactcaggccaacatctctcaaagccacaaggacagagtctgcacctttgacaacggctccatccagctcttcagcgtgggagtgagggattccggctactatgtcatcaccgtgacggagcgcctggggagcagccagtttggcaccatcgtgctgcacgtctctgagatcctctatgaagacctgcactttgtcgctgtcatccttgcttttctcgctgctgtggccgcagtattaatcagcctcatgtgggtttgtaataagtgtgcatataaatttcagaggaagagaagacacaaactcaaaggtaaccccctgggccttgtgataatccatgagtggttttgaggccagaggtggcatgtgttatcttgttctcacgaagaaagcactatgtggcttgatttccaactcattgacttgtctttgctttacagaaagcacaactgaggagattgagctggaagatgttgagtgttagccaaggctggg

SEQ ID NO: 460307 - DNA, 1825 bp, Homo sapiens
tggctgctctgctgttactgtttgggaggcctcggaaactcccttggaccctgcacttgatggatcagctggcaccgcccagatcgctacgagtggctcccacccagcaactgactcagtgcaagaggacagctttgactccctatgatttcatctccgacccaactaatcagtattcccacccccggcaccccactagccaaactatccttaaaaactctgatccccgaattttcagggagactgatttgatttttcaatggattttcagagaattgatgagtgaagtccatctcagagcggcacctgctgatgcatctcctgattcaccaggaaatcttattgctctacgctatgaaatggtggatgagtttgtgtatgctaatgtgggaggaaaaacactgattggccatactccaagatacatcaaaacactccagcagatgtatgggaatgcatccgccctcggactgggtgagatagcagccccagctccaggtggaaaggacagcttactcatcaagggagttacagtgtctgcagcctgtactgagtcagagtatctgagagagatgcctactcccactttgccttctgccatgagtaaaaaagctccctgaggatttccagaagcagaagctgctatgtttcctggagcgaacctgaacttccccagaagcagaagccctaagcttcctgtagtgaagtctgtgaaactatgagccaattaaacctcttttctttataaattacccagtctcaggcatttctttatagcagtgcaagaacagactaatacacagcttgaatatttctgccctctttgctcaagaaataagagaaattaccagaaaacctttgcaaattcagacatcatggtacataaatctaactgctcctacttctggtttaaatgtgtttcagggactgatcattgatatttctgcattgtgtatcaatactcagcttcccaaaggtaactttagtgattaaatagtaaagctagctttgcatatacacttttcattgaatattttagactgagcacatataggaggatagcaatattgcctgaaaatatggagtaatccttggtaatgtgcaccacaattcaaattcaagaatattggggcaggagggggcatttaactgggattcaccttggaatagaaagctcatagcaaaaaggctctttagtaagataattcatacctttaaactgcaaattgtatgtgaaggtggaatttatggtcctagcaagcatcaaggaaagcttatgaaactgaactgcagttgttcatggccagctaaccctgcgggaaatggaaatgcactttggtattcttaaaactaagtgtcaaagcccctcaaatttcaactggctttcaaagaatttttaaagctttagaggttttcagttaagcacgttcttttactattgtagaggtatggaatgaactcctagaaacatgtgtatgtttaatttatattttgctttgaaaatgtaaaaatatatttataaatatacataaaaggatatatttatttattatacccatatctatcatccttgcatcttccaaaatggcctagagtatattttgggtaaggataaggaaaaaagacaaaaaaaggaaatgaaacaagaatggagaaggtagactggaggaggaaggaatgttatgcattcaactttatatgcttagcaaaaagtttgtataaactatttttgtctttaataagtttcttttatgtttctctatgagacgttactattaaaaatgatatgatgatgagctctgactattctcatttcagtacaaat

SEQ ID NO: 460308 - DNA, 804 bp, Homo sapiens
gtggagaagagaagagcagcacacgcagtttcaaatagtgaatgactttcatctggaaatgaggccacaagatggagacggagcgggttgctcacccaagttcatgcagcgcccatctgacgttcccccgggaggagctgcagggccttctttcgaggaggtggcagaggggcttcctgcgtgcaaaggagggtcccaccagcccttttggaacctcagcctggtcctccagaatttcacctcaaactactggagtctaggaaaaccattaaaggaagaaattgaagcttagagaagttctgtaagatgctgaggtcacacagtaataaagagataaatgtgtgttctcattactgcgctttcttgtctctcaaagcaaggaaccagctcaccttgtctctcccagctcctcacctcccgaggcagcagggacaggagccctgggcctgttctcccattccagacacatctcttctcttccagacaggggctgtggctctgccatggggttcctgttctggcagagccaggacacaggatggggagacaggggccggccaccctgaggtggagagtgctgccggatccccacactttatttccataggaacctctaagggagatcggaggagattcccagtctggggagtgggggaatcaaatgagtggcccgtatgcactggtcaccaggggcagtcaaacctgactctcagggaccacctgccattctgctccatagctgagttaggagggaaagggaactcgagaccctgaggaaggcatggaagggcttggccgtggatc

SEQ ID NO: 460309 - DNA, 1405 bp, Homo sapiens
acttatatgatatacctacagtaatcaaatgtacaggaactggaagaagaatggtgattgccaggggctggtaaaaggaagaaacaaggagttattgttaatagttgtagagtttccattttatcaaatgaaaaaattctggagattggttatacaacaatgttggaaaggtactttgttgggtgttgctatggctacagtgaatgctatgatagcagaatatggctgcagtttggaagacattgttgttgtacttggaccttcagtaggaccttgctgttttactcttccaagggaatcagcagaggcatttcataatcttcatcctgcatgtgtacaactatttgattcaccaaatccctgtatcgacatccgtaaagccacaaggattcttctagaacagggaggaattcttccacagaatattcaggaccagaaccaagatctcaacctctgtacatcttgccatcctgacaagtttttctcccatgtccgagatggccttaattttggtacacagattggcttcatatcaattaaagaatgagatacttgactggatttttgtataactgcttcctgcctccttccaaactgactgcaagagagaaatttagctgtttgatttacttaaaaccaaatggattacaatggataattcatcttttgggtatatttttactattattcaaagccaaatgattttcatttaattgtaataataactgacaaaaatcagtatgttgtagctaatatgttttatgcatgagaattattcttaaagtttgttctccctgtttattacacagatcaggaatagatttgttcagttcagtatttattggataccctctattggtcaggcattgtgttaagcatatgtgaatcaaaatgaacacaactttttcctttgagtctgatacagtgaaggagataaacacttctacaacttaaatttaattttaatagcagtagaagagaacataaggaatagaggttaattttacccagaagcaggatagagaaaatattacagagaaaatcacatatcacatgggctcgaaagatgtagaggtttttgacaaatgaagaacaaccataacaggtagagggaacaccatgaaccagggcatgaaactgaaagtgcataacatattctagagagagaagggtgtgggcatgagttagggctggaaaaacaggttggaaacagataagtaagggtctcaaatgcaatgtcaaagagcttgcagtttattttccaggcaatgagtaggcagccaaaaaaaaaaaagtaaggatgttttttttttttttcccatggcatcatatttaagaggatggatttaaattgtgtgagaccaaagcatagagactagctcgtgccaattcctgcagcccgggg

SEQ ID NO: 460310 - DNA, 2234 bp, Homo sapiens
acttatatgatatacctacagtaatcaaatgtacaggaactggaagaagaatggtgattgccaggggctggtaaaaggaagaaacaaggagttattgttaatagttgtagagtttccattttatcaaatgaaaaaattctggagattggttatacaacaatgttggaaaggtactttgttgggtgttgctatggctacagtgaatgctatgatagcagaatatggctgcagtttggaagacattgttgttgtacttggaccttcagtaggaccttgctgttttactcttccaagggaatcagcagaggcatttcataatcttcatcctgcatgtgtacaactatttgattcaccaaatccctgtatcgacatccgtaaagccacaaggattcttctagaacagggaggaattcttccacagaatattcaggaccagaaccaagatctcaacctctgtacatcttgccatcctgacaagtttttctcccatgtccgagatggccttaattttggtacacagattggcttcatatcaattaaagaatgagatacttgactggatttttgtataactgcttcctgcctccttccaaactgactgcaagagagaaatttagctgtttgatttacttaaaaccaaatggattacaatggataattcatcttttgggtatatttttactattattcaaagccaaatgattttcatttaattgtaataataactgacaaaaatcagtatgttgtagctaatatgttttatgcatgagaattattcttaaagtttgttctccctgtttattacacagatcaggaatagatttgttcagttcagtatttattggataccctctattggtcaggcattgtgttaagcatatgtgaatcaaaatgaacacaactttttcctttgagtctgatacagtgaaggagataaacacttctacaacttaaatttaattttaatagcagtagaagagaacataaggaatagaggttaattttacccagaagcaggatagagaaaatattacagagaaaatcacatatcacatgggctcgaaagatgtagaggtttttgacaaatgaagaacaaccataacaggtagagggaacaccatgaaccagggcatgaaactgaaagtgcataacatattctagagagagaagggtgtgggcatgagttagggctggaaaaacaggttggaaacagataagtaagggtctcaaatgcaatgtcaaagagcttgcagtttattttccaggcaatgagtaggcagccaaaaaaaaaaaagtaaggatgttttttttttttttcccatggcatcatatttaagaggatggatttaaattgtgtgagaccaaagcatagagactagataagaggcgatcaaaatatttcaaaaagaaataatgaagatccaatgaaggaagtggaaattaaaatagggaagagagtagatggattagagagacatttaagagatggaatcaatagatcctgttactagataatggaagtaagaggtgaggaagagtggaaaagtcattaatgactctaagatttctgcttggctgcttaccaagattggcaacaaagggagggagaaggtttggaaaaagagagaaggataatgagtttgactttacatagaatgaagggcatccagatagaaatctttggttaataattagaaatatagacctagaaattaggaggaaacctgagacagagacaaatatttcaaagcttacaatacagagatgatacctgattctattggagcaggtttgatcatctaggcagaaattaggatgagaaaaaaggagatccaataatacaaccttatagtcacagaagtaagaaaaaaagggtagttgttttgaagaagccaggataggtgtggaaagtactcaaaaagaaatcttcagggataaaataaagtgataatttaaaagaaatcaatggattaaacatattgaaactgttctataggcagtggtcattgagtcagctttcagtgcattaggaagaagatgcataggtgtcaactcttttctgacagcatttactagagaagagaaaaagctggggactacatcttcaaggaagggactttttttggatgagcagttttgagtgtgtttgtcagttaaagagaggaattaggttagttttcatttgggaaaaattgtatatatatttaatgacactcttctgatgactattcttc

SEQ ID NO: 460311 - DNA, 2074 bp, Homo sapiens
acttatatgatatacctacagtaatcaaatgtacaggaactggaagaagaatggtgattgccaggggctggtaaaaggaagaaacaaggagttattgttaatagttgtagagtttccattttatcaaatgaaaaaattctggagattggttatacaacaatgttggaaaggtactttgttgggtgttgctatggctacagtgaatgctatgatagcagaatatggctgcagtttggaagacattgttgttgtacttggaccttcagtaggaccttgctgttttactcttccaagggaatcagcagaggcatttcataatcttcatcctgcatgtgtacaactatttgattcaccaaatccctgtatcgacatccgtaaagccacaaggattcttctagaacagggaggaattcttccacagaatattcaggaccagaaccaagatctcaacctctgtacatcttgccatcctgacaagtttttctcccatgtccgagatggccttaattttggtacacagattggcttcatatcaattaaagaatgagatacttgactggatttttgtataactgcttcctgcctccttccaaactgactgcaagagagaaatttagctgtttgatttacttaaaaccaaatggattacaatggataattcatcttttgggtatatttttactattattcaaagccaaatgattttcatttaattgtaataataactgacaaaaatcagtatgttgtagctaatatgttttatgcatgagaattattcttaaagtttgttctccctgtttattacacagatcaggaatagatttgttcagttcagtatttattggataccctctattggtcaggcattgtgttaagcatatgtgaatcaaaatgaacacaactttttcctttgagtctgatacagtgaaggagataaacacttctacaacttaaatttaattttaatagcagtagaagagaacataaggaatagaggttaattttacccagaagcaggatagagaaaatattacagagaaaatcacatatcacatgggctcgaaagatgtagaggtttttgacaaatgaagaacaaccataacaggtagagggaacaccatgaaccagggcatgaaactgaaagtgcataacatattctagagagagaagggtgtgggcatgagttagggctggaaaaacaggttggaaacagataagtaagggtctcaaatgcaatgtcaaagagcttgcagtttattttccaggcaatgagtaggcagccaaaaaaaaaaaaagagtagatggattagagagacatttaagagatggaatcaatagatcctgttactagataatggaagtaagaggtgaggaagagtggaaaagtcattaatgactctaagatttctgcttggctgcttaccaagattggcaacaaagggagggagaaggtttggaaaaagagagaaggataatgagtttgactttacatagaatgaagggcatccagatagaaatctttggttaataattagaaatatagacctagaaattaggaggaaacctgagacagagacaaatatttcaaagcttacaatacagagatgatacctgattctattggagcaggtttgatcatctaggcagaaattaggatgagaaaaaaggagatccaataatacaaccttatagtcacagaagtaagaaaaaaagggtagttgttttgaagaagccaggataggtgtggaaagtactcaaaaagaaatcttcagggataaaataaagtgataatttaaaagaaatcaatggattaaacatattgaaactgttctataggcagtggtcattgagtcagctttcagtgcattaggaagaagatgcataggtgtcaactcttttctgacagcatttactagagaagagaaaaagctggggactacatcttcaaggaagggactttttttggatgagcagttttgagtgtgtttgtcagttaaagagaggaattaggttagttttcatttgggaaaaattgtatatatatttaatgacactcttctgatgactattcttc

SEQ ID NO: 460312 - DNA, 361 bp, Homo sapiens
gatggcaagcctattagacttctgtttcagatataaagaaaaaacgtacatacctagagctattacttttggggcaaattgtaactttaaccaaaagaaaatattgtatgattaatagttgtagatatggctattatgttcactttcataggatgtttttgtttgcctaatacataggacattttacatgtactatttattatttgtaatataggtgaaaagcttcagggcctgatttaaatgtatatactaggttaagaatattaaaggaatgtgccttgtcataaaatcagaatgcagaaatggatggtgtagtcatttagttggtcccacagctctcagacaggaatacatttcagga

SEQ ID NO: 460313 - DNA, 1063 bp, Homo sapiens
  misc_feature (2)..(2): n is a, c, g, or t
  misc_feature (6)..(6): n is a, c, g, or t
  misc_feature (9)..(9): n is a, c, g, or t
  misc_feature (12)..(12): n is a, c, g, or t
cncaanttnttngggtaggggcaaaatgccgccagtctctttgctaaaacataacaagagtcatctttattccagttcccaacaaaaaattgagtgtgttagaaacttggaggtctacagactgtcatttttatcctttgaaaaaaggccaaactctcatccagcgagtccaggcaaccctgctcagcccacttccctccactacatgaatccttaccaactgaatgcctatggtatggcactaaaagcagtgggagaaattgttcaagattatgacagtgataaaatgtttccagctctaggatttggtgcaaaactgcctccagatggaaggatatctcacgaatttgctttgatccttctgtccactgtcaagctttcagatgactgcagcccagttcctcaaaaaatatgagtgtcaacgtgtattattctcatctctttcaattgatcttcatggagatttacttttttactgttgttttgttttgttttgcctataaatttctacagaatgggaatcctcaaaacccctactgtgatggcattgagggggtcatggaggcttattacaggagtctgaaatctgtacaactatatgggcccaccaactttgctcctgtaattaatcatgtagcaagatatgcttcttctgtaaaggatggctcccagtattttgtgcttctgattgttacagatggtgttatctcagatatggcccagactaaggagtccatagttaatgcctcaaaacttccaatgtcaataattatagtaggtgttggaccagcagaatttgatgcaatggtcgaattggatggagatgatgtaagagtctcctctagaggaaaatatgctgaaagagacattgtgcagtttgtgccattcagggattatattgacagaagtggaaaccacatactgagcatggctagattggctaaagatgtcctagctgagatccctgagcagtttctctcctatatgagagcccgaggaatcaagccatcacctgcgcctcccccatacaccccacctcctgcaataaaatagtagcatcggc

SEQ ID NO: 460314 - DNA, 863 bp, Homo sapiens
aaaatatactaattctggaacagtaactttactctctttcttggtagaaacagaagtttcattccttgactacattaagggagggacgcaaatcaatttcacagtggctattgattttacagcatcaaacggcaaccctgctcagcccacttccctccactacatgaatccttaccaactgaatgcctatggtatggcactaaaagcagtgggagaaattgttcaagattatgacagtgataaaatgtttccagctctaggatttggtgcaaaactgcctccagatggaaggatatctcacgaatttgctttgaatgggaatcctcaaaacccctactgtgatggcattgagggggtcatggaggcttattacaggagtctgaaatctgtacaactatatgggcccaccaactttgctcctgtaattaatcatgtagcaagatatgcttcttctgtaaaggatggctcccagtattttgtgcttctgattgttacagatggtgttatctcagatatggcccagactaaggagtccatagttaatgcctcaaaacttccaatgtcaataattatagtaggtgttggaccagcagaatttgatgcaatggtcgaattggatggagatgatgtaagagtctcctctagaggaaaatatgctgaaagagacattgtgcagtttgtgccattcagggattatattgacagaagtggaaaccacatactgagcatggctagattggctaaagatgtcctagctgagatccctgagcagtttctctcctatatgagagcccgaggaatcaagccatcacctgcgcctcccccatacaccccacctcctgcaataaaatagtagcatcggc

SEQ ID NO: 460315 - DNA, 454 bp, Homo sapiens
tttctttgtctgtaaaatgcacacttaatcaagttttgtatgagaaatgaatgaagacatgaagggatcaacatgctttctgtcttttcatagcacattttgctacttcatacatcttgatttccttgttgtccacattgttttagtatttggctaaaatgtactgaataaatgatcatattttctcttaaagcaatggtcgaattggatggagatgatgtaagagtctcctctagaggaaaatatgctgaaagagacattgtgcagtttgtgccattcagggattatattgacagaagtggaaaccacatactgagcatggctagattggctaaagatgtcctagctgagatccctgagcagtttctctcctatatgagagcccgaggaatcaagccatcacctgcgcctcccccatacaccccacctcctgcaataaaatagtagcatcggc

SEQ ID NO: 460316 - DNA, 782 bp, Homo sapiens
gcaagacagttaaaatattagatgagctcgttacagaatcctgactgaaaacacacatttcctcttgaaggctttgctcactgattttggttttttggttttaaccattttccaactccctttcatctttccttttatctaaaatgggaagtaacacaatgtccttgtagataattttcatgctggtcttcaaaggaagtaaactggtcatagaaagacattggttaatttttttggtccctttccttcagataatttaaaatgtaagaacaatcagtcctagcagatgttaataaaaaataatatctttagtgagtttcaaaatgcaaagaaatatgattttctctctaataattagaaaggtctatttggggtcacaaacaactagaaggtaattctgtctttttctttttcaggtaactttactctctttcttggtagaaacagaagtttcattccttgactacattaagggagggtaagtaattctctcaaattgtttcgttgcttaggcatttcctaaaatttgtgtaacaagcgctaccacgaggtacctggcactgaaatgatcacctttattatattttgatggcaagcctattagacttctgtttcagatataaagaaaaaacgtacatacctagagctattacttttggggcaaattgtaactttaaccaaaagaaaatattgtatgattaatagttgtagatatggctattatgttcactttcataggatgtttttgtttgcctaatacataggacattttacatgtacta

SEQ ID NO: 460317 - DNA, 723 bp, Homo sapiens
aaaatatactaattctggaacagtaactttactctctttcttggtagaaacagaagtttcattccttgactacattaagggagggacgcaaatcaatttcacagtggctattgattttacagcatcaaacggcaaccctgctcagcccacttccctccactacatgaatccttaccaactgaatgcctatggtatggcactaaaagcagtgggagaaattgttcaagattatgacagtgataaaatgtttccagctctaggatttggtgcaaaactgcctccagatggaaggatatctcacgaatttgctttgaatgggaatcctcaaaacccctactgtgatggcattgagggggtcatggaggcttattacaggagtctgaaatctgtacaactatatgggcccaccaactttgctcctgtaattaatcatgtagcaagatatgcttcttctgtaaaggatggctcccagtattttgtgcttctgattgttacagatggtgttatctcagatatggcccagactaaggagtccatagttaatgcctcaaaacttccaatgtcaataattatagtaggtgttggaccagcagaatttgatgcaatggtcgaattggatggagatgatgtaagagtctcctctagaggaaaatatgctgaaagagacattgtgcagtttgtgccattcagttccaattcaagggggatcctcatagagcaggc

SEQ ID NO: 460318 - DNA, 2199 bp, Homo sapiens
ttccttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtaaggaccacgcgggaaaggtggagggacctgcagctgctttctgctacaaccgaggaaaactgagacatgttgcatgtagttgtcagggacagctgaagtgaatcaggaaagattgatttaaaaaatgcatttgtgaaagagggaaaaggcccattttagctagaagaagttttttgcctttccattccccaatgaagttgttttccagatatttacattttataacgagaaagcaaagttggaaagagaagtaatgtgtccaaggtcaaaaaaatggctagtaagaagagtagagtagaaccccaggaatgtctaaccccgaagtctatcctcctaatcactcttatttaatgcttctcaaaggcctcatggtttttcaaagtatgtctgagaggaagccacatgctctagaatggtgtttctcaaactttaatatgcttctgaatcacttgggcagcttgtaaaatgcagattctgactgagtagtctaggttgagagcctgagattcacttctaataagctcttaattctggtatacatcaaaattatcaaaaattaattatacaagcatgggggggacatggtggctcacgcctgtaatcacagcactttgagaggcagaggtgggaggatcactttaggccaagagtcggagaacagcctgggcaacatagtgacaccttttctctataaaaagtaagaagttagtccggtatagtggcacatacctgtagtcccagctacttgggaggccagggtgggaggatcacttgagcccaggagtttgaggttacagtgagctatgatcacaccactgcactccagcctgggtgacagagtgagatcctgtctctaaagaaaaaaaaattaattaattatacaagtaatatatgattttattcccatgctaaaaatagtcaaacaacaaagatcatgtaacaacccatgtaatcagtttggttttttttcctctggttcttactcaacgcatttacatatatgtctagtgtatacagtatacgcgtgtgcggcgtacgcagtatacgcgtgtccggcatacgcagaatatgcgtgtctggtgtacgcagtatatgcgtgtctgttgtatgcagtatatgcatgtgtacatatgtatgtacacatatatatctatatatatatcacattgtacaatttacattatacttttttcctctgctcaactctatgtcttggggatcatcctgtgttagcacatagaggtttacctcagtgtttttcatagaaaaaagatgcgtgagcaaaaaagaaaccctctattccccatctgtgcagttgccttccccagcgtcaatcgctgtgactggtgtcttctgtaaacttccagagttatcgagcatatataagcatattactgtatgctagtgtatttcacacagagttttgtaccctacagttttcacttggatcatatatcttagagcattttgtgtcatacgtttagagctgtctcctttttaattgctctgtgaaataccgctgtatggatggatatttaggtaatttctcattttttagagcctattgcaaagaatatgtgaatgtatttttaagataaatttctaaaaattgaatcgctgggctgaatggtttgtatatttaaattttaatagtactcacattgctctccacaaaggttttttatcagtttacattcccaccagcagtggtgagtacccacctccccttatcagccaaagcatttttaaagggtttgccactgtgataagttaaaaaaaaaaaagatattttctatttccttgtataacagtgatattggctatcaattt

SEQ ID NO: 460319 - DNA, 1424 bp, Homo sapiens
tcattaaaaacagaaactcccattaatagaaggcactgcactatgacctgcgagattgtaaaaaatatgtgaaacagctttggtgcttagaatattaagtctgatagaacagtggctcttaattctggtatacatcaaaattatcaaaaattaattatacaagcatgggggggacatggtggctcacgcctgtaatcacagcactttgagaggcagaggtgggaggatcactttaggccaagagtcggagaacagcctgggcaacatagtgacaccttttctctataaaaagtaagaagttagtccggtatagtggcacatacctgtagtcccagctacttgggaggccagggtgggaggatcacttgagcccaggagtttgaggttacagtgagctatgatcacaccactgcactccagcctgggtgacagagtgagatcctgtctctaaagaaaaaaaaattaattaattatacaagtaatatatgattttattcccatgctaaaaatagtcaaacaacaaagatcatgtaacaacccatgtaatcagtttggttttttttcctctggttcttactcaacgcatttacatatatgtctagtgtatacagtatacgcgtgtgcggcgtacgcagtatacgcgtgtccggcatacgcagaatatgcgtgtctggtgtacgcagtatatgcgtgtctgttgtatgcagtatatgcatgtgtacatatgtatgtacacatatatatctatatatatatcacattgtacaatttacattatacttttttcctctgctcaactctatgtcttggggatcatcctgtgttagcacatagaggtttacctcagtgtttttcatagaaaaaagatgcgtgagcaaaaaagaaaccctctattccccatctgtgcagttgccttccccagcgtcaatcgctgtgactggtgtcttctgtaaacttccagagttatcgagcatatataagcatattactgtatgctagtgtatttcacacagagttttgtaccctacagttttcacttggatcatatatcttagagcattttgtgtcatacgtttagagctgtctcctttttaattgctctgtgaaataccgctgtatggatggatatttaggtaatttctcattttttagagcctattgcaaagaatatgtgaatgtatttttaagataaatttctaaaaattgaatcgctgggctgaatggtttgtatatttaaattttaatagtactcacattgctctccacaaaggttttttatcagtttacattcccaccagcagtggtgagtacccacctccccttatcagccaaagcatttttaaagggtttgccactgtgataagttaaaaaaaaaaaagatattttctatttccttgtataacagtgatattggctatcaattt

SEQ ID NO: 460320 - DNA, 1813 bp, Homo sapiens
gtgctttccacagctcttctcaggggtcagtctggtaatgagtttgggacttcaaaacatgccatgcagccaggcaaactgctcctctatagtagtcatgaggacctccacactcctgagcccaacagacatctttcaattctcatggtacctgacaactgcattgcatttgatagggttctttccattctcctggtttattttcatttctccaaatatagttttttttccctatcacgtcctccaccaatttgacctcttcagttggaattcctcaagcctcagttttgagcccccttttcctcttactctatgctttctgtcaaaacatttgactccacactcttgttttaaattccatctctctgagaaggatccatgtgttcacatactctgttgttcaagaaagaaaacatgtcattcttcttgccattttcgtctctgtcttcactttcaatctactaccaaatcctactgacttttgcatcctagatagctctctaaatcatcaatttcattttatcattctcttatgcagtagtgttaagagcagagaactataaccaagatcttgaaatcaggaacttcgatacatacataaattatcccattgagcccctggatgttcatatgtattatctctgtttaatattcacagtttgtctccatgaggtcatacagctgcttgaggttgctcggagagtaagaagcagaatgagaactagaacagaagctcactttggcctgaaggctcatgtgctgagcatcttcccttgtctgtctccacccctagcctggtgcccagcatgtagaagaccttcatcctagatgcaatgggattaaacttggagaaaatgggattaaacttggacaaacactacctatttggacttgtgatgatggctttcaaacttcttaaagcaatgaagtattttttccagaagaaaccttacacaagaagcccagcacactgagtcaagcatatgtaggtggaagatatctggttgagaccaagtagagataaacctgtagattcaactgtgccaccacagtgaattctaagaatccactgactgtgatctgtaagctcctactccacaggaggtcagggcacacagcttgaaaccggaaggcagaagagtgacagggaagggtcatggactctgaaattagagctatctgtgttttaatactagttccaataggcacatggtcttggataaatggtttaaattatctgagtctcaatttctttctctgcaaaaagggatgattagtacatatgtaatagggtttttatagaaaattgtataacttgttaaacacacatgtactaagtgcttggtgcccagtatgcactgaataaatgctagctccttgcctttcatctctatgacccttcccaaatctctcagccccatattgcttcatgtagtgtgtgtatatttgggaaaatttgtgtgcatatttacagatgggatcctactcttctattgacagactgtcttttcagatgtgccttactttcattgcattggtttttcaactgaaagtgaacataaaggttttaagcatgcctaggtcttatctttttggtcaaatatctaacaccctcaataacagttgtaaatcattcttttgtaatttgatcattcatttttataaagtaaaacacaactgcccactgtaaaaatagacttcatttgctcttttcttccagtgcagcaaatgacagacactttaagaacacacatttaacttcagcaaacaaatcatgtatattttagacataactgtcaagtatagaaatgat

SEQ ID NO: 460321 - DNA, 5959 bp, Homo sapiens
gaacatcttgtgcagaagaagaggcaatttggcacctgttactgccaagatgttctcgatctcctgacctcgtgatcctcccgcctcggcctctcaaagtgctgggattacagacttgatgcaaggggatgtgtgctttacgggaaactgtcagcgctgcagtcggcatcagagacgtgctgctaaagagaacactaccagcatttaggagaagggacttggaatgatggacaggaccgtaccccttctctcattatcacaagccaaagcaaatgatgtatatctgtgaggtctaacaacgtccctaagccttatccttttaggatcccagtcatccagcgcactgtattgttgcagctaggagtttaagacatagagtcagacagacatgtgtttgaatttcagctccaccgctgactagctaagcaagcttgagcaagttaccatttcttctaagttccttcagttttttttttttgagatggagtttcactctgtcacccaggctggagtgcaatggtgtgatctcggcgcactgcaacctccaccccctgggttcaagcgattcttctgcctcagcctcccaagtagctgggattataggcatctgccaccacaccctgctatttttttgtatttttagtagagataggatttcaccgtgttagccaggatggtctcgatctcctgacctcgtgacccgccctcctcggcctcccaaaatgctgggattacaggcatgagccacctcaccttgtcctcattccttcattttcaaaatggggctatgttatttgccacagagagtttctgtgatgattgttaaaatgcacataaaatacctaccacataattcattctcaaaaaattctagaaatattacaatgggtgatgcctctccctccaacccagcacattccctggacagccctcctggtgcctttcaacccaggcagaccgtgcttttcctccttgagtgccaatcagatggagtggaagccagtggattgtttacctatagcacatgtgcagtgggaagtcagaaggccaagaggagaaactttggctccattcaaaagccagctgtgcaaggctccctggtggatgagggaccgaggagccagaataaatatttaactttcattttgaaacactgtccttgtgtggctgtcaccattgtgttggacaagatgtggagctaaatatttacactttctaattgttccccaaactgctggatgcccccaatctactgtaagctgtctgtctgtctgtctgtctgtctgtttattcattcactcatttgttcacttactttcctaattttaaaatgtatatgttagtttgggaaggaggttgagggggaggagaggaggtgcagaggttgactcaagattctcttccatttcagagaaaggaaataaaaccacgagatggaaagtagaggctgagaaaatgctgactggcttctggatctgttacacacatttggttttttttttttttttttactttttattttggaataattttagatttaccaaaatgttacaaagatagtaaagaaagttcccgtatatctttcacccagcttcccctcatgtcagcatcttacgtaacgatggtacctttgtcaaaacgtagaaattaacattggtacaatacgattaactaagctccacagttactgagtgtcaccagtgttctcactactgtcccttttctgttccaggatccaatcctggataccacgtttcatttagtcatcatgtctctttggtctcatgggatctgttagcttctcagttttttataaccttaatagttttaaaaggtagtgactggttattttgtagaatgtctgtcaatttgggtttttctgatgtttttctcaggattagactaggtgttatgagttttaggagagaataccacagaggtgaagtcctcttaataatcctatcgggatgcatgctatcagcatgacttaagcactggatgatttcatatcaagatccttaactaattacattggtaaagatgctatttctaagtaaggtcccactgcaaggttccagtgaacatgaattttgaggacacaattcaactctttatggatgtggggttatgccatacattttgcaatacagttagattcatttgtcaaagtgtgcactccattctgggtccccctaaacatcttggttgatttttttgcaatttgcatacagtgaagttcagttctaggggttttgaaaagtgcacagagtcgggtaactataccacccaattccatgcagcaccattccatcaccgccaaatttcgctgagcacactatattaaaattgaaggttttctccgaaaaccatacttttgttaatagaaatattaaattttaaatgtacttaaatatattttattaaatttattttattatggaaacatgtaaatggacataaaaggaaagagaacagtatactcatcacctagtttcaacagttatttttaaaatagtttcatctatttgtctacctatttatgtattttactagagatttttaaaacaaatttcagacatcacacaatttttccaccaaatacttctgtatgtatcttggcaaataaaaaaaattagatcacttgtcttataagatttctctaactttgtatttgtcagattatttattttcttgtgcacttaaagtctttttccttttatttactgtaaatttgtagagctaagatccaaattagtttcaagtctatagtgcatcatatcaggggacatataatacctggttgtcccattctttgtgatatgaagtttattcaacagtcattccctccattttcatccccaggcaatcacacgtctgctttctttcactattgattagtttgcttgttctagactttcttataagtagacttacacggtaaatactctttgtttctgacttctttcacatggcataatgtttttgagattccttcatgttacttgtattaatagtttttattactgagtagtattccattttatgaatatacaccaacttgtttatatgttcatctgttaatagatatttagggtggtgttagtttttggctattaaaaataaaactgctatgagcatttgtatactagcctttatgggaacaaatgctttcatttctcttgggtaaatacttaggaatagaattttgaattgtgtggtagatggatatttgtgagtaatcactaaactttttcaaagtggttgcacccttgtcttcctaccagcaatatatgagagttccacttgttctatacctttgcaacacttggtcttgttggtcttttaaagtttattaatcagttgctctagagggtgtgaaatggtatctcattgtgattttagtttgttcttcctgataattaataaacctttcagcatcctttcatggacttataggccgttcatacatcttcttttgtaagtgcctgttcaaatcttttgctcatttttaatacactttattttctggaggaattttaggttcatggcaaaattgagaggaagaaacagagatatcccataaacccattgcccacacacacacatagcctcttccattatcaatattctccaccaaagtgataaatttcttacaactgataaacctacattggcacatcattatcccccaaagaccatagtttatagtagggttcaatcttggtggtgtacattttatgggtttggacaaatatgtgacttatatctaccatatagttttatacagagtagtttcctaagatcttctaaaaattctctgtggcctgccttttcattcttttctcctctactacccctggcgaccactggtcttttgctacctccatagttctgccttttccagaatatcatatagttggaattaattgtacagtatgtagccttttcagattagcttctttcgtttagtaatatgcacttaaggctcctccatgtcttctcacagtttgacagttcatttctttttagcactgaataacatttcattgtctggatgtactacggtttatttatccattcactgacagaaagacatcttggttgcttccaagtcttggcagttttgaataaagctgctataaacatctgtatgcaggtttttgtgtggacgcaaattttcagtttctttgggtaaatactgaagagttttgacgttgctaatcagttgccaatcatactgcaagagtatgtttcgttttacaataaactgccaaactatcttacaaagtgactgtatcattttgcattcccaccagcggtgaatgagaatttccattgctctacatcataaccagaatttgtttttttcagtgttctggattttggtcattctaatatgtgtgtaatggtatctcattttttgttttaattgcatttccctgacgatatatgatactggacatcttttcatatgcttatttgccatctgtatgtatttttttcacagatgtctgttaaggtcttttccccttaatactttaatcatatttttctcttcttattgtttagttttaaaacttttgtatttaaaaaaacaattttattgtgtttatttgaagtatacagcgtggtgttatgagtctttgtatgttttggataacaatcttttatcagatatgtcttttgcaaatattttctcccagtctgtggcttgccttttcattctcttgacagtgtcttttgcagagcagaaatttttaattttaatgaggtccagcttatgagttctttctttcaaggctcatgccgtcaacgtcctatctaaacagtcattgccgagctggtcatctaagttttctcctatgttgtcttccataagttttatagttctgccttgtgcatttaagtctgtgatacattttgagttaatttttgtgaagagtgtaagttctgtgtccagattcatatttttaaatgttcaatgtagtgattccacatcatttgttgaaaagactcatttctttactgtattgcctttttccctttgtcaaagatcagttgactctattgatgtgcctattttgggactctattctgttccatggatctacttgtctattcctttgacaatattacactgtgttgattactgtagctttatatgaaggaagtcttgaagttggcttagtgtcaatcctctgactctcttcttcccctttaacattgttaactattttgtatcttttgcctcaccatataaattttagaatcagttttctgccatccacaaaatagcttgctcagattttgactgggatgcatcaaatcaatagatcaaattgggaagaacttgacagtattgaatcctcctatccacaaacatggaatatctttctattttccatttatttaattctttgatttgtttcattagagttttccagttgtcttcatatagatcttgtatacatattattagatttctacctacttaatttttagatgctaatgtaaatggtattgtttctaattttaaattccacttgttcattactaatatataggaaagtggctgacttttttatattacccttgtgttctacaaccttgctataatacttattagtcccaggagttttcgtcaattattttagatttctacatagacaattatgtcagatgcaaacaaagacatttttatttcttccttcacaatcagtaaatcttttatttcctttccttctcttattgcattaactaggacttttggtataatgttgaaaaagacgatgagaggggacatccttgccttctttttgatctgagtaggaatgcttctagtttctcaccattaagtataatgtttgttgtaggggtttgatagacattctttatcaagttgggcacattcccttctatgccttgtttgccaagagttttattctttttaatcatgaac

SEQ ID NO: 460322 - DNA, 1879 bp, Homo sapiens
tcaaggttcttgcaagtgttattgaaaggataaagaatgttttatctgtagcattttgtgctgatagaaaaggcagggtccagtggaagaaggaggaaatggtacataatttcttcataaaaagagtaaggccagggagaagtgactgagtagacacctgtagctaaacagaggtggtgatgagtttatggtgcctccagcttctcatggccccacttgggaaattcctccagtaacattacactcactcactccttgaccatctacctttactcctctcctcatttccctgttaccaaaactatgtgccctacccagggacttctgggcagctcttttctcagatcatttctcaccctctctcctctactaacttagcctttcatactgaatcacattttccttaaaaaacagctgctgacagaagatgctacattttgtttcagggcctggtaaccatcaaggatgtgtcactgtgcttctctcaggaggagtggcggagcctggacccctctcagacagacttttatggagaatatgtcatgcaggaaaactgtgggatagtagtctctctgagatttccaattcccaaactggacatgctttctcaactagaaggaggagaagaacaatgggtccctgacccccaggacttagaggagagggacattctgagggtcacatatacaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgtgggaaacagtttgtatgggggtcccaccttgccaggcatcaacaaacacacactggggagagaccctacagctgcctcaagtgtgagaagacctttgggcgaagacatcacctcatcaggcaccagaaaacccacctacatgacaagaccagcaggtgctctgagtgtggtaagaatttccgatgcaactcccatctggccagccaccagagagtgcatgcagaaggcaaatcctgcaaaggccaagaggttggagagagccctggcacaaggaaacggccgcgtgccccaccagtgccaaagtgtcacgtgtgcactgaatgtgggaagagctttggccgaaggcaccaccttgtgagacactggctgacccacactggggagaagcccttccagtgccctcgctgtgagaagagctttggccgaaaacatcacctggacaggcacctgctcacccaccagggacaaagtccccggaacagctgggacagaggaacatctgtcttttgaaatctgtttccactacagctatggtcaagtctatcagccggtgctaccaggagtcactgccagggctgccgttctcctgaaccccagtggccagaatcataagccctgaccccatccctagaaagatgaggtcccagcaatggccagagcatttctcaccagttctgtgagatagcacataaaaatagagttctttgggcaaaacttttgggaagcaatgcatcctacatgggctgatattcagcctgagctgttctcaagaggagagtggtactggcagtttatggctgaaatccattctgattggttggagtctgtgctataccagttgttaaacattttgagtatcactcttgcatactgttactattatattttctctatatatagacagaaaggccattttagaatattaaaggctctgaaaatttatg

SEQ ID NO: 460323 - DNA, 2259 bp, Homo sapiens
  misc_feature (2)..(2): n is a, c, g, or t
  misc_feature (4)..(5): n is a, c, g, or t
ancnnccaggactgggaagggaggcaggaggcttctctgggtataaagcagctgaaatgtggagtttcctcccaggagctgagagcgtgtccatgggcccagtgcctggcgtgtcctccctgggagcttgctggacgcatgaccaggattctgggagggcagaggacagaccacaggcacccaggataactcagtacacatgggttctcagcttcctgttcacagagaaacctcagacaagaagcacgtcgcccatttctcatcaaggccaaccccagaccacgagagcgctttctctgcgtcagccccagcaccccagcgcccctgcctccgggcgcccgcggcctccgcactccagtggcccagacctggctgaggcagctcccgtggtagatcaagcctcacaggcggctggaagagccagttctgggctgggcctgtgggaacaggcgtctgttagtcagggtttcaggaatgcggccttcgaagcctgaagcggggaatggcggctctgggccctcaaggggcaggcggtgagcctgggaggccaggccgggctgacccaaggggagaggaccctctccgcccactgccgctggccctgggcaggtctagagcctgggggtctccagaggcacaatcccttatctccgggagaaggcagagggcagaggcaggaaacaaatctcctgtcaaaattcctaattaaaatactaagtaagtgatggctccaggctgaaacaccggacactgagagaataagggaaaatcagccccgacagccagggctaacaagacggttaattacagcccgagaagaacgttaacagtattaattctaaccacaaaggaggaaaagagaagaccgcctaagaaggagaaggagggtccctttcccagatgaggctgccctaaccactgggacctcggcccctcccaggcctgagggagcccagctctgcctggccccacccatctcacaccagccctgcctgacccgcccacctcaccccaaccctggctggcccccacccttgcctagccctcccggccctcccacccttgcccagcccctgcttggccctcccactcgtcccaacccttcgtgtcaccgccaacccttgccccagtccggcccgccgcctcccacccttgccccagccctgcctggcccctcccacccttgccccagtccggcccggcccctcccacccttgccccagtcctgcccggcccctcccacccttgccccagtccggcctggcccctcccacccttgccccagtccggcctggcccctcccacccttgccccagtccggcctggcccctcccacccttgcccagcccctgcttggcccctcccactcgtcccaacccttcgtgtcaccgccaacccttgccccagtcctgcccggcccctcccacccttgccccagtcctgcccggcccctcccacccttgccccagtccggcctggcccctcccacccttgccccagtccggcctggcccctcccacccttgccccagcccctgcctggtcctgcccacctcaccccagcacttcctatgggactcacgcctttgtctcgggcttttggttttcaaaataaattataagttttaataaaataaagtactagaaaagctattcattacggaagatgtaaaaatccgaaaagaaacttccatttgggaggagaaatggagaacggagcccaggagaattcctggggatgtccgctttggttctacagttcgcagataggggaactgaatcctggaaacaggcagggcgaggggtgggcccgccaagcactgcgccccactctatgccaggtctatgtcagcccctctcttgccctctcagagctcagggtacattttgagcccacctggcctggagcacgcagggctgggagctggctgggacctggacagggctcagatgcaaaggcagcttcccccagcaccttccaggctctggctgttccaaaccatgctccaggctcagatgggcttgtcccaaaacagctgagccattaccttcacttgacaagggccccccaaaacacagcattccaggggaatggggacccgaccctgcagtctctgggtggtcagcgctgccctagaggggcgtgacaccctctgctggtcccatacagaaggacacagctgccacccagcatgcagctcccccaggcactgggtgcccacgctgtacccggcagcttacactgtgccttgtcacccac

SEQ ID NO: 460324 - DNA, 1325 bp, Homo sapiens
aagtgatagaaattgttcagtgtaggatgtgccacctccagttcccaggagaaaagtgctccagaggaagaggaatatgcacagcaacaacagaagaggcctgcatggttggaaggatgttcaaaagggatggtaatccctggttaaccttcatgggctgcctaaagaactgtgctgatgtgaaaggcataaggtggagtgtctatttggtgaacttcaggtgctgcaggagccatgacctgtgcaatgaagacctttagaagttaatggttcttctgtgactccaatttctgggtgaggttgttgcctcagcctcttcacaatgactttctaaaaaaaatcacacacacacacacacacactacagaagaggattgcaaacacatggctccatcttctgcacacgaaaggaaagtccctctccttttctacagtctctgtcacgccccttaaaataagtaaataaataaccttgagagaaagaacaagatcaatatatcctgcagatggccgaataagaacagctccggtctgcagctcccagcgagaccaacgcagaaggtgggtgatttctgcttttccaactgaggtacccagttcatctcactgggaatgtttagacagtgggcgcagcccacggaaggcaagcagaagcagggtggggcatcacctcacccaggaagcacaaggggctggggaactagctaagggaagccatgagggactgtgtcttgagggactgtgctatctggcccagatactacactttttccatggtttttgcaacccacagaccaggagattccctcggatgcctacaccaccagggctctgggtttcaagcacaaaactgggcagctgtttgggcagacgccaatggcacctggaaccccagtgagacagaaccattcacccccctggaaagggggctgaagccagggagccaagtggtcttgctcagcaggtcccacccccacagagcccagcaagctaagtatccactggctcggaattctcactgccagcgcagaaatctgaagtcgacctggtacactcaaggacaaagcttccagaggaaggagcaggcagcaatctttgctgttctgcagcctctgctggtgatacccaggcaaacagggtctggagtggacctccagcaaactccagcagacctggagaagaggggcctgactgttagaaggaaaactaacaaacagaaagcaataacatcaacaaaaaggatgcccacgcaaaaaccccatccaaaggtcatcagcatcaaagatcaaaggtagatgaattcacaaagatgaggaaaagccagc

SEQ ID NO: 460325 - DNA, 2080 bp, Homo sapiens
tgggagattcaggaggcaccaatgggacaagggatcttgggttataaaccaagcgtctcaacaccactgctccttcagaagggactgaaagagacaatgaattggcggggctcagctgcaccggaatctcatgttttggaatcctcaggccgtcacagggcagggtctcggcaggtgccccctggagtttccagacatcttgtggcagcatgtccagaagccccaatcagcacaggagcacctcaaggagtcagggctggggccacagttagaagccagaaagtgcaccacccccagctgcaaagcagctgccaccccagagtggagacctcctcatccacccttctgcactgtgagctgggctgcaaggactgtatggtccgggttaaaagtccaagcacacaagaggcaacacttttgaaacgagggcttccctgaagatgccggctctctctggacaggaccagcatcgtgggcatgcagccctgcagctcacacaggcacctgagcttagacgaacccatgcttggtttaacgccccactgtcatcatgaaattcttcgtaactttcgaacaaaaggccccatatttccgctgtgcactgagtctcaaacactctgtagccagtgcggtttcaggatcacattgcggatcaattgatcctacactcatttctgcctggtttttattgttttgttttgttttgtttttctcatcagctaaactgtaaacccgagggagccagggagctgcatgttgcttactagccccggtgttttgcctccagcagagcggggcctgcaaaggtgcctgataaacacactctcagatcacttccacgtggctctgttcattcattcactcaactaatatttacagaaggggggggaatctggacggagctatattatcaccagactattaaaatcttcgattagaaggttgacgcaggtgcagcgacgccgtggacccgaggcggccaccacgatcctgcccaatttgcagcctccgccctgcgggtgacacgtgaactggccagtcctgaggatgaaaagggaggaccattcccactcacatacaggctccatttccccgcagctgcccttgggggagccccgtgtgaggccaggaatattaacgcccgcctttccccatctccccgacaggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggagggatgggaccgtgtctggggggcgacgtggcgggtcggccggttccctgcattcgttttactttggtgtcccagaaacacgcgagtgtgcaatgtttggacgagcaacaacacaaattcagaacgtgcctctttccagatcgctggccccagaaccctgtcccccacacccaggggcacatgcactgttgagttagcgccgactcttcctgtggagtctgagggaggggctccattcaggcaaaggggttttagctgcagccttggaaggaggcaccgacacgacaccaggcaggagtgagcctcaggccccgtccctgcaccccacccctgcgtgcgcctcttggtgatgctggggtctcactagcttgagggggcacatgaagataagccacaaatgaagagaaaagccatgcccaccccagccccagagaaaccaataagaatcctctattattttcactattcatttaggtttttatactccacctcctttcaaaaaagatttaagatgtac

SEQ ID NO: 460326 - DNA, 982 bp, Homo sapiens
agctgatctgcgaggaggcatgaatgagagggagacacccggccagctgggcttggggaacgcgtcaggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggagggatgggaccgtgtctggggggcgacgtggcgggtcggccggttccctgcattcgttttactttggtgtcccagaaacacgcgagtgtgcaatgtttggacgagcaacaacacaaattcagaacgtgcctctttccagatcgctggccccagaaccctgtcccccacacccaggggcacatgcactgttgagttagcgccgactcttcctgtggagtctgagggaggggctccattcaggcaaaggggttttagctgcagccttggaaggaggcaccgacacgacaccaggcaggagtgagcctcaggccccgtccctgcaccccacccctgcgtgcgcctcttggtgatgctggggtctcactagcttgagggggcacatgaagataagccacaaatgaagagaaaagccatgcccaccccagccccagagaaaccaataagaatcctctattattttcactattcatttaggtttttatactccacctcctttcaaaaaagatttaagatgtac

SEQ ID NO: 460327 - DNA, 1224 bp, Homo sapiens
agcggagaaaagagagcagcatttgttagcacacatgggcctgtggagcccagtcccaggcaacagtgtccccagagccccagtgatggctgggttgggtctggggcactcccagggagctccccaaggtggaacgtcctggggctgcagggcgcgctcctgtcccacttcgtggagcccgtgtacctgcagagcatcgtggtgggcagcctgcaccacacgggccacctcgcacgcgtcatgagccaccgcatggagggtgtcggccagctgcccgcctcctaccggcacaaccggcctctcctcagcggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggagggatgggaccgtgtctggggggcgacgtggcgggtcggccggttccctgcattcgttttactttggtgtcccagaaacacgcgagtgtgcaatgtttggacgagcaacaacacaaattcagaacgtgcctctttccagatcgctggccccagaaccctgtcccccacacccaggggcacatgcactgttgagttagcgccgactcttcctgtggagtctgagggaggggctccattcaggcaaaggggttttagctgcagccttggaaggaggcaccgacacgacaccaggcaggagtgagcctcaggccccgtccctgcaccccacccctgcgtgcgcctcttggtgatgctggggtctcactagcttgagggggcacatgaagataagccacaaatgaagagaaaagccatgcccaccccagccccagagaaaccaataagaatcctctattattttcactattcatttaggtttttatactccacctcctttcaaaaaagatttaagatgtac

SEQ ID NO: 460328 - DNA, 1362 bp, Homo sapiens
tggctttgaccaaaatgctgatagcaatatggacaataaagtccaggctgaggtggtctcagatggaaaggaggaacttgttgggaactcgagcaaaggtgactattgttatgttttagcaaagagactggtgacattttgcccctgccctggagatctgtggaactttgaacttgagggagataattcaggggagaaatccaagccagctgcagaaatttgcataagtaacgaggagctgaatattaatcaccaagacaatgggaacaatatcttcagcgcatgtcagagacttttgcagcaggccctctcatcacaggcctggaagatgtatggaaatgcctggatgcccaggcagaagtttgctgcaggggcagggccctcatggagaaactccgctaaggcaatgtggaagagaaatgtgggattggagtccctacacagagtccctactgaggcactacctagtggagctgtgagaagagggccaccattctctagaccccagaatggtagatctaccaaaggtctgcactgtgtgactggaaaagccacagacactcagcatcagcccctaaaagcaactggggaggtctggggggctataccctgcaaagtcacaagggccgagttgcccaatgtcatggaagcccacctcgtgcatcagcatgacctggatgtgagacatggattcaaaggagatcgttttggagtgttaaaatttgactgccttactggattttggacttgcatggggccttggatgactagcaaaacaagagcaaaccaaaatgaaacaaaataaaaattatcaagtcatatcaagcacacatgtggcagatacattttgtgatagatgaccatttttatataaaaacatacagctccatctagctctaagtgcttttgtctctgctctcaattgtcagacattttgcaagataaacagcagcatgcaatgggctggagaaagaaacagcagaaagcacagtcgaaagagcccagggaaccatccatcacaaagccatcctgccttaaagtgaaaagtgcaattccctaagactctggtaacacccatgactgaacatcctgctaattttagcaaaataataaatatgaataagtcttgtttatgaaactgtctgcagccagatgagactccatcaggtcatttactttcttctttacactgactattctagttagccattcgtctaacctttttttttttaatgtttttagcttccttgcaaggggttagaacatgctccttcagctcagagaagtttgttataacccaccttctgaagcctacttctgtcaacttgtcaaactcattctccatccagttttgttcccttg

SEQ ID NO: 460329 - DNA, 927 bp, Homo sapiens
gggtggtgcaagatgtgctttgttaaacaggtgcttgaaggcagcatgctcgttaagaacccaatagaaatgaagaaaacaaaaaggaaattcaatggatccccaagccctcctcactcaccccctgggctgctggccaggagagagcaagtgctgcagcccccacagctcccagttgactgcaggaatgcagggggcagcatcatgatagcctcaaatacctacaggccctggttcatagccttgggttcacctgcccaggcaggggagagaaaattccatcatattagtgagcagggagatcaggtctatacgctggagaaatttgactcgatgggacaacagacctgcttagcccatcctgctcagttctccccagatgacaaatattcccgacaccgaatcaccatcaagaaacgtttaaaggtgctcatgacccagcaaccgcgccctgtcctctgaaggtcccttaaactgatgtctcttctgccacctgttaccccctagagactccaaagaggatgcagatctcatttttatttggaggatgcagatcacatttttctgtctgttcacatcacaggtatggactaacaacactctatgtggcctaaaaaccaaccaaatcaagtttctatcaaggcagaagaggcaggacagccaaggaattgagcataaaggacactctactgtgagagctagccttgatttgacatgtgtcaggaaacatacgacctcaaacaatcttcatacacaatgaagagatataagaagatttggtaatccaggaagtctcgaaagttcttcagaaatgtttaacctatttcaaaaattttcattactctgcgcacactattcctcattacagaaagtgctcaataaacttctgtatgctcctattactattttttgagctctaagtgtatt

SEQ ID NO: 460330 - DNA, 1134 bp, Homo sapiens
agagggggccctgtgcatgaggtctccttttcagcctcaaaatcaccaacttctcatcattaaaactgagagagagagagagagagagagaacaccaaagcctcaccgtggaaacacatgaacacgaatgagcaggctgtagcggaagcatgccatctactgccatctgcttctggtgaggcctcagggagctgccaatcatggcggaaggtgaaggggagccagtgcatcacacggcaagagcaggagcaagagaggtgccaggctccttcaaacaaccagctctccagtgaactaacagagcaagatctcactcatctccaaggagcttcaccctgtcgcccagctggagtgcaaggcacgacctcagctcactgcaacttccacctctcaagttcaagcaattctcctgcctcagcctcccgagtagctgggattacagacacacatgaccacacctgtctaatttttgtatttttagacagcattgcccaaactccggtcacgcgctacgcagaacaacgatatggtcaacaacagaccacatgtacaatggtggtttgggtaaatccagtctatgacgttcacacaaccacaaaatcgcctaaggacacacttctcagaaagtgtctcctcatagttaagcaatgcatgatgaattttgtgcaaaacatttgttttcgttttgatcagtaactcagagattgaaacaaaattatgaactgaacccataattgattcctttaatgttttcactgttcagccaatcaaatttttaaggaaaagggtcccctctccacacctaaccccttcctggcatccagggtctcaggcgcctcctgtgggacaccttgaggcaccacagtgtcgagcagggaggttgttcataggacaagccaggcaggataggccagagggcatcagtcctgtagggtgggcagtgggcatgtgtggttggctgattgcaggggacaggcctctatggatttgaacaggaaagatggggcacttagctcccaaccctagaaaggtatcgagtttgtggtggctcccaaggaagctgcctgcctgtggggtcaacattccagcccccatggtctctcggctgtggcgtcagggacatctgtatgatgt

SEQ ID NO: 460331 - DNA, 1577 bp, Homo sapiens
gcttgattggtctgcttcctggatgctcattgtgggcaatgaaagacttcaggacggtgattccttgcagggagtggggccggagagggtttcactccagatcctgcaggcatctccccatcctcagctgtttgccagtcccaggaaagcacttctcaactcaccaactccagtagaaagaagggtgttaaggggcaccagtggaggttttctgagcatggatccaaccaccccggcctggggaacagaaagtacaacagtgaatggaaatgaccaagcccttcttctgctttgtggcaaggagaccctgatcccggtcttcctgatccttttcattgccctggtcgggctggtaggaaacgggtttgtgctctggctcctgggcttccgcatgcgcaggaacgccttctctgtctacgtcctcagcctggccggggccgacttcctcttcctctgcttccagattataaattgcctggtgtacctcagtaacttcttctgttccatctccatcaatttccctagcttcttcaccactgtgatgacctgtgcctaccttgcaggcctgagcatgctgagcaccgtcagcaccgagcgctgcctgtccgtcctgtggcccatctggtatcgctgccgccgccccagacacctgtcagcggtcgtgtgtgtcctgctctgggccctgtccctactgctgagcatcttggaagggaagttctgtggcttcttatttagtgatggtgactctggttggtgtcagacatttgatttcatcactgcagcgtggctgatttttttattcatggttctctgtgggtccagtctggccctgctggtcaggatcctctgtggctccaggggtctgccactgaccaggctgtacctgaccatcctgctcacagtgctggtgttcctcctctgcggcctgccctttggcattcagtggttcctaatattatggatctggaaggattctgatgtcttattttgtcatattcatccagtttcagttgtcctgtcatctcttaacagcagtgccaaccccatcatttacttcttcgtgggctcttttaggaagcagtggcggctgcagcagccgatcctcaagctggctctccagagggctctgcaggacattgctgaggtggatcacagtgaaggatgcttccgtcagggcaccccggagatgtcgagaagcactcccacttataagtgagaacgtgtggtattcggttttctgttcctgcattagtttgctaaggataatagtctccagctccatccatgttcccacaaaagacatgatctcattcttttttatggttaaatagtattccatggttcatatgttccgcatttttttaacttttatcttaggtttgggggtacatgtgaagatttgttatatagtttgatgattttctgtagttgtatgctttgacttctttctttttatctttttctgtatctagtaaagatttttgctttactggttaccatgagacttacgtaaaacatcttaactaataagaggttattttaacctgataactacttaactttgatcacttgcacaa

SEQ ID NO: 460332 - DNA, 2442 bp, Homo sapiens
agcgggtttccggtggtgtccaatccgacctgaggagtcacagttgtgagcaagttcggtgccgcgggctggggtaggcggcagtggggtccctggctttggggcactgggaagatcgcgagtgggaaggtcctcccgcggtcctccgggtcatctttcctcctgaggagcagcatatttcgcatctgccggagattagaattacttgttattggtaaatagccactatggagactaaggaccagaagaaacaaagaaagaaaaatagtggacccaaagctgcaaagaaaaagaagcggcatctgcaggatctccagctaggagacgaagaagatgcctggaagagaaatcccaaagcttttgcatttcagtctgctgtgtggatggctcgatcctttcacaggactcaggatttgaagacaaaaaagcatcatattccagtggttgatcgaactccactagagcccccaccaatagtggtagtggtgatggggcctccaaagttggaaagagcactttgatacaatgcctcattcggaacttcacccggcagaagttgaccgagatcagaggccctgtgatgatcgtgtcaggtaaaaagctccgactcaccattattgaatgtgggtgtgacattaacatgatgattgatctggctgaagtagcagatctggtactgatgcttatagatgccagctttgggtttgaaatggaaacgtttgagtttctaaacatctgtcaagtacatggctttcctaaaattatgggagttctcacccacctcgacttcttcaaacacaataagcaactgaagaagacaaagaagcgattaaaacacaggttctggacagaagtttacctggctggagtgcagtggcgtgatcttggctcactgcagccttgaactcccaggctcaagtggatcctccctcttcagccccgcaagtagctgggactacaggagtgcaccaccacccccatctaatatttttttgttgttattctagggacgagttctcactatgttgcccaggctggcctcgaactcctgggctcaagcaatcctcctgcgttggcctcccaaagtcctgggattacaggtgtaagccactacggctggcctattattgctgtattctaacttattcatctcctatggctagcctccaagctggaagctgaattgacagttgaaaaataatgacatgtatacaaggtatgtttgaaggattgcagatgcaggggcaccatatgctaaaggagtgttggaagctcactgcagaagatgacaaaagcagactgatatgtattatttgctgaaatataagctggaggcacaggtgaagattgccaaacctaatgaacagtttggcaaataagacaggctgtcaggccatggcagttcagcagtgggcgtgctgcctgtgaaccaagtcatttgttccagaggactacacttaaataccacaaataaaatcttccttgtcactgatatcacagtgaaatagatgttgtctttcagatttctggttgaattaccagccattaacatctggtgatttgggttgtaaaattatttttagttttgcctgttcatatttcatccagaaagcccaaacaagatatattttcccacataagaatgtaagcagtataatgccccgtccgggagggaggcggggggcagcccccacctggccagccgccccttccaggagggaggtggggggcgcctctgcccggctgccccgtctgggatttggatcccccagctcagcctgggtcatccccaccttctgcctcttgggccatagctcagctctgcacactgagccatcatcctatgatgccttcacaaactttgtccatgagaactctaaggacttctccagacctgttggctgctgctgtgatctctgcccaagaggagcctctgaccaacatccaaagggcttctggacccactggactcctctggaggcacctaataactcaggtaccttaacagtcactaatgagtgtctctccaaggtcaaaacaatggaagactgtagaagatgctattcattaagatatctcaagaatgtggaagactattattcgcttctcatgggacaggactttatagggcacctgaaaaaactcccatgaaaaatcacttttacaaaatgtcaagttatgatatccaagatgaaaccaatgagtcacaacattcacataatacactgtacaaccctgatctcttgactgtcatcaaatgtttcttacctctaaaccaaagtttcattttataatttaatttttctcattttttctgttctcttagcttaagaaaagatcattacaaactttttgtatgtttttcatatatgcttgcaaagggttgtaaaactttattgtgattattcttgctttaagctgaaacttccctaatctttcttt

SEQ ID NO: 460333 - DNA, 2301 bp, Homo sapiens
agcgggtttccggtggtgtccaatccgacctgaggagtcacagttgtgagcaaattagaattacttgttattggtaaatagccactatggagactaaggaccagaagaaacaaagaaagaaaaatagtggacccaaagctgcaaagaaaaagaagcggcatctgcaggatctccagctaggagacgaagaagatgcctggaagagaaatcccaaagcttttgcatttcagtctgctgtgtggatggctcgatcctttcacaggactcaggatttgaagacaaaaaagcatcatattccagtggttgatcgaactccactagagcccccaccaatagtggtagtggtgatggggcctccaaagttggaaagagcactttgatacaatgcctcattcggaacttcacccggcagaagttgaccgagatcagaggccctgtgatgatcgtgtcaggtaaaaagctccgactcaccattattgaatgtgggtgtgacattaacatgatgattgatctggctgaagtagcagatctggtactgatgcttatagatgccagctttgggtttgaaatggaaacgtttgagtttctaaacatctgtcaagtacatggctttcctaaaattatgggagttctcacccacctcgacttcttcaaacacaataagcaactgaagaagacaaagaagcgattaaaacacaggttctggacagaagtttacctggctggagtgcagtggcgtgatcttggctcactgcagccttgaactcccaggctcaagtggatcctccctcttcagccccgcaagtagctgggactacaggagtgcaccaccacccccatctaatatttttttgttgttattctagggacgagttctcactatgttgcccaggctggcctcgaactcctgggctcaagcaatcctcctgcgttggcctcccaaagtcctgggattacaggtgtaagccactacggctggcctattattgctgtattctaacttattcatctcctatggctagcctccaagctggaagctgaattgacagttgaaaaataatgacatgtatacaaggtatgtttgaaggattgcagatgcaggggcaccatatgctaaaggagtgttggaagctcactgcagaagatgacaaaagcagactgatatgtattatttgctgaaatataagctggaggcacaggtgaagattgccaaacctaatgaacagtttggcaaataagacaggctgtcaggccatggcagttcagcagtgggcgtgctgcctgtgaaccaagtcatttgttccagaggactacacttaaataccacaaataaaatcttccttgtcactgatatcacagtgaaatagatgttgtctttcagatttctggttgaattaccagccattaacatctggtgatttgggttgtaaaattatttttagttttgcctgttcatatttcatccagaaagcccaaacaagatatattttcccacataagaatgtaagcagtataatgccccgtccgggagggaggcggggggcagcccccacctggccagccgccccttccaggagggaggtggggggcgcctctgcccggctgccccgtctgggatttggatcccccagctcagcctgggtcatccccaccttctgcctcttgggccatagctcagctctgcacactgagccatcatcctatgatgccttcacaaactttgtccatgagaactctaaggacttctccagacctgttggctgctgctgtgatctctgcccaagaggagcctctgaccaacatccaaagggcttctggacccactggactcctctggaggcacctaataactcaggtaccttaacagtcactaatgagtgtctctccaaggtcaaaacaatggaagactgtagaagatgctattcattaagatatctcaagaatgtggaagactattattcgcttctcatgggacaggactttatagggcacctgaaaaaactcccatgaaaaatcacttttacaaaatgtcaagttatgatatccaagatgaaaccaatgagtcacaacattcacataatacactgtacaaccctgatctcttgactgtcatcaaatgtttcttacctctaaaccaaagtttcattttataatttaatttttctcattttttctgttctcttagcttaagaaaagatcattacaaactttttgtatgtttttcatatatgcttgcaaagggttgtaaaactttattgtgattattcttgctttaagctgaaacttccctaatctttcttt

SEQ ID NO: 460334 - DNA, 789 bp, Homo sapiens
agcgggtttccggtggtgtccaatccgacctgaggagtcacagttgtgagcaagttcggtgccgcgggctgggattagaattacttgttattggtaaatagccactatggagactaaggaccagaagaaacaaagaaagaaaaatagtggacccaaagctgcaaagaaaaagaagcggcatctgcaggatctccagctaggagacgaagaagatgcctggaagagaaatcccaaagcttttgcatttcagtctgctgtgtggatggctcgatcctttcacaggactcaggatttgaagacaaaaaagcatcatattccagtggttgatcgaactccactagagcccccaccaatagtggtagtggtgatggggcctccaaagttggaaagagcactttgatacaatgcctcattcggaacttcacccggcagaagttgaccgagatcagaggccctgtgatgatcgtgtcaggtaaaaagctccgactcaccattattgaatgtgggtgtgacattaacatgatgattgatctggctgaagtagcagatctggtactgatgcttatagatgccagctttgggtttgaaatggaaacgtttgagtttctaaacatctgtcaagtacatggctttcctaaaattatgggagttctcacccacctcgacttcttcaaacacaataagcaactgaagaagacaaagaagcgattaaaacacaggttctggacagaagtttacctggttgccaagctgttctgcctttctggaatggtgcatggagaatatcaa

SEQ ID NO: 460335 - DNA, 1165 bp, Homo sapiens
ccacgcgtccgcggacgcgtgggcggacgggtcttctgttgttagacaacattgtgcaagcttggtttttataagtttgcatggattaaactgaacttaatgaaattgtccctccccccaaattctcagcacaatttttaggcccacaaggagtcaagcacctcaaggagatcttcagtttgaacttggtgtagacacagggatactgatgaatcaatattcaaattagctgttacctacttaagaaagagaggagaccttggggatttcgaggaagggttcataagggagattttagctgagaaataccatttgcacagtcaatcacttctgaccaagttatcagaaaaaggagaaaagaatgtctccccactaaatgttctagggtggtgagaaatctagggtggttatctaaatcaacaatatttagatattccaatatctaaatattgttggaaatactctcctgaagtgttcattgaactctaagagagacagcttgtgtatcagtggcagggtttaaggttcattttttattcccatattaatcctttaatatttagacaaatttccttctgagtttaaggataaaatgggatgggttctgcctgggcctggccctcatggggacatcaaagggcaatgttgcaaaaaaaaaaaaaaaaaaaaaaaaaatcagaccatcagattgcatggggggaaccacccccataattaaattacctccacccagtcccacccttgacacctggagattatggggattgcaattcaaggtgagatttgggtggagacatagagccaaagtatattattcaaataagaaatcaaaagagaaattggaaagttcattgagctgaaaatgaaaacacgatatatcagaatcagggagttgcagctaatgtatgcttggaggcaaatttaagcactaagatcctatattataacaaaaaagaaaggtctcaaatcagtgacctgagttttcaccttcagaaactggaaagagaagagcaaattaaacacaatgtaagcagataaagaaaataataaaaagaacagaaatcaatgaaagaaaaaaagggaaaattataagaaaaatccaagaaagtaaatgctaatcattttaaacaatcaattaaattgttagacttctagtcagctgatc

SEQ ID NO: 460336 - DNA, 2060 bp, Homo sapiens
caagctcaggcatggtgggctgcggcccctcactgccccggccagcggggccagcttgctgctccgagtgcgggccggcgcccacgcccacccggaactggcattggcccgcaattgctgcgcgcagccccgattcccgcccacacctctccctccacacctccccgcaagctgagggagccagctctggccttggccagcccagaaaggggctcccacagtgcagtggcgggctgaagggctcctcaagcatggccagagtgggcgtcaaggccgaggaggtgccgagagtgagcgagggctctctgaaggctgtgagacccctgatttcccacttcacacctctgtatttctgtgtgtatgtccttaattcctctagctccattgggttagagtctccccgagcgagctggtctcggcaagtggcgtccattcgtggaggctcgaatccaggtcaaagggttgctggagcgacggttggaatggaaaactagctggaagacacccaagtactcttaaagcaatccccgtgttctggaggctgggaagtccaaggtcaagatgctgacaaatgatgagagctttcttgctgcatcctcacatggaagaaggtggaagggcaagagagaagaaactaatgctaggaaatgcctcttttaaaagggacttagtcccattaacaaagaagcaggtcttatggcctaatcatctcataaaagcaccacctcttaatactatcacattggcaataccttgattttggaggggacacattcaaaccatagcagagaccactaagtatagggaagactaaacccgagaaccaagtggccagaagcctgcactagctcagctgattctgctattagacttagataaagtatgagccttttgctactgaatcaacagaaaggctgcccgaaagcacttctgttgttagacaacattgtgcaagcttggtttttataagtttgcatggattaaactgaacttaatgaaattgtccctccccccaaattctcagcacaatttttaggcccacaaggagtcaagcacctcaaggagatcttcagtttgaacttggtgtagacacagggatactgatgaatcaatattcaaattagctgttacctacttaagaaagagaggagaccttggggatttcgaggaagggttcataagggagattttagctgagaaataccatttgcacagtcaatcacttctgaccaagttatcagaaaaaggagaaaagaatgtctccccactaaatgttctagggtggtgagaaatctagggtggttatctaaatcaacaatatttagatattccaatatctaaatattgttggaaatactctcctgaagtgttcattgaactctaagagagacagcttgtgtatcagtggcagggtttaaggttcattttttattcccatattaatcctttaatatttagacaaatttccttctgagtttaaggataaaatgggatgggttctgcctgggcctggccctcatggggacatcaaagggcaatgttgcaaaaaaaaaaaaaaaaaaaaaaaaaatcagaccatcagattgcatggggggaaccacccccataattaaattacctccacccagtcccacccttgacacctggagattatggggattgcaattcaaggtgagatttgggtggagacatagagccaaagtatattattcaaataagaaatcaaaagagaaattggaaagttcattgagctgaaaatgaaaacacgatatatcagaatcagggagttgcagctaatgtatgcttggaggcaaatttaagcactaagatcctatattataacaaaaaagaaaggtctcaaatcagtgacctgagttttcaccttcagaaactggaaagagaagagcaaattaaacacaatgtaagcagataaagaaaataataaaaagaacagaaatcaatgaaagaaaaaaagggaaaattataagaaaaatccaagaaagtaaatgctaatcattttaaacaatcaattaaattgttagacttctagtcagctgatc

SEQ ID NO: 460337 - DNA, 1364 bp, Homo sapiens
gtatctattaagaatttgctcaaatgttatttcattgcttgtctaatgttatagctgcctcctttgcctactgtgctttgccaaatgttgtgtgtctcgctcctgtggttcttccttggctaacctcacatgcgtgcgtggatcagaatcctgctgaggacttcacctgggctcgctgtacagcccaagagtttcttctaggtgcaactttcctcatctttgttaactctgcttgcaaatatcagctgccatggccccccccagaatccctactccatggcaccagctcaggaagttcaccaggcttcaactggcgcagtagccaaggccctgcacgcctgcctttggtggccagacaccagcttagacacaagactacactggaccctggggaatgtggagcttggaatgcaaacaagcacctggcaaccaggacaggctaccagggactagagaaccaggaggcttcattgggtaacaaagttcttcccaagcattctcttgcattccacccggggaacaagacagcaccgggtttcacactggcaaggcaggaggctgtgtgctgccagaacgaccagcagggggcgcaaaggccacgccaggcacctgctggcctcagagaaaacagaaagggaaccaggaagcccactcctgctgtcctttctctgcaaggaaatgtgccagggcactgcagcccagacagtcggcagtagaggacccatgaagtatctttgtgcaaagaaagcagcaaagagaattaagagaattgcatcatataaagagtgaattaaaccatctaaaggagcaaaaattcatcatcacatggacaagaaattaagacgtaacatccatctcactatttgcaaagtggcttattcctacagacaatgcagatatcagctggaaacctaggagcagaagcccagcataaagatctctgaaagcctggatgcgtggattcctctcttacttcccaaaacggtggggtggaaatgtgaatatcagcatgatgcacagatctctgcagatgtccagcgaactgaatttctagacgctataatctatgttctttcccaacccccacttcagtttacatatcgcaggccatagatcctgtttgttgaaaagcgatcagctagaaaacaagagtggttataacctgtgctgcccagtgatcaggaaaagagagcggatgaaacttccatgactttctgttagtctgattaatatccatgccaaatgtaagattagttaaaaggccttattgcttcccaccaaaatgttccttcactagctatatactacactgaaatgtaaagttatgggtatgtttaacagtttaatttgtcagtgggcatcca

SEQ ID NO: 460338 - DNA, 2607 bp, Homo sapiens
tgacctcctctgcccagttccatgccctacttcagttgcaggggcaggggattagaggccctggggactgcacacgctgcaggattgaatgcctcaggggcaggaacttgcggaggacagagtccactgcacgagctagtaaaaaactccatcattgagggtcacaaaactgaaggtcttgattccgagctcttcagagggacccttgagtggggctctggtcctgtggcctttgatctcatactcagtccattgcagcagatgctgtggaggcatttgaaagttatgctgggtcttcgtttgcccacagatcaagaacaatttagggagtttgcagagcagatgaacagagatttatggaatgagcaaaatgccctgtgggagcattggggagctgttcgttctcatgatagtgagtgacttctcacgagatctgatggttttataaggggctcttccctcttcgctcatcccttctctttcttgccaccatgtgagaaaggtccttgcttcccctttgccttccaccatgattgtaagtttcctgaggcctccccagccatgtggaactggtttcactctgtcacccaggctggagtgcagtggctggatcacggctcattgcagccttgacctcaggggctcaagcaatcctcctggcctcaacctcctgagtagctgggactacaagctacctcgcccagctgatttttgtattttttgtagcgatgggggggtctcaccatgttgcgtaggctggtctcgaactcctggtctcaagtgatctgcctgacttggcctcccaaagtactgggattacaggtgtgaaccaccgtacctggcccattttacacttttaaatccttttctactaaggtgatcattcaatcagtttccatatagtttttcctctgtacataaagattggtaacattgtaaataagtattacaatccgaattcacagaaaatatttataatctcaagagaacagaatctattttgaacagagctcttgtttttgtaattagttcaccaccacatttttccatatgtttctgtatccaccttttcttggaacttatgggcaggaaatgacagaagaaggcaggaaaaggaaacgtcaaagtttttttggagggactgcattttctgggactgataagatggatgacttccactgtaactctggttatcaaaggaataggagaaataacaaattctcagtatagttgtcaatctcacttaataccatcagaatgaaggatttaaatgaaaagttcaagttaaaaggcatctttatacataatcctctgatattcctagtgctctcacttatttacctgtgtgggtgtttttaaaaaactggaagtataataaaaagaatccagaatccatatgaaaagtagatatgtgtgttaacatagaaattgaataaattggtatttcaaatatcaatccctgtattttttccatcatgaaaatgaaatacatttttaatgtaaagttttgggttttgtttctttttagaactttcacttatttgtaactttcatttcttattttttgtaactttcatttttaaaaaattaactgctttgcatttccccttgtggaaaaaaagaaaaactactcaaaatagctttccctttatgaagtgaatgtactccatttatttttatggctgaaaaatattctattgcatgaatatactatgttttattattccatttgtcaattaatggacatttgattgtttccattttggggctattctgaatactgctgctacgaacatttgtgtacagatttttgtgtggacacatgctttaatgcttttgggcctatatgtaggagtggtattgctgggttacatgaaaactctgtgtttaaccttttgaggaactgttgaaagtggctgtaccactctacatgcccccccagcagtgtatgaagattccaatttccctacaccctttccgtcacttgttattatctgtctttttgattagagtcatcttagtggtttgaagcaatatctcattgtggctggatttgcatttctgtaatgacaaataatgttgatcattttttaatgtgcttattggccacttgtgtgtcttctttggaggaatttctattcaaatcctttgtccatttttaatttttttaattgttgacttgcgtgtgtacatatttccactagtgcatttcccacactgttctgtcgcctatgctttatgtgtctgagtttcctattagactgtggccagatgtgggcagggtctgggtcagacttgaacccaggcccttctcatgggcacagtgcagagcatgcagtaggcacctggtaaatgcatcaagactggagacccaaactctctggggagcccttgtgctctcctccaagcttctttcttctcaaagtccctgcatttctagattccttatatatggaagcccgtggtgggtctgggtcctctctggggaagcaggggttgagctgagaggtctcaattctggaacatactgcctcactgcctagccagaccttccctctcgtcctggacagtactgttttcactctgcaagtctgcagatgcccctcc

SEQ ID NO: 460339 - DNA, 2193 bp, Homo sapiens
gtgagtgggtccctgctgtgttcatctgaataagatgaaatgaagcactggtggaggtagcatcccgggtctcagcagtcatagagcccccccacctccacctctgcccccatctgagaccccctgcaccctcccttgagtggagaatcactgtggttaatgtgaaacacacagacaaaaaaaaaaaaatgcaggcacccacggcctggcctgaagggaggtagggtgggactggagacgcggggtggacgagagcaacacctccaaacgcaggcacccgcagcctggcctgaagggaggtagggtgggactggagacgcggggtggaatttgtgggagaagtttgacgggtcaccagcagcccagtgtttccagaaacagccctgctcctgcagtggcgaggaacccagacagcggcaaggcctacaccgtgtcctccagccacccgcctagccccacacagtggcaaaataccaaaagaccctaaaataccagcgaggcggggggtggtctgtccctgctaagagctgcctgggggtgctactgcctctcctgcaacacagggcttctaaatttccacctccaaccgcgagctctgcaaaaactgcaggcgaggacaggctttggaggtatgtgggatggcggctccctgacatggactaggggactctgcagcctccctgagggccgcgggaagcccacagagcctcaccgggttctgttgggtgttatgagaggcggctgcagcgatccaacgggcagacatggcctgaaagtggtgctgggatgttctgacctggacctgagggcgaaatcctcaggcttcaacacgagcccttccatctctgcagaggtggcacagcccctccaggcacatccagggctgtgggaatcctgggacctgggtcttccaggcacacctggggctgtgggaatcctgggacccggcccccccaagcatagctggggctgtgggaatcctgggacccagctcttccgggaactcttggggctgtgggaatcctgggacccgggtcttccaggcacacctggggctgtgggaatcctgggactcggcccccccaagcatagctggggctgtgggaatcctgggacccgggtcttccaggcacacctggggctgtgggaatcctgggacctggccccttcgggcactcctggcactgtggaatcctaggacctggcccttcctggctgggtcaggccctgccagttgggagcagcctgcgtgtggcgtgatctggtgtggcgtgcctcctgcgtgtagggtcacccttgactgcctcgactaccttctcctttcactacccagggcctgggaccctcctttccttacgtggggtcccctctgcagcccacatcccctctgacagatccctccacggaaaggctccggcacctcaacctcactctggctgcattggaaactcttctgtcgctatcggccttctctgaagagctttaatctctccttccatggagtctcctgtggacttaatacacgaatccatacacttgtactaatgggtagcatggaattaatgtgtggctttctccagatgtggatgttgatatttcagtaaagtctgagttgtttctggaaggtcaatgcctgagacaaaacgaatcccaaccccccagctgtggcttcatgatgctggccactgggtggccgagcgctttccgagtcccgtgaatcagaccctgcgtcttccctgtgacagtgaaatctgcttacaacacaggccccctcgctgcagaaacagcgtgatttggagcccactgggacaaagcattatatgcttctctagccaacatctcagatgaaggtgatttgaggcctgggtgggagacttcagccaggagctggccgtgctcccacgcattcaggggagcgctcacttctgactgctgcgaatgtctgagccacccatcacctctcgactctaagttctctaagcttcatcctagtgatgtcaagttaccagaacttaatagaaactggtcgtttgagcttagcttttgcactgaattaagatttcatttatttttgtgatttttataaaagattaatgtgagtcctttatttgaaaaaatgttctcgtatcttttgaaactttatctggaagaagttgtctactccagtacctgttttcttttctaaaagaactc

SEQ ID NO: 460340 - DNA, 1727 bp, Homo sapiens
gctgcagctagtgtcttcacagtggccactcaagatgggccgctgccaccatcagtttgaagtcagtggctcttcttgtgatataactttctatgacaccattcttgcatataaagctggggatgccaccttgttaccaccagctagagctgcaggtctgttggagtttgctagaggtccactccagaccctgtttgcctgggtatcagcagcagtgtctgcagaacagcagattttcgtgaactgcgaatgctgctgtctgatcgttactctggaagtgttgtctcagaggagtacccggccctgtgaggtgtcagtctgcccctactgggatctccagctgcgtgctgggagaaccactgctctcttcaaagctgtcagacagggacatttaagtctgcagaggttactgctgtctttttgtttgtctgtgccctgccgcccagtggtggagcctacagaggcaggcaggcctccttgagctgtgatgacagaaacttcatctgcattggcttcggcaaagcagaaatttattagcttacaaggccccatcttgtccatgcacctgtctgcttccttggcttcagagcattgcctccaagtcctctacagcacaactttcccttcagcatccaaccttatgatgtactgggatattgtgttgcccctctcccctctctacctgtgctgggctttaaggctgacacacctataaaccccaggagtggagggaagggagagtggattgtcattgagacatatgttctgcttacgtggagagtaacttgagcaacgttacccacctctatgtggaaacacaggtttatttagtatgttgaaattccagacataactatctgttcagtagcagtggttcctataagacaacaacttcactgttcattttgtgctagtagaatggaacttcacggaccttggagaagcatactccaaacactacaaatgatggttatactttggagagatgctaagacagcagatgctaaaatccagataccttttgtgaatatgaggcatatctactgggaacacatcataataatctgttgaggtaaacattaaagatggtggcaataagcagttggagaaaaagaaaaatatcaacatgcaaggcaccattgttttcttgcttcttaattgtaactttttattttttgtgtatatggctatcacagagatttaaaaattaatcattgaaaatcattaatagaatcgacctgtgagcatcaacacagaaatggataaagaaaatgtgttatatacacagtgggataccattaagcctaaaaatgaaggaaatcttgttattcacagcaacatgggtgagcctgggggggcattatgttcagtgaaataagtcaggcacagaaagataaatatcacctgttctcacttatatattccttggattgggttttgactttctcctgaatcttgatgacctttattcctatccatattttgaattctctctctgtcatttccaccctttctgcctggttaagaacccttccttgggaactagtacagttatttggaggaaagaaaacactgtagtttagttgttagagctcttgcaccagttttttctcatctgtgtgggctgatgctcctttaactgtggtgtaattgagtgcagactccttttttgaatgttttttgagggccgaggttttgtgcagggtctttgttgttgaaatcttgtc

SEQ ID NO: 460341 - DNA, 1537 bp, Homo sapiens
gctgcagctagtgtcttcacagtggccactcaagatgggccgctgccaccatcagtttgaagtcagtggctcttcttgtgatataactttctatgacaccattcttgcatataaagctggggatgccaccttgttaccaccagctagagctgcaggtctgttggagtttgctagaggtccactccagaccctgtttgcctgggtatcagcagcagtgtctgcagaacagcagattttcgtgaactgcgaatgctgctgtctgatcgttactctggaagtgttgtctcagaggagtacccggccctgtgaggtgtcagtctgcccctactgggatctccagctgcgtgctgggagaaccactgctctcttcaaagctgtcagacagggacatttaagtctgcagaggttactgctgtctttttgtttgtctgtgccctgccgcccagtggtggagcctacagaggcaggcaggcctccttgagctgtgatgacagaaacttcatctgcattggcttcggcaaagcagaaatttattagcttacaagggagagtggattgtcattgagacatatgttctgcttacgtggagagtaacttgagcaacgttacccacctctatgtggaaacacaggtttatttagtatgttgaaattccagacataactatctgttcagtagcagtggttcctataagacaacaacttcactgttcattttgtgctagtagaatggaacttcacggaccttggagaagcatactccaaacactacaaatgatggttatactttggagagatgctaagacagcagatgctaaaatccagataccttttgtgaatatgaggcatatctactgggaacacatcataataatctgttgaggtaaacattaaagatggtggcaataagcagttggagaaaaagaaaaatatcaacatgcaaggcaccattgttttcttgcttcttaattgtaactttttattttttgtgtatatggctatcacagagatttaaaaattaatcattgaaaatcattaatagaatcgacctgtgagcatcaacacagaaatggataaagaaaatgtgttatatacacagtgggataccattaagcctaaaaatgaaggaaatcttgttattcacagcaacatgggtgagcctgggggggcattatgttcagtgaaataagtcaggcacagaaagataaatatcacctgttctcacttatatattccttggattgggttttgactttctcctgaatcttgatgacctttattcctatccatattttgaattctctctctgtcatttccaccctttctgcctggttaagaacccttccttgggaactagtacagttatttggaggaaagaaaacactgtagtttagttgttagagctcttgcaccagttttttctcatctgtgtgggctgatgctcctttaactgtggtgtaattgagtgcagactccttttttgaatgttttttgagggccgaggttttgtgcagggtctttgttgttgaaatcttgtc

SEQ ID NO: 460342 - DNA, 1028 bp, Homo sapiens
gctgcagctagtgtcttcacagtggccactcaagatgggccgctgccaccatcagtttgaagtcagtggctcttcttgtgatataactttctatgacaccattcttgcatataaagctggggatgccaccttgttaccaccagctagagctgcaggtctgttggagtttgctagaggtccactccagaccctgtttgcctgggtatcagcagcagtgtctgcagaacagcagattttcgtgaactgcgaatgctgctgtctgatcgttactctggaagtgttgtctcagaggagtacccggccctgtgaggtgtcagtctgcccctactgggatctccagctgcgtgctgggagaaccactgctctcttcaaagctgtcagacagggacatttaagtctgcagaggttactgctgtctttttgtttgtctgtgccctgccgcccagtggtggagcctacagaggcaggcaggcctccttgagctgtgatgacagaaacttcatctgcattggcttcggcaaagcagaaatttattagcttacaaggccccatcttgtccatgcacctgtctgcttccttggcttcagagcattgcctccaagtcctctacagcacaactttcccttcagcatccaaccttatgatgtactgggatattgtgttgcccctctcccctctctacctgtgctgggctttaaggctgacacacctataaaccccaggagtggagggaagggagagtggattgtcattgagacatatgttctgcttacgtggagagtaacttgagcaacgttacccacctctatgtggaaacacaggtttatttagtatgttgaaattccagacataactatctgttcagtagcagtggttcctataagacaacaacttcactgttcattttgtgctagtagaatggaacttcacggaccttggagaagcatactccaaacactacaaatgatggttatactttggagagccgtctgcatgctatcgctcatacctgatgacgcgccgcctga

SEQ ID NO: 460343 - DNA, 1640 bp, Homo sapiens
gctgcagctagtgtcttcacagtggccactcaagatgggccgctgccaccatcagtttgaagtcagtggctcttcttgtgatataactttctatgacaccattcttgcatataaagctggggatgccaccttgttaccaccagctagagctgcaggtctgttggagtttgctagaggtccactccagaccctgtttgcctgggtatcagcagcagtgtctgcagaacagcagattttcgtgaactgcgaatgctgctgtctgatcgttactctggaagtgttgtctcagaggagtacccggccctgtgaggtgtcagtctgcccctactgggatctccagctgcgtgctgggagaaccactgctctcttcaaagctgtcagacagggacatttaagtctgcagaggttactgctgtctttttgtttgtctgtgccctgccgcccagtggtggagcctacagaggcaggcaggcctccttgagctgtgatgacagaaacttcatctgcattggcttcggcaaagcagaaatttattagcttacaaggccccatcttgtccatgcacctgtctgcttccttggcttcagagcattgcctccaagtcctctacagcacaactttcccttcagcatccaaccttatgatgtactgggatattgtgttgcccctctcccctctctacctgtgctgggctttaaggctgacacacctataaaccccaggagtggagggaagggagagtggattgtcattgagacatatgttctgcttacgtggagagtaacttgagcaacgttacccacctctatgtggaaacacaggtttatttaaatggaacttcacggaccttggagaagcatactccaaacactacaaatgatggttatactttggagagatgctaagacagcagatgctaaaatccagataccttttgtgaatatgaggcatatctactgggaacacatcataataatctgttgaggtaaacattaaagatggtggcaataagcagttggagaaaaagaaaaatatcaacatgcaaggcaccattgttttcttgcttcttaattgtaactttttattttttgtgtatatggctatcacagagatttaaaaattaatcattgaaaatcattaatagaatcgacctgtgagcatcaacacagaaatggataaagaaaatgtgttatatacacagtgggataccattaagcctaaaaatgaaggaaatcttgttattcacagcaacatgggtgagcctgggggggcattatgttcagtgaaataagtcaggcacagaaagataaatatcacctgttctcacttatatattccttggattgggttttgactttctcctgaatcttgatgacctttattcctatccatattttgaattctctctctgtcatttccaccctttctgcctggttaagaacccttccttgggaactagtacagttatttggaggaaagaaaacactgtagtttagttgttagagctcttgcaccagttttttctcatctgtgtgggctgatgctcctttaactgtggtgtaattgagtgcagactccttttttgaatgttttttgagggccgaggttttgtgcagggtctttgttgttgaaatcttgtc

SEQ ID NO: 460344 - DNA, 615 bp, Homo sapiens
aggggtggagctgcccaagtctatgggaacccacattttgtatcagcatgacctggttgtgagacgtgaagtcaaaggagaacattttggagctttaagatttgccttccccgctggatttcagacttgtatggggcctgtagcccctttgttttggccaatctttcccattcagaatggctgtatttacccattgcctgtaaccccattgtatctacaagcctgggacacaagaagggaaaaacttgttcttcagaggctcggtttaaacccactgtctggctcgctgtctggctcgagagtgacttatggaaggaagggcatgaagaaggaccatgccgctgcacaagtgtccagggaacctcaggccatttcacaaggacaagctcaggccaaatgcatctggagaacccggagaaacctagcgtaaccctcccatctcaatcagactgaaaggtccatcaataccacgaaggacaatccaccgcagtgcacttagtcctctcttgctgagatgcccctctgcactcggctgcagcgtttctttccatctaatacgatattccatttcaagcctatgctgttgttggtaaattcttcttgctacccatgagc

SEQ ID NO: 460345 - DNA, 887 bp, Homo sapiens
agcagccagttcatgagggctccagtttctccacctccttagcaacattgattttctctctggatgtgagtttaggacactgcatttctaccattcaatttcttactacatttttgcacagggatcatggcacaagttgcagtttccaccctgcccatggaagatgaggagtccatggaagatgaggagtctgttgaagatgattccgtggagagcaggatggtggtgacatttctcgtatcagctctcgagtccacgccagtaaaaaactctcacagctccggatgtgagtttaggacactggatttctaccactcattttcttactacttttcttgtgcaaggatcatggcacaagttgcagtttccaccctgcccattgaagatgaggagtctgttgaagatgaggagtccttggagagcaggatggtggtgacattcctgtcagctctcgactccatggtcagaccttctgttctcacattctgtagttcagtaggactgggcgcaacccagacattctccaactccagttgttaagggcgcttatgaacgcttcattatgcaggcatgattgatgaagtcattgaccattggtaattaagtcagtcttcggccactatttcttcctggagcccaggggctgaaaatagttaattttatgtatattccaactcagaatacatcctatttttgaatatttgatgactttaggatactatattaactcttaattgaattaatacaagtttaggtgtaaagatgatgtttatgttgacaaaaattattaatgttttacatatatgaaagtaacaatatcatatatttttcatacttgtacaatactttgaaatctattattagctaatattttatattcattttgc

SEQ ID NO: 460346 - DNA, 3561 bp, Homo sapiens
gctaacaaattggaaaacctggaggaaatgattaaatatctggacacatgccaatccggcaagattgaattaggaaaaaataaaaaacttaaggagacctataacataataagattgaatcagatactaagtccattaggagagaatctttcatctgttttaactgctatgctctcagacagtcttctggatgaccttggaccaatccagctctaccctattcttgcagagaatttcaccaactttaagacattctcggtagaaaaagcaaatggggaagaagtaaagatagattctttcattattatcaatggtaaccataatactcaagctaaccagtggttagcaaacacaaagcagggggaagaatcccatccttatgttaagattgtagctagagtcttatttaaagacaatttcaatttaatgttcaaggagatatctatgaaaattcaattggatttcaaatttcaggaattcataaggtcagggaaaatcttaacaagtgtggtaaagtgaagagatttcaaaaatgccagtttttcagacaggagaggagataaagggtttgagatagcagaacaatagagctaagaaatataaacttggtctaagtcttttgacaaaatctagcatcagcctgaaaatttatcattcttttcagtatatgtttcatgtaagcttgttagaaaagaagaataagattacgtatacagatggctaactcagcaggtgagagcttgattaatctcaggtcaagacctcatgtctcctacgggctcattattttcacacgttttcatgtccacagtgtacatatttaacccaggtcagtcatttcataaatgcttattcagattcattcataacgggtaaattcttgaagttctaactccacaataaaagaaaaacttacagcacattcataataatattggatttgtagtttcaatcacaaattaaaaccaacaataatgtttttatgcccattatccattgtctctatgttaatgaattccattgatccatcaacttatatttagggtttctgattgtctattttgctgacaagtcaataccttcaactcattgaaaccatggaaaattcataagatgtgcaatagagatctctgttcccaatgattagtcctgaaacatatgttttgctatactttcaaatagtgaggcacgatggccgggctttgttgttgttttcttatgaattctgtaaatttcactcaccttttgactaattttccattcttagtactatagcagaagtcgatgctaggccatccaaagggtatcagatcaactgtcagaagtgaggagctaatatttaagcaatgcatctgcttgtaatacctgactctctcacttctgcttgtgcgatcttggtaatgttatctttctgggcaaaactttgctcatttataaaatgggaataataattatgtctattctatcagattgttatgaagattaaataatttatagttcacatagtatcttcccatgatttattttatttaatccttaaactctatgagataagacaaggaggcatttttgtccttagttgacaatgaaaaaaaataaggattgatatggtgaaatatcctgctcaaagtcacaaaactgttactcaagtccttcattcaacaaaattatgccagagaccattaaaataaaaatgattagaaagtgatatttgctgttctctctgtaattcaaaatttattgagagaaaagcatataaataagcacaagcaaatcattcagaggtcctataggagatgcctaaacaaggtaagagagagtagtcactttttttgttgttgttgtttgataataggctatgccttgcaaagcaaaatagaataattgtatcattaactggagagagagagagagacagagagagagagagagactccagtttaaaggagatctggtgagaaatggggtaatgcgctccttagggacttcttcttgagatatgtacttacatagaaagaaataaacttgatgtcaagattttactgaatttttgtgaacaagcagagtttgtggacatcttttcaaggtaaaagcctgtcatgtagacaaaatgaagatgagttagagagctttaccaaaacactataaagtatgcatgtcatgttcttcaatttcaaagattcatgctgttcattctaactcagaaaaacaggcaattgctaaagaaaaattattttaagctgaaattttcagcaagctcacagtaatttcaggtatcttcataatggtagagagggcaagatgcatcaatatgtaaactggctcaaagactggagaaattaatatttaagcaggcgactgaagtctaccctgttcactcaagaagtgaagaggcaataacaggtaatagaacccagcaaaaacaaggtgccttgtggaggtcatggaaatggaaaagaaaaccagtgaaataaaaaatttcatgaaaaaggttctagtctgaactgagagaagccaatagtacactgtagaattggattcagaattgctttcaaagttttattctcctacttggatatgaaattttttttttcctttcaaataacaatatggacttctagttttcagtttagcatgtaggaaatttgaaagtctttgttctaacaaaattttaaggaaagcactttaccataagttgaccctgattagtaccacttttccttatgtgattctccatgaagttacagaaaggacaataataattattaccatttactttcactgttattttacaatgaaacacaatctgtgaaaataaaaatgaaagtcctatctaaagtaaatatcttctccctgctacaatatagattgtggtttaattttcaaacatatattttaaattcatatttgaagtgaaaactgttttttgtttgtttgtttgtttgggggatgcaaaatttagtagcacaaataacctttacatgtttccaatgaactagcatagatgagtcactgaggttgtcttgcttctttaccatcaagtctattttcactcacctcttgcttaccctgccaggtaccctacaggttccagtcatagacaaagaagcatcagcttcacatagaccattgaaacagctttcagaggattctgcttctctgatcaaattctgaatgatacaggtaagaaatgacttgctcctccttgccttctgccatgattgttcctccgcagcctccccagccatgtagaactagaactgtaagtccattaaacctctttctgtggttaattccccagtcttgggtatgtctttatcagcagcgtgaaaacggacatatatatttaagaatctagggaatctgtcatttttttttcctttacatccacagcattgatcagttagaaatgttggaggaaaacattcttattcaaaatagtaacaaaatacaaaatgtctaggtatatcctgattcagaaatttgaggaagttatacaaagaaaaatataaacatttgctcaaaaattaaaaaatgcatgacaataaatttgaaaaccat

SEQ ID NO: 460347 - DNA, 1675 bp, Homo sapiens
cctcctgggggcagtgaataggcaatgagagggactggaaggtcacatttgcagccagagcccaggctgccctggcatgtccggcaggaccatggcccgtcctcctattggacggctgcgtatcccctttccctcggtgaccacatttcaggacccttgatttctttgcaaatcccaccctgcctggccagtcccctcactctcatgccgaccgcagaaccaaggctgcgccccttcaaaggcagagttggggtaattttacttgacaagactgctgcctgccctcctcctctttcctcatctgccttcctctctcctgaccctgtttattattatcaggaaaaaacaataggtccacatttaaacttcaaagaaaagcacgggctcaggtttcaaacaactgcagaggcctgggcttgggacagctccatcccgctctctcacctgaactacggggaacctggggatggatttcaactctctgcagcccagcactcagggtcaaggtgaggcccagtctgtgaccacggaggaattctggaatgtggtgatgaccaacaggaattttatgagtgtccctctgtggaggagcctgagagaaaggctcatggagggcagagggtggagggcgtgggaccaagttccttagataaggctgtggccccatggtaagggtctggacggggaagtgattcatccaggtggcgctaggagggatcttcgccgcagagggcattcgagagatgacaactctagacatccatgcaacttctgttcttgtgctcctgctgttttcaaattccacagtcacagactgcaccctggaaaactcaggacaccctagagtgaactgctctgaagaacaaagttgctacttgcttgctacctctggttgctacccctggttgtgtttggttgccacataatgaaatgattttccttccctcttttatttcctttctttcttttttttctgctacaaatggaaaaatagtttgatcaccttgaatcttttcacccttggtattctcccccttcacacccgagcaccgccccttgataaatgagaacacgtgtactgaaatcgcagacttcaccctccagactcatcgtcctcatgctctcaggggggacatgtttcctttcaaacctccagaataaattcatcacagcaggaagaagattgtttttcttaaaaaaaatcaaatcctgtatcacaattatttcatttcagagggaaaatgctccccttccatctgaaactttcttctctccagctctgcagtctttgaccgtggcgatccggcaccctcggcccggctgcttttgcaaagtccacactgattcattatttcagagagccaaagggtgacacatgcatattttgaatattaccctgtatgtagatctgcctctggcttgacttaggggcttctaactgcctgatgtattggcactcgcatgctttcaatggtgtttgcatttaaaaaatcatcttcaattctttcatttggagggtgaactttctgaaaaggatgctgggaaccatgttatttcagtgttatttctctactataccagcccctttgcaagcaaacccctttttccttaatgacaacacacagtgacaaatgcccagtgctgtaaacgtgaagctccttggtttgactgagac

SEQ ID NO: 460348 - DNA, 1526 bp, Homo sapiens
ggacctcatcctgagccctgggaggggaggggcaccatgggcccccctgcagcagccaggattaccacccaggggactcggccttctgtggccctggccagacttagaatttggcccaagacaaacttacttggagccgcttctcagtacctggggcctgtgcattccaggcaagaactggggtgtgtgccgcctttggggctccagtccaagcatcggggcttctacagcactgtgggcttctcgggtgccaagaggcagaccacaggccatcttgaggaggactctggtaagagcttccttgtgtatgtggatgatgtccagaatgttggcctggtcctcagccaggccttggagctggaccaggccatccacttcagtatagatgccttccactctgtcagtgagctctttgccagtcagtccaggaaggacctggacccagccatggacctgttagtgctgtctcagggacaccagaccaacatcctggacatcatccacatacacaaggaagctcttaccaaagtcatggagagcaggcaacatgtggccgaagggaagacagaggtgcagaggctgatgatgtcagaatcacaggaacaggatttctttggccactttggctgaaattcaccacttccatccaattccagtgagagacatggactcacagatgcagcatttcttgcaacaagagatactactttttcaaaaagtcacccaggaattgatagtgttgaatgactcgatactcgatcgtggacggtttccagttcaaggatactttctacagcagaataataacactagcaaagagctagtacaaggatggttttgtgctcaactgaaatccagctgaatacagaattgtataggaaacagttaatatggtgatagaatagaaacagtagcaatcgtgaactaaatcatactatgaatgcctaaactactgctgtaacttttggaaaaatgataataccactttattgcttttcgaagtatgaatattttagtgtatatgctctagacctcaaactctataaagagtctcaaagaagttggctggataaagcctgctgtggatgtctttatattcaaagattgatgatgcaatttgaatatgtgtccccaccaaatctcatgttgaattatatttcctaatgtggaagttggatcctggtataaggtgattgaattatgaaggcaaatttctcatgaatggttcagcaccatccccttgtaccatccttacaataatgagtgacttctcatgagatgtggtcactgaaaactctatatcacctccctactctccgtgttttccccttgccatgtgagacaattgattctttctttgccttccatgattattgaaagatttctgaggcctagaagcagaagcactctgcttagaaccatgagccaattaaacctctttttcaaaataaatcatacagaaaatggcaaatgaggactggagcgttgctataaagatacctggaaatgtggaagcagctttggaa

SEQ ID NO: 460349 - DNA, 2157 bp, Homo sapiens
  misc_feature (1)..(1): n is a, c, g, or t
  misc_feature (5)..(6): n is a, c, g, or t
ngccnnagtatctcacaatgggactgtattcgaggaccgagtctctaaagaggtgattaggttaaaatgggttcaaggcgtttcggttgtttagcattccccgcctgctctaaccccaacccctgtctgcggtgctttgtcacggtggccctggcagtgcactgcaccgtggatggtaacatgttctcaggttctggggagtgggatgtggatatctttggggggctgttagtctgcctaccacaggtgggttctgtgaagaagcgtccctgcagctcctgcctgcacctggcagggagcaccgctacagagtttgctgctgtaccggctcagaaacgggagttcccggcacagggccatcggcgagcctcccagctggagtgtgggcagaggcagacactggggctgcaggggagtggcccccagggtgcaggtgcaggtgcaaaggtcctaaggcaggacctgagcagatgcaggtgcaaaggccctgaggcgggacctgagcaggagccgccagcatacttccctcacgtttctggccagaagtggatcacaggccttccccggattactcaggcccagagggtgcaatgtggtccccactacatggtagacaggatttgaactaaacaacagttcgctggagtggaaaataaaggatgctacattttcttattgtgataaaaaatatatatcataaaatttaccattttaacaatttatttagcttggggccctctgtctggggtcttcccctccatcctccgggaccccagtcctatccctctgcccaccctgtccttctcacccactctacaaccgagtttcaggactgaaggaccagggaccttcccacccccaggggctccctcaagaagagaaaattctctcatcatgagaaaaacatcagaccaatcccaatgcaggcgcatcctgcagctccgtgaccagcaagcctcgaaactgtcaaggtcacctgcctcgaaactgtcaaggtcatcaaatcaaaaccaaggcacatcctggcctgtccgtgcctctgcgccccaggccagcacctctgtagaatcgtttcctagaaatggaacagctgcttcaaagagagcccgtgagaagggtgtgggttgtaaggcaactctgccacggacaagatcatcttccaaagcgggcagagggagatgatgtggggtgggcgaggaaggtgatgtgtggcgatttcattacaggtgatcagagaaggtttctttgagggtgacatttgagcaaagacgtgaataaagagacagttggagccatgtggagatgtgaggaggagggttccaggccaggggacccgtacgtgccaaggccctgagagcacacaatttaacccaggacagcagggagacagcaccccaggccgagtgaaggggaggaccgcacaggcaaacgctggcctggcgaggcaccagaggctgtagaggaaagcgcctcccacctgtgagatgccaacaagatacccagggtctgaagagtcttaaaagaaaagcaaggagcgggggtatgatatccgaccaaagagcaaacgcccgagccacttggcactgcactctaactgggaggctgagcacacaaattagatgtttgtaagaataaacagtcattagaactcgagaactagaggagaaataaacatcatttcaagatatttgactaatttggctctgagctctgcctgcctgtgaatgtgctggtttctggcttgcggggatgcctgtgtatctgtgcatgcttcttgttagccctcttggttacgtgtccttactgagtgccaaagtctcctctgtaaaatggggataacagcaacacccaactcaagggtgttgggagagtggaacaaggaaatacacacaaattgattaaaacagagcctggcacctatacatcatattttgtattcactgtctctctccctctaacgtcagcttcctggaggcagagacctcttctgtcttgcttatctttgtgctgccaaaactgtgaggtatccccaaatgttagtcagctccctcatttcaccaatgggaagggacctccctcaatgtttttggtaaacttacatataaactttgggtgggggcgtatgcatagtccaaagttcacttgcacatttatatt

SEQ ID NO: 460350 - DNA, 1002 bp, Homo sapiens
ggccttccaaagtgctggaataataggcatgagccactgcgcccagctatagtattctttcaaccacagacagtagagttcctacgaggaattccaggaagctgatgtttttcatcccttccacctttatcagaatggattttaagtcccttacagtctggagcgctggctaacagctgttgacctgcttcttactccagctctggttccaacagtaacactggctcctcaaacttccaacccaaggaacggtttctgccaagaaaatgtgccttaggagatgagactaccagtggagcagaattccggcagttctccaggggctgcctgtcacgagggcactcaagctgcctgcagagaggcccatacggggagcatctaaggtcccgccaacagctggcaccaacttgccaaccatccgggaagaagaccctccagccccagtcaagcttgcaaatggctgtggctctggctgatgtctcaactgcaacctcttgaaagactccaagccagaatgttcctgaatttctgaccccccaagactgtgagatatattaaatgtgtattgttattttaaatttctactgtgcccaggtggagaagggtgcttggagagctaaggcggtcactgggagggtatatgtcttctgctgggtacccaggtgttctatggacaactgtgggagtagaggactggatgactcatgcagctggctcctgagtcccccagatgatgacagattggagctgctacagaatcctgactgggactcccacttccctgatgcagaccatttaccagactacgcttttggccgatggctattccagcaaacacctttggaagagactgcctgtgcatgccaacaagctggctgtatctacatgttctctcataaaactaggagctcatctactctgaagtcaaagtctagcaagccagttgccactgaatccaacctctacagcattactcaacaggaaaggggtgagttatagcac

SEQ ID NO: 460351 - DNA, 341 bp, Homo sapiens
tggcctcaagtgatccaccccctttggccttccaaagtgctggaataataggcatgagccactgcgcccagctatagtattctttcaaccacagacagtagagttcctacgaggaattccaggaagctgatgtttttcatcccttccacctttatcagaatggattttaagtcccttacagtctggagcgctggctaacagctgttgacctgcttcttactccagctctggttccaacagtaacactggctcctcaaacttccaacccaaggaacggtttctgccaagaaaatgtgccttaggagatgagactaccagtggagcagaattccggcagttct

SEQ ID NO: 460352 - DNA, 334 bp, Homo sapiens
tctaatgattagaatgtggctgaagtgcaagtgtgtgtcactgtggtttctgctttgttctcccttggattgtctgccgcaggggctgcctgtcacgagggcactcaagctgcctgcagagaggcccatacggggagcatctaaggtcccgccaacagctggcaccaacttgccaaccatccgggaagaagaccctccagccccagtcaagcttgcaaatggctgtggctctggctgatgtctcaactgcaacctcttgaaagactccaagccagaatgttcctgaatttctgaccccccaagactgtgagatatattaaatgtgtattgttat

SEQ ID NO: 460353 - DNA, 863 bp, Homo sapiens
ggtcaggagttttcagtgctctgattcggtaaatttatttacagagacagctgtccgagggtggaataaggactcgggagtgagagggaggcactgtcaacactttcaggccagaccagcggctcacgctttggagaccggggctgcagcaggttagtttgtagcctgaactgcatgatggagattgagctggatctattttaattgccatgaagacatcatgggcaggaagcatgcatgctggaatagattagcaaacattgactcctcacgaaagccacagccttccaactgcaactcagtggtcagaggaggatgagcaaaagtggaggacagagaatgacccgacgtggagctgagcggccctcttctgcgtggcgatttggagaacacagtcagcatgcacacacatcattcttcaggtgcagttatgacagaaggatggtcctgtctcatccctacacctgtgaggcctcagttctgcctctctcccctgttgtggccttggaaggaaaagcctccagctctgagtctgctgccaggtggaggttcttccatttgataagctttgtgttggacaaaacacagtggggacaggaacctaaagcagttgtgaaagagccggaggacccctgtccccaaaccctgcccatcgggaagaggccacagagctatgtgtcggccccacgcttgggcagaccactgcaggcacgtgtctaagggaatttctctaaacagaaatgaaataataacagaagaaggcttagggcttcaaaatggaaagaacaacattgaaatgagtaaaaatcgtgctaagtatccttttcctcatgtggcgctctctatatatagaggatacttac

SEQ ID NO: 460354 - DNA, 591 bp, Homo sapiens
agcaattttgcatgcatagaacacgtctatctatgaatatgcctaatgaggtacacaaagactcttattatccaaacagagacattccactggtgctagacagccacagatggaagttttctctgcctcctggaaatgaagacaaacttttttctttcttcagccatgaggattgctgtcctcctcttcgccattttcttctttatgagccaaaacttgtaaaggggagcgggctactcacctccagccttttgtcatccaggggcaaattcaaggagatctgtgaacgtccaaatggctcctgtcgggacttttgccttgaaacagaaatccatgttgggagatgtttaaatagccaaccctgctgcctgcctctggggcatcaaccaagaattgagagcactacacccaaaaaggactgaagcctgttgttttctggaggttttatgttctcttttttctctctccctctctctgtctccctgtctccctttccctctctccatttttctcacagggatttttattgaatcctcaaaaaagaataaaccaaaaccaaccagcacaaaactcttttaaaagtttatatta

SEQ ID NO: 460355 - DNA, 1839 bp, Homo sapiens
tttctgacacaaagttcagatatggcttctaaacatcctggtatttactacaaatatgcagaagttaccttagcccttcctgaagaagacaggaaaatatggaacagtttggaacttcctagagatttgttaaatggctttgaacaagttgctgataatgacacgggcaatgaaatccaggctgaagtagtttcagatggagatgaggaacttgttgggaactggagcaaaggtgacccttttctatgttttcataaaaaaactggcagcatttttgcccctgccatagaggctgtgggtgcacagaggctctccactgaagcactgcctagtggagctgtgagaagagggccactgtcctctagactccagaatggtagatccaccaacagtttgcaccatgcaactggaaaagatgcagacactcaaacccagcccttgaaagcatctgggagctgtaccctgcaggtcacaggggcagagctgcccaagatcatgggaatccacttcttgcatcagcatgacctggatgactctaccctccacacctcagcacagtgctccctggctaccccagctgtggctgatgcagctccaggtggggctcatgccacagttccagaaggctaaatgtttgccctgctgggttttggacttgcttggagctttttactcttattttgattctctctcccttttggaatgggaatgtctgtcctatacctgtaacaccattttatcttgaaagtggataacttgcctcaatttcggaggtttacaagtaagactctggaatttggacttttgagctgatgctgatgctgaaatgagtttttggggctatgaggatggaaaaaaacgtatatgtatttaaagttgtgagaaagacataagttttggagatccaagggcagaacactatgacgtgaaagtttgttccctctgaaattcatgttgcatgaactttgtccccagtgtggcagtatcgagaggtaaggccttcaagaggtaattggatcacggccctcaggagggaatttatcaattaatggattaatggattaatgaattgtcatgggagagatattagtggtttcaaaagcagagaaagagagacctgagctagcacactcctccccttcaccatgcgatgcccttcactaccttgcgactctacagcgagtcaccaccagcaatgagacgctcatcagatatggatcctcaaccttgaaatgctcatctccatactgctttgaaataatcattaaaactatacatttaacaagatcggagtcatatggtgcgcatctgccagcacagcaataatacaagaggacatcaccaagggaatgagcctagaccaagaaaggtactacaaactgggtctgaagcactgtgaacagggtggaagaagagcaaaacataaaacctgtttcagagaatgagtgacaagttttgttgggtcaaatacagcgactgctcatgtataacctttattgattccatgtttgtatccctccaaaatttatatgttcaagttctaacccccagtatgatgacattaggaggtggggcttttgaaagcaaattgaatactgcttgtgtttgactgttttaaaaagggaaggaaaaaaggagagggagggaagaaagttaatgaaagggaagaaaaaatgaagagaaaatgggaagggaaaggaatggaagggaagggaggggaagggaaagggaggaaactggagggaaggggagggaaggggagggaagaggagggaaggggagggaagaggagggaaggggaagggaagggagaaggggagggaagggaaggggaggggg

SEQ ID NO: 460356 - DNA, 1994 bp, Homo sapiens
tttctgacacaaagttcagatatggcttctaaacatcctggtatttactacaaatatgcagaagttaccttagcccttcctgaagaagacaggaaaatatggaacagtttggaacttcctagagatttgttaaatggctttgaacaagttgctgataatgacacgggcaatgaaatccaggctgaagtagtttcagatggagatgaggaacttgttgggaactggagcaaaggtgacccttttctatgttttcataaaaaaactggcagcatttttgcccctgccatagaggctgtgggtgcacagaggctctccactgaagcactgcctagtggagctgtgagaagagggccactgtcctctagactccagaatggtagatccaccaacagtttgcaccatgcaactggaaaagatgcagacactcaaacccagcccttgaaagcatctgggagctgtaccctgcaggtcacaggggcagagctgcccaagatcatgggaatccacttcttgcatcagcatgacctggatgactctaccctccacacctcagcacagtgctccctggctaccccagctgtggctgatgcagctccaggtggggctcatgccacagttccagaaggctaaatgtttgccctgctgggttttggacttgcttggagctttttactcttattttgattctctctcccttttggaatgggaatgtctgtcctatacctgtaacaccattttatcttgaaagtggataacttgcctcaatttcggaggtttacaagtaagactctggaatttggacttttgagctgatgctgatgctgaaatgagtttttggggctatgaggatggaaaaaaacgtatatgtatttaaagttgtgagaaagacataagttttggagatccaagggcagaacactatgacgtgaaagtttgttccctctgaaattcatgttgcatgaactttgtccccagtgtggcagtatcgagaggtaaggccttcaagaggtaattggatcacggccctcaggagggaatttatcaattaatggattaatggattaatgaattgtcatgggagagatattagtggtttcaaaagcagagaaagagagacctgagctagcacactcctccccttcaccatgcgatgcccttcactaccttgcgactctacagcgagtcaccaccagcaatgagacgctcatcagatatggatcctcaaccttgaaatgctcatctccatactgctttgaaataatcattaaaactatacatttaacaagatcggagtcatatggtgcgcatctgccagcacagattgccacctttggacagatgaaaatactgaggcagagaaaagttaagtaagttccccaaagagaaatacacagctaagaagtgttagtttaacctgaccatgtggcagaaagccagatatgcaaagaaaaacatgggggaatggatcaagaatgcaataatacaagaggacatcaccaagggaatgagcctagaccaagaaaggtactacaaactgggtctgaagcactgtgaacagggtggaagaagagcaaaacataaaacctgtttcagagaatgagtgacaagttttgttgggtcaaatacagcgactgctcatgtataacctttattgattccatgtttgtatccctccaaaatttatatgttcaagttctaacccccagtatgatgacattaggaggtggggcttttgaaagcaaattgaatactgcttgtgtttgactgttttaaaaagggaaggaaaaaaggagagggagggaagaaagttaatgaaagggaagaaaaaatgaagagaaaatgggaagggaaaggaatggaagggaagggaggggaagggaaagggaggaaactggagggaaggggagggaaggggagggaagaggagggaaggggagggaagaggagggaaggggaagggaagggagaaggggagggaagggaaggggaggggg

SEQ ID NO: 460357 - DNA, 1559 bp, Homo sapiens
tttctgacacaaagttcagatatggcttctaaacatcctggtatttactacaaatatgcagaagttaccttagcccttcctgaagaagacaggaaaatatggaacagtttggaacttcctagagatttgttaaatggctttgaacaagttgctgataatgacacgggcaatgaaatccaggctgaagtagtttcagatggagatgaggaacttgttgggaactggagcaaaggtgacccttttctatgttttcataaaaaaactggcagcatttttgcccctgccatagaggctgtgggtgcacagaggctctccactgaagcactgcctagtggagctgtgagaagagggccactgtcctctagactccagaatggtagatccaccaacagtttgcaccatgcaactggaaaagatgcagacactcaaacccagcccttgaaagcatctgggagctgtaccctgcaggtcacaggggcagagctgcccaagatcatgggaatccacttcttgcatcagcatgacctggatgactctaccctccacacctcagcacagtgctccctggctaccccagctgtggctgatgcagctccaggtggggctcatgccacagttccagaaggctaaatgtttgccctgctgggttttggacttgcttggagctttttactcttattttgattctctctcccttttggaatgggaatgtctgtcctatacctgtaacaccattttatcttgaaagtggataacttgcctcaatttcggaggtttacaagtaagactctggaatttggacttttgagctgatgctgatgctgaaatgagtttttggggctatgaggatggaaaaaaacgtatatgtatttaaagttgtgagaaagacataagttttggagatccaagggcagaacactatgacgtgaaagtttgttccctctgaaattcatgttgcatgaactttgtccccagtgtggcagtatcgagaggtaaggccttcaagaggtaattggatcacggccctcaggagggaatttatcaattaatggattaatggattaatgaattgtcatgggagagatattagtggtttcaaaagcagagaaagagagacctgagctagcacactcctccccttcaccatgcgatgcccttcactaccttgcgactctacagcgagtcaccaccagcaatgagacgctcatcagatatggatcctcaaccttgaaatgctcatctccatactgctttgaaataatcattaaaactatacatttaacaagatcggagtcatatggtgcgcatctgccagcacagattgccacctttggacagatgaaaatactgaggcagagaaaagttaagtaagttccccaaagagaaatacacagctaagaagtgttagtttaacctgaccatgtggcagaaagccagatatgcaaagaaaaacatgggggaatggatcaagaatggtaaattgacatattattataaaagaatttaaatgaaaatttaagatgttttgtgtcaaataaatgaatgagagtcatcgtagg

SEQ ID NO: 460358 - DNA, 1257 bp, Homo sapiens
cttcaatcggtctcccttgcgggagctgccgaacttgtttagagactcctagactccatgtggcttcttctgcctgcatcatggcctggaaaccgtccacatgatagcctaaatcaatcataggactcaccagattcagtgagtacatgtgcaggttcattatcagcatgtattgcatgatgctgagatttggagtacaaatgatctcatcacccagggtcttgctctgtcacccagcctggagtgcaatggcgtgatccgctcacagcgacctctgcctcctgggttcaggcaattctcctgcctcagcctcttgagtacctaggattacaggcgcacaccaccacgaccgaaaagtgacctggaaggaacaggcgtaaacatggaggatccagttgggctttgcatttgcatccgggtggtcgcattttaaagaactgaaccgatgccaaatacagacagcaatttttatgggagagacaaacagagagaagaaaaggaaaaccaaaagacaataaaaagacgggatacatcagaggataaaaggagctcatttcctgtagaggaacaaactcctttcctgtcttcctgtctcactcccccaaccaggacagctcctctatctacagcaggccctaagtcacacctccattgacctaataaaaactggttcctatcacttctctctccatttgactgcctcccaacccctcacgggaaggggaccacacatgtgaccgggcgcaggggccgggatgaatgcttctgggtgccagcaagagcagaactctgtgcagccctgcagcagcatctggagggtacccttgacccctggacccccagaggtgaagcctggggttcctatgggtacaggatgggggcatggtgggggtcaggatggttttggaaaaggcaacattcgagcaggaaaacaggaatgcatgttcttgctttgggccactggtccaggcttgagggtggacattaacataatggatgctgacagaaaacacaagattcctgggtcagagacaaaggactttgttactcacaacacagtgtgtctgttcattacctcacccacacttaattcccatggatatgaagcaatgtgggcccaagaggagactgtgcacacagtgggattgaggagaggaggttcctcacagatgaggaacactatgcttggagaacccactccttttgcacaaaaggaaagccatttcattgtctgcagagagatgtgacctgaagtct

SEQ ID NO: 460359 - DNA, 714 bp, Homo sapiens
  misc_feature (683)..(684): n is a, c, g, or t
cttcaatcggtctcccttgcgggagctgccgaacttgtttagagactcctagactccatgtggcttcttctgcctgcatcatggcctggaaaccgtccacatgatagcctaaatcaatcataggactcaccagattcagtgagtacatgtgcaggttcattatcagcatgtattgcatgatgctgagatttggagtacaaatgatctcatcacccagggtcttgctctgtcacccagcctggagtgcaatggcgtgatccgctcacagcgacctctgcctcctgggttcaggcaattctcctgcctcagcctcttgagtacctaggattacaggcgcacaccaccacgaccgaaaagtgacctggaaggaacaggcgtaaacatggaggatccagttgggctttgcatttgcatccgggtggtcgcattttaaagaactgaaccgatgccaaatacagacagcaatttttatgggagagacaaacagagagaagaaaaggaaaaccaaaagacaataaaaagacgggatacatcagaggataaaaggagctcatttcctgtagaggaacaaactcctttcctgtcttcctgtctcactcccccaaccaggacagctcctctatctacagcaggccctaagtcacacctccattgacctaataaaaagtgatgcggcagcgtgnnttccttcctgcccatcccaacacaaagccg

SEQ ID NO: 460360 - DNA, 1984 bp, Homo sapiens
  misc_feature (3)..(3): n is a, c, g, or t
  misc_feature (7)..(7): n is a, c, g, or t
  misc_feature (11)..(11): n is a, c, g, or t
  misc_feature (14)..(14): n is a, c, g, or t
ttncatnccgncangactttgtcctggaaaggcaggacacctgaatagccactacctgagtacctctcctgtgaggaaaccagggtgacccgggaaaccatggttctttgctttccgatcctggtgcattttataaaaaggggtgcggaagtgtgccaacatgctgctgttcctgccagcaaatctaagagactgttgacactgttgcactgggctgtccaaagaaatgtttgtgatcatgcacctgccactggagttgggaaatgctgtgacccacgtgccatgctcaaagaaccaggaggatgtgtgctaaagaaatgtgcagaggtcaatagtcagctaaaaaaggagaatgaggagataattccaggcagatggaagagtgacagcaaggcccctgagaaaggagggtgcaggacatatctatggagtagaaaaaagaccagtgtggcccagagcactgatgaggattcttttagcaaaaagcattccattcacaatacatatccatttactactcagccttctgtggtcaatggagcctctacagcttatgaaattgcaaagactgagaaaacccccaaacttaatgataattgttgaatcagaggagtcttaatttcaggagatcccaagtctccccaaaccacctgcccatgaaaaataaaatctagggatttccagttgttttattagggggttaaaacaccatgggcaagtattgggaaaaaccagtaactaccagaactatctaatgatcaacgtgagttgtaaaagacatgtatttaggcacccaatgctttgagaaaccttatcattttgaaacattcccctttaactcttgtaatgcttcctattttaataactacttttaaataacattagtgtagttatgcctgatttttttagttagtttgcattgtacaccttttctattcaattactctcagtaatttttgttctaacaattaagatttatcccttttaagataatatagttttaatggtctaatattttttcttttaattaaaatgccattggcctaaactcattcagtcgttaagtattcatgaaatccattatacccttaagcaaataaaaaatctgttaacctacacttcagtctgcctcaggcatattcggagtctcatgggggtatctgtgaagaagacgagcacaagaaagcctaagttcagtacacacagtaggactgaatcagaattcttatggtcacaaaagcctcttctgagggtaagaaatcagcaaaaactccaaatcagcaaaggaaacagacttaaaatacatgctcatttccaaaaggtctgactccattcttctttttgccaatttttagatcccatataatcttggatagaaaaatgatctatactgcatcagaatcatggaacctattggcaaagggcattctgtcccttcaattgtagcttcaacctcattgtctaataaataataactaccactttttgagggatcaatgtatatcaggcaattttctgagaggacttaaggctgcaccatttcattcagacattataatagcgattcaacattgctagctccattagcaaggtactattattttactgaagccccttaactccagtacatccagtatacgacagagccagaaccttaatcaaagtccatttgttgacaccagattctaactataacctttacaatatgttaactttaactgtgcttattccgattgcttattttataccatcccatggttccttgattttattctagatcccatctagaattgaagccaggcaaaaagttgctcctatttgttgaagttatagtttgttcatttaataccttcatactaatccttccacttatgcatattaaaaccctaaaaagtgcagctccaaaaagtgcctagtaacaagaacaactattttctaatattctgcaatatgaatgatgtccccttgagttgtgcagcaactc

SEQ ID NO: 460361 - DNA, 992 bp, Homo sapiens
agggggacgggggaacctttcccatttcaacaccaccgctgtggctgcatgtggctgccataagaaaaagaacccattctttggcacagctgaagcaggactcttctcgttgttctccagggctccagccctccccctccttacacagtggggatgtcagcaccacagcctccctttgcttctgtgcctgggaggaaggaagatgcctgctcttgttcttacccctgcctctccctccatctctgggttcctgtacctcccatcatagtactgttttgttttgtttgtgtcataatagacaccaccctgatctcatttaatcacctaaaggaaatccttaagcaatgcaggtgtcacagatttactttaaggcttcaagggtaaagaaagggactgaaacaagaagagtaaatacaataaaaatcttgataatagggtataactgtgtctcctttgttagagggcagggtgagcggggggagcgggaggaaagttttaggctattagcaaatcgggtatcagtttcagactgtgaggtcccgctccagccaatggatgcaggacacagcagtaaggacgacccaaatgctctctctctctctctctcactctcactctttcttcctgtctttattttgcaacagaatctgagcctggacatcaagaataaagagatctgtttaacagccatgagggagtgcacggatgcatggagagccaggaatggtccacagcaatcaatgctgcaggaatgaatttgtttaaatggattttttttccatttcatgaataactttgttcaagcctttgatggacaatgtttctcaaaacctgaggaaacaagatagctttgcaatgctttaaacaaacgttatttcctttggtgctttaccagttaattaatgtagttgttctaaatgggagggttgatctactgtaaactgacccatcaccacaaaacttatgttttctgagaactgtaattttctaaa

SEQ ID NO: 460362 - DNA, 1928 bp, Homo sapiens
ttttttccaactaacatttcctctgggaaatgatgagaactgtgtccagggtactggccccttatctcacttgggcttatgctaaagatgtaaaatgtggtatagatgcccaagccttaatgcttcaaggtgcagaacttttagccgatgctgtagccattacaatggggtcaaagggaagagcagtgattattcaacagagctgtggagatcccaaagtaacaaaagatggtgtgactgttgaaaaatctattgacttaaaggatgaatataacagtattggagttaaacttgttcaagatgttgccaataacacgagtgaagaggctggggatgacactaccactgtactgttctggcatgctctattgccaaggatggcttcaagaagattatccattgtacctgctcttgaagttgccaatgctcaccataaaactttggtcataattgttgaagatattgatggagaagctctaagtacattcgttttgaataggctaaaagttggtcttcacattatagcagtcaaagctccaggatttgatgaacaattgaaagaaccagcttaaagatttggctattgctactggtggtgcagtgtttggagatgagggcttggccctaaatcttgaatatgtgcagcctcgtgacttagcttttctcagtcctctgagctcaagctaagccaccatatcccctgtgacctgcacatacacatccagatggccggttcctgccttaactgatgacattccaccacaaaaaaagaaatgaaaatggcctgttcctgccttaactgatggcattatcttgtgaggcatctcaccaatttcaaatccgatcttctcggcttagcggctgaagactgacactgcccgatcgcctcagaagccccctagaccatcacggatgccgagctttagtataagaagacaggaatgtcaggcctctgagcccaagctaagccatcatatcccctgtgacctgcacatacacatccacatggccggttcctgccttaactgatgacattccaccacaaaagaagtgaaaatggcctgttcctgccttaactgttgacattatcttgtgaaattccttctcctagctcatcctggctcaaaagctcccctactgagcaccttgtgacccctactcctgcccgccagagaacaacccccctttttcctttacctacccaaatcctataaaacagccccacccttatctcccttcactgactttcttttcggactcagcccacctgcacccaggtgaaataaacagctttattgctcacacaaagcctgtttggtggtctcttcacacggacatgcatgaaagctttccatatttgtgttccaaagaatcacattcagagactctcttattaccataagaaatagataagcgcatgtattttttttttctaaactctgatatagtcttcttttcaggccagtcataagtttgccttgtttaatggactcattcaaacatagtagttacatctacttagttttatgcatttttgtatttaaatatttttatatatgctatcaattttctttaaataagtaatgctttcatttaatttgcttactaaggttattttttaacaagattaaattaacaaaacgcttttatcttgtcaacatttctaacaaatttctttagttcacttaagtcaattttaacaattctaggggctaattttatttaaaatgattatttaacatgagtgtttaatttcagtgttaaatctacatgtaaagtgttgaattcacaggaaacaaaacatattccttggtgtcaaagatcatataatctagtatttaaggattcaagtattcaaatagataattattaaaagtaaaaatttatcgaagctttgaatgttgtgctatggagctaacaaatggaac

SEQ ID NO: 460363 - DNA, 1041 bp, Homo sapiens
gtcaccggcctctctggcaataggctgcgagctcagctccctgaagcggcggcgaaggcggcggcggcggcggcggcggcggcagcagcgcggctcggtctctggtccattcactccacgctttctgcagccgccactgcagccgcgcggcgggggctccctccttgcagccagccggcggtccagcctggtgcctctgcaaaggaaaggggagcgtggagacgtgttcgaggtggtatcggcgaggatctctcgggcgccgctcactccttggtcgccttgcttgccagcagttgctcccttagtccttggctcgctcgcacaccccctcccgctacagggagcagttttgggtggcgtgggctccgtcctcttcttggctggtaggaacggtgtgcccaagaggggaagcctagtgggcctggcccctcccagccccgcgccaatgagtgccagggcgccgaaggagctgaggctggcgttgccgccgtgtctcctcaaccggacctttgcttcccccaacgccagcggcagcggcaacacgggtgcccgcggcccaggcgcagtaggcagcggcacctgcatcacgcaggtgggacagcagctcttccagtccttctcctccacgctggtgctgattgtcctggttaccctcatcttctgcctcatcgtgctgtccctctccactttccacatccacaagcgtaggatgaagaagcggaagatgcagagggctcaggaggaatatgagcgggatcactgcagcggcagccgcggtggcggggggctgccccgacctggcaggcaggccccaacccacgcaaaggaaacccggctggagaggcagccccgggactctcccttctgcgccccttccaacgcctcgtcgttgtcctcttcgtcccctggcctcccgtgccagggtccctgtgctcctccgcctccaccgccagcctccagtccccaaggagcacacgcagcttcctcctgtttggacacagctggcgagggccttttgcaaacggtggtactgtcctgatc

SEQ ID NO: 460364 - DNA, 1077 bp, Homo sapiens
gggtgacacagaccacatgcgtcatggcagagccctcatcttgaattgtgactgggttcaagtgctcactattcacttgtcaaccaatgcttgttgaactcttggccggcgtggggtagggcacacccctgccttctgcctctcgggaagccattcattcattttcaagtacttgtggaacatccggtggtcattttaaggagtgggttagaggcatttagaccacaatctccatcagtcttgccgtccaaactcgccctcaaataaaaacacaatgtgcaaccttggcaggctcgggtctcctgccacctcctctgagaagccccaccacccatggtctggggcgtgtcccccgtcgctgggataccttgctcacccagctgagcctgccactcttctgttgaatctgttaagcaggaaacatccctccaccctccccagcccccctcctgcgtcccactcattccctaaccaccccgactggatgacgaagggcgcagagcagcgcgagggtttcgggccattcatctctgctctgcacgcggcgtccaaggggcccattttaccctccctcatctacaccagagagaaagacttacagtcagcagagctttgtgcaaacgtaggaaaaacctgcttgtcctgtgtgagcgtttcagagacctaccaaaaggtctttaattcagcaagttgctaacatgtctgtggctcagttttctcctctgcacagagtttttctggggctcgtgtgtctacaacaatagagtacgcgctccatgcttgttggctgttatttgtattagcatcattgtttttatggtgcaattacaggttcaattatttaagatacttatgcccacaccaaagtatattaaaagcaaataaaaggcctgatggctcatgtcgctcccatcctgggtgaaggtgttttctagattaagggaagacatttgcttggggtctgcaggctccttgcaaggggttaccagataaaatacagtgacaagcttacatttaaaaattgtaattatttatctgaaattcaaatttaaccagatgtcttatattttatttgct

SEQ ID NO: 460365 - DNA, 1754 bp, Homo sapiens
ctgcagctgtgtgtctttgagcaagctgcctaccctctctgtgccttatcaggagagggtgactctgtgccgactttacaaggctatgggaaggacacaatgaactaagacctaatcaccacgggatgatgtcagagcgtggggcttctgggaggtgatgagctgtcatgagtgggattggtgcccccagaaagccgccctgcccctcttcctgggagaagccaccatctatgaaccaggaaacgggccctcgtcccatgtgacaccaaatctgccagcatcttggtcttggacatccagcctccagaactgtgagcaataaagttctattgtttgtgagccacccagtccaaatagactaaaacaaggtggggacaggggtgatgggcataccgcagaccctggtggtgacagtgttacaaggagtagtgaaggtgtcacagggagtcacaactgacatcaggcctctctcaggaggcgccattagcagaggcctatatcagggaggctgaaggtctcaggaaagggtgttcccagaagaggttacagccaggccgggtgtggtggctcatgcctgtaatcctagcactttgggaggccgaggcaggtggatcacttgaggtcaggagttcaagaccagcctggctaacatggcaaaaccctgtctccactcaaaatacaaaaattaggcatggtggtatgcgcctgtagtcccagctactcaggaggcaggagaatcgcttgaacctgaaagaaaggtggccacagctctgcactccagcctgcgggagtgagactttgtctcaaaaaaaaaaaaaaaaaaaggttatagccagtgcaaaggtcctgaggcaggcccatgatcaggggccccaaagaacagcaaagaagaggctcatgaggctggatgcccccaaaccctatcccacccccatctctccagaccctaagctacgacccatgcccacgggacacaagcctccaccacgccactctgatgacaggaacacccttacagcagctcagtcatgaggcccccacaggccctgcaggcaccacatactccgcagcaaattgtttgttgagtgacttaatgaagaccacaaatcatcaaacaccagaaacagccacaggcagcagcccccagacagagcctgtggccaaaaccaaactcatattcagaataagccagtgtctggttatctgctcagcaaaagaactccccatcacgcaagccttcgacggcgaccacccctccatacttcgaaaaagcatcccctggccaaaatctgccgacaggccgcttcctggagcccgtctgctgagcagagctttgacggtgggaaagatcggtgaagaccccccagaatatgattcaccgcaggccacaggggccaggacggtcaacagaaactacatgtgtggggcccaggggggaggtgggggccagaactctgaggaccagatccagacccacagccgcagctacgcttcagcatccggctccagctggaagagacccccactcacttcctccccacacactgctgcttcctggccaggcacagatacgagtggagcagggtgggggcaggagaaagagacagcaccgtgagccagacacgtctggctatctgcacctcctcaatcccgggccccagggctccgtgacctgggcagcctcagtttcctcatctgaaaagccacttagatatcaaatggttctattgatgtatgccacacaatggaattcc

SEQ ID NO: 460366 - DNA, 631 bp, Homo sapiens
cttgggatgcttggtgggtaccccagtggcagtcagagaaaaagcatgagaacttttcctggttttccaaatcatccccaaaatgcagggcctccttcaccagagaggccccatttatggggaggggacaggctgaggccccgtggaagacactgagtcaggcacaactgtctcctaagtgcctgctacatacccagtgctggggacacagcggtgacaaagatgaacaaaatcctggatggaggggtgctggagtgtgaatgtttatgtccccccaaaatctgcatgttgagacctaatcaccacgggatgatgtcagagcgtggggcttctgggaggtgatgagctgtcatgagtgggattggtgcccccagaaagccgccctgcccctcttcctgggagaagccaccatctatgaaccaggaaacgggccctcgtcccatgtgacaccaaatctgccagcatcttggtcttggacatccagcctccagaactgtgagcaataaagttctattgtttgtgagccacccagtccaaatagactaaaacaaggtggggacaggggtgatgggcataccgcagaccctggtggtgacagtgttacaaggagtagtgaaggtgtcacagggag

SEQ ID NO: 460367 - DNA, 2709 bp, Homo sapiens
agctttacacatgcagctccatctgggtgaacacttctctgcaacatgcctaacattcctatttcctatggcctggatttcaaggattctcaaccagaggcagttcatttagccagttttgagtgggtgaccgtccccccttccctgttcattgtgaatttccgcccaacgtgtgtcgccgccaggtccctgttcctcctacccgcctcggctcacggggcgcaggctgtggctctgcacctgcccgggcacctccaccggcggctcacagcccattcgggacttcctgtcggacaacgcacaccagaggcgattcggtcctcgccttcccgctcttcaccttcggttgcacaccggtctacggcgacctctgtgacaatttgccgccccgtccctcgtcctgagcctcaacgaaattgggcagccgcgagcggaggccagggccgcctggcgtgcttggtgcgaacgcggcgggcccagcgcgagagctggggaatcccgggatgagccaagcgccgcgagcccgctgctgcctcagcagttccgggtctgggcggtccgcggataagagaaatggtgcttcctggggaactggttatgatggaaggagaggtcccttttatcttcattgttgctcatttgttaatctcacatacttttgttgggtctttccaaaatattaaacatagatttttaaagaaacaacaatttccacactatttcattggtttatacaatattaagttacgaaagcacaatatcaagcacaactggcaaaaacaggtttgcaaacaaacacaaagggggaggaaataaaagaccttgccccttgcctctctgaatgagacaagcaggtaggttataactggatttcaccaaaggtctatataacttctgtcccagaggtagaaatcttttcgaaacagttgcctggacatcctttaaagcttggatttgagctgcagaccaaccccttaatgtctacactccaaaacaagagatgttttggtagtccagtactgtctatacattcagcaaagcccctcctttggtagaaacctagaagcagtgtggataatgtatgaatgttgcctattattatcttggataaggaggtaaggaacagtacaaaccctctgttttctttctttttcagtgccctgaaactctaatctcattgcctggccagaaaaggaagtaatccctagtgtcagcagattcagcggtactggtgtataatagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggtgtgcaaaattacttagtaaaactattttttctattactccttttttgcaagtacatacattaaatgataaatttattgtgaagttaataaaatgcccatagctgttctattaccttcagaaactattttcataattgaaaaaaacttggaataagtacatgtgttatataacaacgaccctagatgctcaaatgcataaaggaaacatccacaaatcccctgtagatttataaaactatatggtcaaataaaatcacagtgaacaattaatccatttgttgtagaaaatgtaattcacaaaaatgttaaagacttagcttctatgccaatggatccagaccaattcaaatcaatttagtacacttaatggtgttatgcaagcaatataaattaataactgaaccttaagcatcttactatttctcttactgttctttgaagacgatagaagacacaaacttaaaatattgatcatttcttgctagagaattaaaaagtgtcttttacactgttgttcggcagttgccaccataactaccactttcctttttgtcttattttcatttggtttttagttctgtgtcaaatgtaaggtttctttgagtaacagttctttatttttgtatacgtatagaagtaatattctaatgctatttatcaaaactaaattttgatttggctagttttcttaaattatagaaacactgaaaaattggatttatattgatcatccttttttgacttctatatttcaaatgttgtcaacatacaggaagacattacaaacttaaaggataaaattataactgtaaaagaatctatcattgaaaaaacttgttttcttgaggaagaaaaaaagacacatgaaaaattaagaaaagaaatagagtaattcaaaagtcatttgacactttaaaatcaaagcaataatggattttgggttttatagcatgtagagtaagatatatatcaagaatagccttttgttgtaaggttcttatatttttacatgtactgatatgttaattgaagacagattgtgataagttaagagaatatattaaaa

SEQ ID NO: 460368 - DNA, 3208 bp, Homo sapiens
tcattctgaattcctcttagttcttgagctgtgattacgtttatttcaatggactgtttaaaaagccctcccctaaaagtcacttgcaaatcttcaaattcaaaattgtaaacatcagtgaagagttgatcaataaaagctttcattaatgtcttcctgtgcctgggtacaattaccttaatgctgctcagatttttttcatcaattttctgtttaatggtatacaaagtggcagccatgctgggacagctaacaatctcaaattcttccaagagagctgataatccattgcttgtttctatttcacaattatcttgttctccatccctttcatagctgatgttactgcaacacattatacagagaaacttggccttggcagcatggtggtattggacagcattcaaagtcttcagtaatgtctgatggcagtttttttgagagttcaatttcaaaccaaaaagatcaatcaaaacagcttctgccatccttgaaagaatacttttatgccaaataaatcacctcacctacctcgccgcggccgcacagattccccgcctgataccgtcccaggatcccaggggaaacctgacggccaggttccctcgtgccagctgccgggaggcgggagggagaggccagggccgcctggcgtgcttggtgcgaacgcggcgggcccagcgcgagagctggggaatcccgggatgagccaagcgccgcgagcccgctgctgcctcagcagttccgggtctgggcggtccgcggataagagaaatggtgcttcctggggaactggttatgatggaaggagaggtcccttttatcttcattgttgctcatttgttaatctcacatacttttgttgggtctttccaaaatattaaacatagatttttaaagaaacaacaatttccacactatttcattggtttatacaatattaagttacgaaagcacaatatcaagcacaactggcaaaaacaggtttgcaaacaaacacaaagggggaggaaataaaagaccttgccccttgcctctctgaatgagacaagcaggtaggttataactggatttcaccaaaggtctatataacttctgtcccagaggtagaaatcttttcgaaacagttgcctggacatcctttaaagcttggatttgagctgcagaccaaccccttaatgtctacactccaaaacaagagatgttttggtagtccagtactgtctatacattcagcaaagcccctcctttggtagaaacctagaagcagtgtggataatgtatgaatgttgcctattattatcttggataaggaggtaaggaacagtacaaaccctctgttttctttctttttcagtgccctgaaactctaatctcattgcctggccagaaaaggaagtaatccctagtgtcagcagattcagcggtactggtgtataatagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggtgtgcaaaattacttagtaaaactattttttctattactccttttttgcaagtacatacattaaatgataaatttattgtgaagttaataaaatgcccatagctgttctattaccttcagaaactattttcataattgaaaaaaacttggaataagtacatgtgttatataacaacgaccctagatgctcaaatgcataaaggaaacatccacaaatcccctgtagatttataaaactatatggtcaaataaaatcacagtgaacaattaatccatttgttgtagaaaatgtaattcacaaaaatgttaaagacttagcttctatgccaatggatccagaccaattcaaatcaatttagtacacttaatggtgttatgcaagcaatataaattaataactgaaccttaagcatcttactatttctcttactgttctttgaagacgatagaagacacaaacttaaaatattgatcatttcttgctagagaattaaaaagtgtcttttacactgttgttcggcagttgccaccataactaccactttcctttttgtcttattttcatttggtttttagttctgtgtcaaatgtaaggtttctttgagtaacagttctttatttttgtatacgtatagaagtaatattctaatgctatttatcaaaactaaattttgatttggctagttttcttaaattatagaaacactgaaaaattggatttatattgatcatccttttttgacttctatatttcaaatgttgtcaacatacaggaagacattacaaacttaaaggataaaattataactgtaaaagaatctatcattgaaaaaacttgttttcttgaggaagaaaaaaagacacatgaaaaattaagaaaagaaatagaggtacaacataagaggtatgatgcaattcttaagcgtttgcattgtcaggtgaacaagcttcagtcaaatagacgacagtggcaatggaacattcaacaattggaaaaaactgcagccgaattaagaaaatgcattggaatgcaagagtaacattgccatagggcaatgtggaacacagaccatgacaacaaaaattactggacagaacattaagaaaatcttttggattcttaataacaagcatccactattagagacctgtcttaatgacagatgtcttcggttgttgttttttttaaatcagtcatcgatttgttaaaatgccttctaaccctacacttgatagcagtagacagacaataggaatgtctacgggaaaataatgcaagagtctctgtgactatttggagtgtgtaaaatgtattatactcatgaatacctgtttatgttgcattcactaccctatgaagtaaaa

SEQ ID NO: 460369 - DNA, 2434 bp, Homo sapiens
tcattctgaattcctcttagttcttgagctgtgattacgtttatttcaatggactgtttaaaaagccctcccctaaaagtcacttgcaaatcttcaaattcaaaattgtaaacatcagtgaagagttgatcaataaaagctttcattaatgtcttcctgtgcctgggtacaattaccttaatgctgctcagatttttttcatcaattttctgtttaatggtatacaaagtggcagccatgctgggacagctaacaatctcaaattcttccaagagagctgataatccattgcttgtttctatttcacaattatcttgttctccatccctttcatagctgatgttactgcaacacattatacagagaaacttggccttggcagcatggtggtattggacagcattcaaagtcttcagtaatgtctgatggcagtttttttgagagttcaatttcaaaccaaaaagatcaatcaaaacagcttctgccatccttgaaagaatacttttatgccaaataaatcacctcacctacctcgccgcggccgcacagattccccgcctgataccgtcccaggatcccaggggaaacctgacggccaggttccctcgtgccagctgccgggaggcgggagggagaggccagggccgcctggcgtgcttggtgcgaacgcggcgggcccagcgcgagagctggggaatcccgggatgagccaagcgccgcgagcccgctgctgcctcagcagttccgggtctgggcggtccgcggataagagaaatggtgcttcctggggaactggttatgatggaaggagaggtcccttttatcttcattgttgctcatttgttaatctcacatacttttgttgggtctttccaaaatattaaacatagatttttaaagaaacaacaatttccacactatttcattggtttatacaatattaagttacgaaagcacaatatcaagcacaactggcaaaaacaggtttgcaaacaaacacaaagggggaggaaataaaagaccttgccccttgcctctctgaatgagacaagcaggtaggttataactggatttcaccaaaggtctatataacttctgtcccagaggtagaaatcttttcgaaacagttgcctggacatcctttaaagcttggatttgagctgcagaccaaccccttaatgtctacactccaaaacaagagatgttttggtagtccagtactgtctatacattcagcaaagcccctcctttggtagaaacctagaagcagtgtggataatgtatgaatgttgcctattattatcttggataaggaggtaaggaacagtacaaaccctctgttttctttctttttcagtgccctgaaactctaatctcattgcctggccagaaaaggaagtaatccctagtgtcagcagattcagcggtactggtgtataatagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggaagacattacaaacttaaaggataaaattataactgtaaaagaatctatcattgaaaaaacttgttttcttgaggaagaaaaaaagacacatgaaaaattaagaaaagaaatagaggtacaacataagaggtatgatgcaattcttaagcgtttgcattgtcaggtgaacaagcttcagtcaaatagacgacagtggcaatggaacattcaacaattggaaaaaactgcagccgaattaagaaaatgcattggaatgcaagagtaacattgccatagggcaatgtggaacacagaccatgacaacaaaaattactggacagaacattaagaaaatcttttggattcttaataacaagcatccactattagagacctgtcttaatgacagatgtcttcggttgttgttttttttaaatcagtcatcgatttgttaaaatgccttctaaccctacacttgatagcagtagacagacaataggaatgtctacgggaaaataatgcaagagtctctgtgactatttggagtgtgtaaaatgtattatactcatgaatacctgtttatgttgcattcactaccctatgaagtaaaa

SEQ ID NO: 460370 - DNA, 2645 bp, Homo sapiens
tcattctgaattcctcttagttcttgagctgtgattacgtttatttcaatggactgtttaaaaagccctcccctaaaagtcacttgcaaatcttcaaattcaaaattgtaaacatcagtgaagagttgatcaataaaagctttcattaatgtcttcctgtgcctgggtacaattaccttaatgctgctcagatttttttcatcaattttctgtttaatggtatacaaagtggcagccatgctgggacagctaacaatctcaaattcttccaagagagctgataatccattgcttgtttctatttcacaattatcttgttctccatccctttcatagctgatgttactgcaacacattatacagagaaacttggccttggcagcatggtggtattggacagcattcaaagtcttcagtaatgtctgatggcagtttttttgagagttcaatttcaaaccaaaaagatcaatcaaaacagcttctgccatccttgaaagaatacttttatgccaaataaatcacctcacctacctcgccgcggccgcacagattccccgcctgataccgtcccaggatcccaggggaaacctgacggccaggttccctcgtgccagctgccgggaggcgggagggagtgccctgaaactctaatctcattgcctggccagaaaaggaagtaatccctagtgtcagcagattcagcggtactggtgtataataggatcaccaatatacaacaggaaaaaacaaaagtgaaagattatcaatatagattattgagtaggagtaaagaaggtaaatcaaaaaggggaaaagagattacagacacagaaaatgtcagacaacaaagaaaggaagagtcaaggatttcctaaagaagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggtgtgcaaaattacttagtaaaactattttttctattactccttttttgcaagtacatacattaaatgataaatttattgtgaagttaataaaatgcccatagctgttctattaccttcagaaactattttcataattgaaaaaaacttggaataagtacatgtgttatataacaacgaccctagatgctcaaatgcataaaggaaacatccacaaatcccctgtagatttataaaactatatggtcaaataaaatcacagtgaacaattaatccatttgttgtagaaaatgtaattcacaaaaatgttaaagacttagcttctatgccaatggatccagaccaattcaaatcaatttagtacacttaatggtgttatgcaagcaatataaattaataactgaaccttaagcatcttactatttctcttactgttctttgaagacgatagaagacacaaacttaaaatattgatcatttcttgctagagaattaaaaagtgtcttttacactgttgttcggcagttgccaccataactaccactttcctttttgtcttattttcatttggtttttagttctgtgtcaaatgtaaggtttctttgagtaacagttctttatttttgtatacgtatagaagtaatattctaatgctatttatcaaaactaaattttgatttggctagttttcttaaattatagaaacactgaaaaattggatttatattgatcatccttttttgacttctatatttcaaatgttgtcaacatacaggaagacattacaaacttaaaggataaaattataactgtaaaagaatctatcattgaaaaaacttgttttcttgaggaagaaaaaaagacacatgaaaaattaagaaaagaaatagaggtacaacataagaggtatgatgcaattcttaagcgtttgcattgtcaggtgaacaagcttcagtcaaatagacgacagtggcaatggaacattcaacaattggaaaaaactgcagccgaattaagaaaatgcattggaatgcaagagtaacattgccatagggcaatgtggaacacagaccatgacaacaaaaattactggacagaacattaagaaaatcttttggattcttaataacaagcatccactattagagacctgtcttaatgacagatgtcttcggttgttgttttttttaaatcagtcatcgatttgttaaaatgccttctaaccctacacttgatagcagtagacagacaataggaatgtctacgggaaaataatgcaagagtctctgtgactatttggagtgtgtaaaatgtattatactcatgaatacctgtttatgttgcattcactaccctatgaagtaaaa

SEQ ID NO: 460371 - DNA, 2350 bp, Homo sapiens
aagtagtctggcaggataattgtgttaaaattgatagcaaattagaatagatggaagcagttacatttagctgggacaaacatatacagtgtttagcaaaggcatatcaacctgaaaatacagacctacaatgaaaatgcatcaactctaattgctatagagttgttatggtagcactataattatagtatatgtgcaagtggtctggataaaaaaaattaggacaatcaaaatatttatactgttccgtagaggaacgggtatgacattgcagtaggcaactttgaattgcctattattgttgcctttacttttggttttgtttatatcagcaagggaaaattactaattctaaatttagtttagaaggaaaaaatatcaaatatttcatgattttgagtaaagaaacataactttcttaaaatggctgtattttaatttttattatatactttattcttttgtctaattgtagataaccaagacacaagttcattagctgatgctgtagagaaagttgcaaagcaacaacaatcacaagcatcagagatagaaaaaaacaaaaaggttctgttcaatttgaagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggtgtgcaaaattacttagtaaaactattttttctattactccttttttgcaagtacatacattaaatgataaatttattgtgaagttaataaaatgcccatagctgttctattaccttcagaaactattttcataattgaaaaaaacttggaataagtacatgtgttatataacaacgaccctagatgctcaaatgcataaaggaaacatccacaaatcccctgtagatttataaaactatatggtcaaataaaatcacagtgaacaattaatccatttgttgtagaaaatgtaattcacaaaaatgttaaagacttagcttctatgccaatggatccagaccaattcaaatcaatttagtacacttaatggtgttatgcaagcaatataaattaataactgaaccttaagcatcttactatttctcttactgttctttgaagacgatagaagacacaaacttaaaatattgatcatttcttgctagagaattaaaaagtgtcttttacactgttgttcggcagttgccaccataactaccactttcctttttgtcttattttcatttggtttttagttctgtgtcaaatgtaaggtttctttgagtaacagttctttatttttgtatacgtatagaagtaatattctaatgctatttatcaaaactaaattttgatttggctagttttcttaaattatagaaacactgaaaaattggatttatattgatcatccttttttgacttctatatttcaaatgttgtcaacatacaggaagacattacaaacttaaaggataaaattataactgtaaaagaatctatcattgaaaaaacttgttttcttgaggaagaaaaaaagacacatgaaaaattaagaaaagaaatagaggtacaacataagaggtatgatgcaattcttaagcgtttgcattgtcaggtgaacaagcttcagtcaaatagacgacagtggcaatggaacattcaacaattggaaaaaactgcagccgaattaagaaaatgcattggaatgcaagagtaacattgccatagggcaatgtggaacacagaccatgacaacaaaaattactggacagaacattaagaaaatcttttggattcttaataacaagcatccactattagagacctgtcttaatgacagatgtcttcggttgttgttttttttaaatcagtcatcgatttgttaaaatgccttctaaccctacacttgatagcagtagacagacaataggaatgtctacgggaaaataatgcaagagtctctgtgactatttggagtgtgtaaaatgtattatactcatgaatacctgtttatgttgcattcactaccctatgaagtaaaa

SEQ ID NO: 460372 - DNA, 888 bp, Homo sapiens
tcattctgaattcctcttagttcttgagctgtgattacgtttatttcaatggactgtttaaaaagccctcccctaaaagtcacttgcaaatcttcaaattcaaaattgtaaacatcagtgaagagttgatcaataaaagctttcattaatgtcttcctgtgcctgggtacaattaccttaatgctgctcagatttttttcatcaattttctgtttaatggtatacaaagtggcagccatgctgggacagctaacaatctcaaattcttccaagagagctgataatccattgcttgtttctatttcacaattatcttgttctccatccctttcatagctgatgttactgcaacacattatacagagaaacttggccttggcagcatggtggtattggacagcattcaaagtcttcagtaatgtctgatggcagtttttttgagagttcaatttcaaaccaaaaagatcaatcaaaacagcttctgccatccttgaaagaatacttttatgccaaataaatcacctcacctacctcgccgcggccgcacagattccccgcctgataccgtcccaggatcccaggggaaacctgacggccaggttccctcgtgccagctgccgggaggcgggagggagaggccagggccgcctggcgtgcttggtgcgaacgcggcgggcccagcgcgagagctggggaatcccgggatgagccaagcgccgcgagcccgctgctgcctcagcagttccgggtctgggcggtccgcggagtcggcatcccgcagccccggcggcgttagaggaacaggaaccagagccgcgcgagggctctcgcccgggagccaggcgggttagcgggcaggactgcaggtctccagagggcacggggcgg

SEQ ID NO: 460373 - DNA, 804 bp, Homo sapiens
tcattctgaattcctcttagttcttgagctgtgattacgtttatttcaatggactgtttaaaaagccctcccctaaaagtcacttgcaaatcttcaaattcaaaattgtaaacatcagtgaagagttgatcaataaaagctttcattaatgtcttcctgtgcctgggtacaattaccttaatgctgctcagatttttttcatcaattttctgtttaatggtatacaaagtggcagccatgctgggacagctaacaatctcaaattcttccaagagagctgataatccattgcttgtttctatttcacaattatcttgttctccatccctttcatagctgatgttactgcaacacattatacagagaaacttggccttggcagcatggtggtattggacagcattcaaagtcttcagtaatgtctgatggcagtttttttgagagttcaatttcaaaccaaaaagatcaatcaaaacagcttctgccatccttgaaagaatacttttatgccaaataaatcacctcacctacctcgccgcggccgcacagattccccgcctgataccgtcccaggatcccaggggaaacctgacggccaggttccctcgtgccagctgccgggaggcgggagggagtgccctgaaactctaatctcattgcctggccagaaaaggaagtaatccctagtgtcagcagattcagcggtactggtgtataataggtatacagtttatttttaattattcaattaattctttttggatgtctctgatgatgttctaacttctcttaaaaacatgtttg

SEQ ID NO: 460374 - DNA, 207 bp, Homo sapiens
gcccgctgctgcctcagcagttccgggtctgggcggtccgcggagtcggcatcccgcagccccggcggcgttagaggaacaggaaccagagccgcgcgagggctctcgcccgggagccaggcgggttagcgggcaggagtgggcaggccgagtccggaaagggtcgcgaggaggcagctaggggccccttgaggagggatagggcgg

SEQ ID NO: 460375 - DNA, 1132 bp, Homo sapiens
ctccacacaactacagtcgcgcctaattcccgctagccgacccacgacgcgtctgtgccctgaaactctaatctcattgcctggccagaaaaggaagtaatccctagtgtcagcagattcagcggtactggtgtataatagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggaagacattacaaacttaaaggataaaattataactgtaaaagaatctatcattgaaaaaacttgttttcttgaggaagaaaaaaagacacatgaaaaattaagaaaagaaatagaggtacaacataagaggtatgatgcaattcttaagcgtttgcattgtcaggtgaacaagcttcagtcaaatagacgacagtggcaatggaacattcaacaattggaaaaaactgcagccgaattaagaaaatgcattggaatgcaagagtaacattgccatagggcaatgtggaacacagaccatgacaacaaaaattactggacagaacattaagaaaatcttttggattcttaataacaagcatccactattagagacctgtcttaatgacagatgtcttcggttgttgttttttttaaatcagtcatcgatttgttaaaatgccttctaaccctacacttgatagcagtagacagacaataggaatgtctacgggaaaataatgcaagagtctctgtgactatttggagtgtgtaaaatgtattatactcatgaatacctgtttatgttgcattcactaccctatgaagtaaaa

SEQ ID NO: 460376 - DNA, 3327 bp, Homo sapiens
tcattctgaattcctcttagttcttgagctgtgattacgtttatttcaatggactgtttaaaaagccctcccctaaaagtcacttgcaaatcttcaaattcaaaattgtaaacatcagtgaagagttgatcaataaaagctttcattaatgtcttcctgtgcctgggtacaattaccttaatgctgctcagatttttttcatcaattttctgtttaatggtatacaaagtggcagccatgctgggacagctaacaatctcaaattcttccaagagagctgataatccattgcttgtttctatttcacaattatcttgttctccatccctttcatagctgatgttactgcaacacattatacagagaaacttggccttggcagcatggtggtattggacagcattcaaagtcttcagtaatgtctgatggcagtttttttgagagttcaatttcaaaccaaaaagatcaatcaaaacagcttctgccatccttgaaagaatacttttatgccaaataaatcacccgcctcggctcacggggcgcaggctgtggctctgcacctgcccgggcacctccaccggcggctcacagcccattcgggacttcctgtcggacaacgcacaccagaggcgattcggtcctcgccttcccgctcttcaccttcggttgcacaccggtctacggcgacctctgtgacaatttgccgccccgtccctcgtcctgagcctcaacgaaattgggcagccgcgagcggaggccagggccgcctggcgtgcttggtgcgaacgcggcgggcccagcgcgagagctggggaatcccgggatgagccaagcgccgcgagcccgctgctgcctcagcagttccgggtctgggcggtccgcggataagagaaatggtgcttcctggggaactggttatgatggaaggagaggtcccttttatcttcattgttgctcatttgttaatctcacatacttttgttgggtctttccaaaatattaaacatagatttttaaagaaacaacaatttccacactatttcattggtttatacaatattaagttacgaaagcacaatatcaagcacaactggcaaaaacaggtttgcaaacaaacacaaagggggaggaaataaaagaccttgccccttgcctctctgaatgagacaagcaggtaggttataactggatttcaccaaaggtctatataacttctgtcccagaggtagaaatcttttcgaaacagttgcctggacatcctttaaagcttggatttgagctgcagaccaaccccttaatgtctacactccaaaacaagagatgttttggtagtccagtactgtctatacattcagcaaagcccctcctttggtagaaacctagaagcagtgtggataatgtatgaatgttgcctattattatcttggataaggaggtaaggaacagtacaaaccctctgttttctttctttttcagtgccctgaaactctaatctcattgcctggccagaaaaggaagtaatccctagtgtcagcagattcagcggtactggtgtataatagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggtgtgcaaaattacttagtaaaactattttttctattactccttttttgcaagtacatacattaaatgataaatttattgtgaagttaataaaatgcccatagctgttctattaccttcagaaactattttcataattgaaaaaaacttggaataagtacatgtgttatataacaacgaccctagatgctcaaatgcataaaggaaacatccacaaatcccctgtagatttataaaactatatggtcaaataaaatcacagtgaacaattaatccatttgttgtagaaaatgtaattcacaaaaatgttaaagacttagcttctatgccaatggatccagaccaattcaaatcaatttagtacacttaatggtgttatgcaagcaatataaattaataactgaaccttaagcatcttactatttctcttactgttctttgaagacgatagaagacacaaacttaaaatattgatcatttcttgctagagaattaaaaagtgtcttttacactgttgttcggcagttgccaccataactaccactttcctttttgtcttattttcatttggtttttagttctgtgtcaaatgtaaggtttctttgagtaacagttctttatttttgtatacgtatagaagtaatattctaatgctatttatcaaaactaaattttgatttggctagttttcttaaattatagaaacactgaaaaattggatttatattgatcatccttttttgacttctatatttcaaatgttgtcaacatacaggaagacattacaaacttaaaggataaaattataactgtaaaagaatctatcattgaaaaaacttgttttcttgaggaagaaaaaaagacacatgaaaaattaagaaaagaaatagaggtacaacataagaggtatgatgcaattcttaagcgtttgcattgtcaggtgaacaagcttcagtcaaatagacgacagtggcaatggaacattcaacaattggaaaaaactgcagccgaattaagaaaatgcattggaatgcaagagtaacattgccatagggcaatgtggaacacagaccatgacaacaaaaattactggacagaacattaagaaaatcttttggattcttaataacaagcatccactattagagacctgtcttaatgacagatgtcttcggttgttgttttttttaaatcagtcatcgatttgttaaaatgccttctaaccctacacttgatagcagtagacagacaataggaatgtctacgggaaaataatgcaagagtctctgtgactatttggagtgtgtaaaatgtattatactcatgaatacctgtttatgttgcattcactaccctatgaagtaaaa

SEQ ID NO: 460377 - DNA, 2755 bp, Homo sapiens
tcattctgaattcctcttagttcttgagctgtgattacgtttatttcaatggactgtttaaaaagccctcccctaaaagtcacttgcaaatcttcaaattcaaaattgtaaacatcagtgaagagttgatcaataaaagctttcattaatgtcttcctgtgcctgggtacaattaccttaatgctgctcagatttttttcatcaattttctgtttaatggtatacaaagtggcagccatgctgggacagctaacaatctcaaattcttccaagagagctgataatccattgcttgtttctatttcacaattatcttgttctccatccctttcatagctgatgttactgcaacacattatacagagaaacttggccttggcagcatggtggtattggacagcattcaaagtcttcagtaatgtctgatggcagtttttttgagagttcaatttcaaaccaaaaagatcaatcaaaacagcttctgccatccttgaaagaatacttttatgccaaataaatcacctcacctacctcgccgcggccgcacagattccccgcctgataccgtcccaggatcccaggggaaacctgacggccaggttccctcgtgccagctgccgggaggcgggagggagtgccctgaaactctaatctcattgcctggccagaaaaggaagtaatccctagtgtcagcagattcagcggtactggtgtataataggatcaccaatatacaacaggaaaaaacaaaagtgaaagattatcaatatagattattgagtaggagtaaagaaggtaaatcaaaaaggggaaaagagattacagacacagaaaatgtcagacaacaaagaaaggaagagtcaaggatttcctaaagaagataaccaagacacaagttcattagctgatgctgtagagaaagttgcaaagcaacaacaatcacaagcatcagagatagaaaaaaacaaaaaggttctgttcaatttgaagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggtgtgcaaaattacttagtaaaactattttttctattactccttttttgcaagtacatacattaaatgataaatttattgtgaagttaataaaatgcccatagctgttctattaccttcagaaactattttcataattgaaaaaaacttggaataagtacatgtgttatataacaacgaccctagatgctcaaatgcataaaggaaacatccacaaatcccctgtagatttataaaactatatggtcaaataaaatcacagtgaacaattaatccatttgttgtagaaaatgtaattcacaaaaatgttaaagacttagcttctatgccaatggatccagaccaattcaaatcaatttagtacacttaatggtgttatgcaagcaatataaattaataactgaaccttaagcatcttactatttctcttactgttctttgaagacgatagaagacacaaacttaaaatattgatcatttcttgctagagaattaaaaagtgtcttttacactgttgttcggcagttgccaccataactaccactttcctttttgtcttattttcatttggtttttagttctgtgtcaaatgtaaggtttctttgagtaacagttctttatttttgtatacgtatagaagtaatattctaatgctatttatcaaaactaaattttgatttggctagttttcttaaattatagaaacactgaaaaattggatttatattgatcatccttttttgacttctatatttcaaatgttgtcaacatacaggaagacattacaaacttaaaggataaaattataactgtaaaagaatctatcattgaaaaaacttgttttcttgaggaagaaaaaaagacacatgaaaaattaagaaaagaaatagaggtacaacataagaggtatgatgcaattcttaagcgtttgcattgtcaggtgaacaagcttcagtcaaatagacgacagtggcaatggaacattcaacaattggaaaaaactgcagccgaattaagaaaatgcattggaatgcaagagtaacattgccatagggcaatgtggaacacagaccatgacaacaaaaattactggacagaacattaagaaaatcttttggattcttaataacaagcatccactattagagacctgtcttaatgacagatgtcttcggttgttgttttttttaaatcagtcatcgatttgttaaaatgccttctaaccctacacttgatagcagtagacagacaataggaatgtctacgggaaaataatgcaagagtctctgtgactatttggagtgtgtaaaatgtattatactcatgaatacctgtttatgttgcattcactaccctatgaagtaaaa

SEQ ID NO: 460378 - DNA, 696 bp, Homo sapiens
caagcccctataaaagccaagagaataaacacaatgtttgtagtagaaagtcagtcccaagaatcaaaatacaatcactacacaatctcttgcaatgcttacaaactgcaccttttgatcaactgttgctaggttttttgttgactttatgcggaaagtggttaaatgtaaggttgtaaacatgtcgtctaaatctgtaaagataattcccaagctatgcttttattaaaaaaaaaatcctcaaaacaaaaatgtaaacaaaaaatagtgaaggtcatagcccaaggcatacccatctgtatcatcatagataacgtgtccaggagagacagcacaaggggctccatcttcatcacacaactcatcgcatgcttccagagatattcctggcgctgccacctagaggaagtattttggaaggttcagcaagcatttgaaagtccggaggcaacagtccaaatgcccaccatagaacgagtgtccatgacaagatatttctacctctttcctggcaactgaaaatggttaagcattgagagttgttggtggtgtatgaaataaatgaaagtgtgatattggaggaaaccacaagcagcccagccctcctttatcaacttcaagaaacacctttactagtacagattgaatgcttaacattttgtatttcaataaaggtgaagacaaatgaactgtgtc

SEQ ID NO: 460379 - DNA, 2567 bp, Homo sapiens
tcagtctgagccttttttcagtgctgtaagaaaggacggaggctgttatctatggcagatctatccaataaaggagagaaaggaccgcatacgcctggttctcatcatatgcaataaagagtttgaccatctgcctccaagaaatggggctgactttgccatcatggagatgaagaagctgcttgaggatctgggttacagtgtggatgtagaagagaatctgacagccaggcaaaccatggggaacagtgggtcagagactgtccagcatctttgggagtcatgtcttcacagtcacctaagaacctggaggatgcagtttgcaagacataccagagaaggacttcattgttttctgctcttcaacctcatgtatacgtcttttggtggtattaagtgatttgtgggcctgaggctacctttgaatgattctaccaaatcaagaatccctaagaaacaatgatccgagggaatgttgtgtgctctcccatattttacatgatcttagatgtgatgtgaaaacagattccttccccctcccacacccacgtttttaaaaattgtacttttcttataagtgttacaatttaaagccaaaggcataccaaatattaaagcaacacaacataaggaatcccattcaccacacaccatttaaacacaaatgatggattctgttatttatcaaacccatttaatgttttgtgtagtgttttcatggattccaggaatggcttccctttctcaaatgatcaatttcaagtcttattctccatatttcccatctgattccactatgagcagtgccattgcatgccctactagaactgtggataccctttaaaacaagtagaagatgatagggtgggactcattacgtctaatcttggggaacactgcccaaggcatacccatctgtatcatcatagataacgtgtccaggagagacagcacaaggggctccatcttcatcacacaactcatcgcatgcttccagagatattcctggcgctgccacctagaggaagtattttggaagatgagaaaccatccaacggtgttctggtccacatggtgaagttgctgatcaagacctttctagatggcatttttgatgatttgatggaaaataatgtattaaatacagatgagatacaccttataggaaaatgtctaaagtttgtggtgagcaatgctgaaaacctggttgatgatatcactgagacagctcaaactgcaggcaaaatatttagggaacacctgtggaattccaaaaaacagctgagttcagcttttctggaaatccagggtgcccaacccagtggcaagttaaagctttgtcctcatgctcacttccatgaactaaagacaaaaagggcagatgaggtgatatgctttgaaatacggagacacaagattactcattcagacaagacactggggacttactggaatgatatatccagtgatggagaaagagaggcgaacatgcctggcctcaacatccgcaacaaagaattcaactatcttcataatcgaaatggttctgaacttgaccttttggggatgcgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcagcctgggcttggtgcaggacataggatgcacaattaaagcagcaaatttgactcacaaagtagaatcagagaataagaaagtacacaaggagtatgcgttgtcagactttaatgtgaatgaaagatcaggtgaagaacatctctaaaggctttctttaccattttaggttcaacattcatttgagaccccaaatatactgacccagctgcccaccattgaaagactatccatgacacgatatttctatctctttcctgggaattaaaactcataagaagcaactcaggaaaatgaaggcattatggtgtctatgaatctgctattagaaaaggtcaatttttgattaagaatatttttataccaaactgctcagctgtccaccttttcaaataccaggctaaaatcaatctcatatttttgctaaattaatgcttaataaatttttattataaaattgtgcttgttttctaattttgtcataaattaagtcatgcttataggagaaaaaattaagtattaaaaatcataaaaaatgaagaaataatcatcatcaacctttttaaaactattcataaaaactcaagttttttatatagcttatttattttgtatatccaattttgtgtgcttttattatattgttataacattactactagtaataaaactatcctaaatataacttttaagtttataatattc

SEQ ID NO: 460380 - DNA, 742 bp, Homo sapiens
aatggggaatattggattctgatgtatgcagaaagtaaagtcattggaaatgtgatgtatagccaatgtttgtctctcttcacccaaaagtcagtttttgtgagtcatgttctcctctctttgtgatgaggctttcctgtaccatatgtcccactagctgctaaatctatgctgaggcaatgagaccctagtacaggtcttcccatttggggatgacagatccgtagcccttttgtaaaagtatttctcacagtagacattagttatatttacatcttaccgataatagccagattactcatgttcttttcttctactttctctaggaaaatgaaggcattatggtgtctatgaatctgctattagaaaaggtcaatttttgattaagaatatttttataccaaactgctcagctgtccaccttttcaaataccaggctaaaatcaatctcatatttttgctaaattaatgcttaataaatttttattataaaattgtgcttgttttctaattttgtcataaattaagtcatgcttataggagaaaaaattaagtattaaaaatcataaaaaatgaagaaataatcatcatcaacctttttaaaactattcataaaaactcaagttttttatatagcttatttattttgtatatccaattttgtgtgcttttattatattgttataacattactactagtaataaaactatcctaaatataacttttaagtttataatattc

SEQ ID NO: 460381 - DNA, 435 bp, Homo sapiens
aggtagtgtacaacgttgagaagacagaatacccatgggcttggtcctatgaaacctgcaaactctcttcattccaggactttcctggttcatggtggaagatgctttctgagacttgaaaagagtcgtatctcatctatagcctactttctttttcaggttcagcaagcatttgaaagtccggaggcaacagtccaaatgcccaccatagaacgagtgtccatgacaagatatttctacctctttcctggcaactgaaaatggttaagcattgagagttgttggtggtgtatgaaataaatgaaagtgtgatattggaggaaaccacaagcagcccagccctcctttatcaacttcaagaaacacctttactagtacagattgaatgcttaacattttgtatttcaataaaggtgaagacaaatgaactgtgtc

SEQ ID NO: 460382 - DNA, 758 bp, Homo sapiens
tcagtctgagccttttttcagtgctgtaagaaaggacggaggctgttatctatggcagatctatccaataaaggagagaaaggaccgcatacgcctggttctcatcatatgcaataaagagtttgaccatctgcctccaagaaatggggctgactttgccatcatggagatgaagaagctgcttgaggatctgggttacagtgtggatgtagaagagaatctgacagccaggcaaaccatggggaacagtgggtcagagactgtccagcatctttgggagtcatgtcttcacagtcacctaagaacctggaggatgcagtttgcaagacataccagagaaggacttcattgttttctgctcttcaacctcatataacgtgtccaggagagacagcacaaggggctccatcttcatcacacaactcatcgcatgcttccagagatattcctggcgctgccacctagaggaagtattttggaaggttcagcaagcatttgaaagtccggaggcaacagtccaaatgcccaccatagaacgagtgtccatgacaagatatttctacctctttcctggcaactgaaaatggttaagcattgagagttgttggtggtgtatgaaataaatgaaagtgtgatattggaggaaaccacaagcagcccagccctcctttatcaacttcaagaaacacctttactagtacagattgaatgcttaacattttgtatttcaataaaggtgaagacaaatgaactgtgtc

SEQ ID NO: 460383 - DNA, 618 bp, Homo sapiens
tcagtctgagccttttttcagtgctgtaagaaaggacggaggctgttatctatggcagatctatccaataaaggagagaaaggaccgcatacgcctggttctcatcatatgcaataaagagtttgaccatctgcctccaagaaatggggctgactttgccatcatggagatgaagaagctgcttgaggatctgggttacagtgtggatgtagaagagaatctgacagccaggataacgtgtccaggagagacagcacaaggggctccatcttcatcacacaactcatcgcatgcttccagagatattcctggcgctgccacctagaggaagtattttggaaggttcagcaagcatttgaaagtccggaggcaacagtccaaatgcccaccatagaacgagtgtccatgacaagatatttctacctctttcctggcaactgaaaatggttaagcattgagagttgttggtggtgtatgaaataaatgaaagtgtgatattggaggaaaccacaagcagcccagccctcctttatcaacttcaagaaacacctttactagtacagattgaatgcttaacattttgtatttcaataaaggtgaagacaaatgaactgtgtc

SEQ ID NO: 460384 - DNA, 642 bp, Homo sapiens
tcagtctgagccttttttcagtgctgtaagaaaggacggaggctgttatctatggcagatctatccaataaaggagagaaaggaccgcatacgcctggttctcatcatatgcaataaagagtttgaccatctgcctccaagaaatggggctgactttgccatcatggagatgaagaagctgcttgaggatctgggttacagtgtggatgtagaagagaatctgacagccaggaatatgaagtcattgctgtgggcatttgctgcctgaccagagcacaagtcctccgacagcacgttcttggtgctcatgtctcatggcatcctggggggaatgtgtggaactgaacatgatgaggcaaacccagatgggctgctttccttcaggccaaagctgaaggaacacttgaagccaggattttgagaccaattgattcatagctcttgggagctatttttcaaatgaaagagaaaacagaaataatttttctaaaaactggtaactacaagatgatttcattatcactaggcacactgttgaatgacacttgagagaaaacaaagtggtatgtatgtgtgtgtgtgtgtgtgtttgtgtgtgtgtgtctgtgtgtttgtatgtgtatgggtctatgtgtatgaaac

SEQ ID NO: 460385 - DNA, 1322 bp, Homo sapiens
  misc_feature (266)..(266): n is a, c, g, or t
  misc_feature (268)..(268): n is a, c, g, or t
  misc_feature (271)..(271): n is a, c, g, or t
agggtctttgcagatgatcaagttaagatgaggtgatcaggatgggccctaatccaatgtggctatgtcctaataaaaaggagcaattggatacatatacactcccagggagagcacggtgtgaagatgaggcagagatcagggtgatgcacccactcatcaaggaatgccaaagattgccagaaaaccaccagaagctaagacatagcatggaacagactttccctcacagcaccttgatcttggacttccagcctcaaaaaccntnagncagattgtgacaagtgctgcaaagaaatacaggacagtaggaacatggacaacagaattccttccatagaatcttactcattgttgatttcttctcttaagccggagctcggcttcaggagtacttttcaaaatatcatgtattttgctaactctatataactccatgtgtcatttcatccagaaaacttgtttctaatgcttttttctctggactctaagctggttgatgccaccaggccttgggaaaaagcctgccttctgataggattgctattgagtagcaaaaattcttggattctgataacatctttcatgcagaaactcaaagcatctcccaaattataagcccattcttttacactgttctacactctcacactctaggaacaactcatttcaatcttgggacattgaccagaattcagggaaactagcatgatccttccagtctgacgtttcattccatctactgtccaaagctgtgtctacaaggcatcacctatgagacaataaaacaaaccctctgaaatcaggaaatttgccagaagatggcgagctgggaagaaataaaaccaggatttgagccagaacttggcttcaagctgacctcaccccacctgcaagtcttaatacacttggacatgccatgaaatgacaagaaatattcagattttagatatgtaaaaatattaaaactatgcctcttagaatctgtgaagtatggtatatgtaacccttttttgtgctaaatgttataacatgagaatttactactatcttttaaattatgatgtttaaaggctctacaatagtcaatttaacttatttaagcaaacctctattattgaacatttagaacctttccaactttttgctgttataaataaagaaatattgtcagaccttgtaataagcaagatttctatctctagtatatttatgggccaagtctttctgatcacaggaggtttgtgtaggaaattaaaactatttttaatattcatcctttcagcaagcatccactgggctcacactatttataaggtgca

SEQ ID NO: 460386 - DNA, 409 bp, Homo sapiens
tcatccagatctctggtgagctaccaagctctaggaacaactcatttcaatcttgggacattgaccagaattcagggaaactagcatgatccttccagtctgacgtttcattccatctactgtccaaagctgtgtctacaaggcatcacctatgagacaataaaacaaaccctctgaaatcaggaaatttgccagaagatggcgagctgggaagaaataaaaccaggatttgagccagagacagggtttctctatgttgcccaggcttgtgttgaactcctggcctcaagtgatcttcccacctcagcttctcaaagtgctggaattacaggcataagccaccatgcctggctgcatgaaatcttctgaggtattattttgagaacataaataaagaattccacaatca

SEQ ID NO: 460387 - DNA, 1580 bp, Homo sapiens
tttcactatgttggccaggctggtctcaatcccctgacttcaggcaatccacctgcctcagcctcccaaagtgctgggattacaggtgtgagccaccgcgcccggtcaacaagcatgtttttaaaggcaaatttcttcctcagtcgtgtggcaggccctgagcaggcagctgggtgtccccgctcagatccaggcccgagtgggctgggcggctgcagagccagtcacctgagctacccagggtgggatccctggccccgacctctgtcctgacacgccccaagcggcagcaacaaagccccaattggcctgggcctgggcaggaggagctgggccgggtgccagatactgggatcagccactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccgtgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggccgggcgcggtggctcacctctgtaatcccagcacttttagaggccgaggcaggcggatcacctgaaatcaggagttccagaccagcctgggcaacatggtgaaaccccgtctctactaaaaatacaaaaattagccgggtatggtgccgggtgcctgtaatcccagctacttgagaggctgaggcaggagaatcgcttgaatctgggaggcggaggttgcattgagctgagatcgtgccattgcactccaggctgggcgacagagcaagactccatctcaatcgatcaatcaatcaatcaatcaacccctgcaaacaggtgggaggccacatgccccagaagaccgatgaccggggcccagcctgccctgcctaggagaatcaagggctgcacaaggcccaggtgacccttggctcccagaaggttgcactacccccaggccctcctccttgtataccgggatggcagcccaagctggtgtttgtggctttttttttttttttaaagctatcttgattttattttgttttgcccattactttgttttttctcgtgattttacttagtttgctcatatatggcttcatttatataacatgctagagagggcacact

SEQ ID NO: 460388 - DNA, 943 bp, Homo sapiens
tttcactatgttggccaggctggtctcaatcccctgacttcaggcaatccacctgcctcagcctcccaaagtgctgggattacaggtgtgagccaccgcgcccggtcaacaagcatgtttttaaaggcaaatttcttcctcagtcgtgtggcaggccctgagcaggcagctgggtgtccccgctcagatccaggcccgagtgggctgggcggctgcagagccagtcacctgagctacccagggtgggatccctggccccgacctctgtcctgacacgccccaagcggcagcaacaaagccccaattggcctgggcctgggcaggaggagctgggccgggtgccagatactgggatcagccactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggcaccaaggcctggatggagaccgaggacaccctgggccgtgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggccgggc

SEQ ID NO: 460389 - DNA, 865 bp, Homo sapiens
cccagaccacccaccccgggctgaagactcttcctgagtcgtgtggcaggccctgagcaggcagctgggtgtccccgctcagatccaggcccgagtgggctgggcggctgcagagccagtcacctgagctacccagggtgggatccctggccccgacctctgtcctgacacgccccaagcggcagcaacaaagccccaattggcctgggcctgggcaggaggagctgggccgggtgccagatactgggatcagccactgcagctccctgagcactctctacagagacgcggaccccagacatgaggaggctcctcctggtcaccagcctggtggttgtgctgctgtgggaggcaggtgcagtcccagcacccaaggtccctatcaagatgcaagtcaaacactggccctcagagcaggacccagagaaggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccgtgtcctgagtcccgagcccgaccatgacagcctgtaccaccctccgcctgaggaggaccagggcgaggagaggccccggttgtgggtgatgccaaatcaccaggtgctcctgggaccggaggaagaccaagaccacatctaccacccccagtagggctccaggggccatcactgcccccgccctgtcccaaggcccaggctgttgggactgggaccctccctaccctgccccagctagacaaataaaccccagcaggccgggc

SEQ ID NO: 460390 - DNA, 2765 bp, Homo sapiens
gaattggcgggagaataggtttggtggtccgagatccgaggcaacggtggctcctcgaggtccacggtcccggccggtgaactcgataccttgcaagcctgtagccccagctcacacgcctctgggcgtccgcctggatctgtctggtgaatggaactaggatggcctgtgagcccacagaacgtctagaaaagtcagctttacattgggaccaacagaaaattacagggaattatctacatcatccacaggcatcccatttacttaaaaataatcatttttattttgtgacacttaatacggagaatattgtaaatactgtacacccatcaccctaaattgactactggcattatgatttatttgcttattttttaaaagctagataatacaataaaagttaaacttacctgttttttctactctcaagcctattaccctctcatcctctccagaagcaactattatgaattagaattagcttgtgttctcccagtccatttttaataattatatagatgggatttcgccatgttgcccaggctgatcttgaactcctgggctgaagatatccaccctcctcggcctcccaatgtgctgggattacaggcctgagccaccatgcctggcccaagtgttcattgatgatgagagatgggcttttcgcatcaaatcacaaaaatatgctgagtaatgtgaggattcttgcttttctggaagctaacacatagtcagtgccaaagtagtgacagaagaaatcttgagaggaagcatttttgtcttgtacttgaaacagctgctgggcccaccatggctcctgtgaagatcagccatgtggtatcattttcttctcaggatcccaagtatcctgtagagaacttgctaaacccagatagtccaaggagaccttggctcggctgccctcaggacaagagtgggcaattgaaagtagaactacagctggagagggcagtgcccactggctacattgatgtgggtaactgtggctgtgcgttcctgcaaattgatgtgagccaccatgcctggccaagttctcatactatttctgtcacatctgcagttaatttcctccactgaagtcttgaaagcccactaggagggttggaatcaacttcttccaaattcacattcatgttgatgctgtgacctcctcccatgaatcaccagtattcttaatggcatccaagatggtaaattatttccagaaggttttaatttactttcctagatccatcagaggaatcgctatctatatggcaaatatagccttacagaatttatttcttaaatagcaatgcttgaaagttgaattactccttgatccttgggctgcaaaatggatgttacagtaggtacgcccaagaactagtacatactttttacctccacactttggcatctctgtgaagtccacttggagaccttcaaagggggctgctccataagctcgtatgccgggcggaacggctggaccttgcctcgcatcatgctggcggcaggtaacacaccgctgcctcaccgttttggcaagggctgacaaaggctcccctagatggcaaatgacctgctttcgttctgaccccgggctgtgttccgacccctgttggatagtaaatcccagggctatcgggatcacagggagtatacatacgatagacctcacacagtctctggtagaattgtgctggactttcttctttaccctgaatgacctcagagagcttgttaactggttggagtatgacgttactcacaatatagcactgagtgtgcatccacccgtgattttgctcctaatattcacagaagaagagaatgctattactcccaacatcacaggaagtgtacacccccgtgtgagatggtccttaaaaatattccaaggcggagggggtgatatgactacatatatggcagaaagtggacacccccaaggatatcgttcccatgatcctggagggaagaggataatattgctttcaatatcacagaaagtggacacgtccccaactgatatagtttctagttgcaacgtgggagaggacgacctgacacctggtatcccagggagtagaaatacccctgtgatactgttcctaatattcagagaggaagaggatgatattactcccaatacagacgggtgtacagcggtctgtgaaacagttcaaaatctccagagggggaggtgatattactcacaatatgttaaacaggctgtgagtccaccgcggatcctaagagccagggggggcaagaggggctggctcttactccccgcatcgtggggggctcctcgcccccctgcgatgggggtcttaagagccaggggggcaagaggggctggctcttactccccgcatcgcggggggcgcctcacccccctgcgatggggctcgtaatatccagtgggggagagggggtgatattactccgtttctcgtattatgttttctctactgctacacttggttaacaccctgggacattattttccatattctaggaatgtgtcactgtttgagtcccgggggtatacaccctgtgatattattcgtgataatgtggtgaaacgtgaatcctgatgtcacaagtgtctacacactctgatattattcgcaataccctagcgggacgttaataataatgtcacaatgtgtgtacagcttgtgccattattcttaatctcctaaggggaggttgatttttttgtcacacggagtagtttccctttggtatgattc

SEQ ID NO: 460391 - DNA, 2322 bp, Homo sapiens
gaattggcgggagaataggtttggtggtccgagatccgaggcaacggtggctcctcgaggtccacggtcccggagatgggatttcgccatgttgcccaggctgatcttgaactcctgggctgaagatatccaccctcctcggcctcccaatgtgctgggattacaggcctgagccaccatgcctggcccaagtgttcattgatgatgagagatgggcttttcgcatcaaatcacaaaaatatgctgagtaatgtgaggattcttgcttttctggaagctaacacatagtcagtgccaaagtagtgacagaagaaatcttgagaggaagcatttttgtcttgtacttgaaacagctgctgggcccaccatggctcctgtgaagatcagccatgtggtatcattttcttctcaggatcccaagtatcctgtagagaacttgctaaacccagatagtccaaggagaccttggctcggctgccctcaggacaagagtgggcaattgaaagtagaactacagctggagagggcagtgcccactggctacattgatgtgggtaactgtggctgtgcgttcctgcaaattgatgtgagccaccatgcctggccaagttctcatactatttctgtcacatctgcagttaatttcctccactgaagtcttgaaagcccactaggagggttggaatcaacttcttccaaattcacattcatgttgatgctgtgacctcctcccatgaatcaccagtattcttaatggcatccaagatggtaaattatttccagaaggttttaatttactttcctagatccatcagaggaatcgctatctatatggcaaatatagccttacagaatttatttcttaaatagcaatgcttgaaagttgaattactccttgatccttgggctgcaaaatggatgttacagtaggtacgcccaagaactagtacatactttttacctccacactttggcatctctgtgaagtccacttggagaccttcaaagggggctgctccataagctcgtatgccgggcggaacggctggaccttgcctcgcatcatgctggcggcaggtaacacaccgctgcctcaccgttttggcaagggctgacaaaggctcccctagatggcaaatgacctgctttcgttctgaccccgggctgtgttccgacccctgttggatagtaaatcccagggctatcgggatcacagggagtatacatacgatagacctcacacagtctctggtagaattgtgctggactttcttctttaccctgaatgacctcagagagcttgttaactggttggagtatgacgttactcacaatatagcactgagtgtgcatccacccgtgattttgctcctaatattcacagaagaagagaatgctattactcccaacatcacaggaagtgtacacccccgtgtgagatggtccttaaaaatattccaaggcggagggggtgatatgactacatatatggcagaaagtggacacccccaaggatatcgttcccatgatcctggagggaagaggataatattgctttcaatatcacagaaagtggacacgtccccaactgatatagtttctagttgcaacgtgggagaggacgacctgacacctggtatcccagggagtagaaatacccctgtgatactgttcctaatattcagagaggaagaggatgatattactcccaatacagacgggtgtacagcggtctgtgaaacagttcaaaatctccagagggggaggtgatattactcacaatatgttaaacaggctgtgagtccaccgcggatcctaagagccagggggggcaagaggggctggctcttactccccgcatcgtggggggctcctcgcccccctgcgatgggggtcttaagagccaggggggcaagaggggctggctcttactccccgcatcgcggggggcgcctcacccccctgcgatggggctcgtaatatccagtgggggagagggggtgatattactccgtttctcgtattatgttttctctactgctacacttggttaacaccctgggacattattttccatattctaggaatgtgtcactgtttgagtcccgggggtatacaccctgtgatattattcgtgataatgtggtgaaacgtgaatcctgatgtcacaagtgtctacacactctgatattattcgcaataccctagcgggacgttaataataatgtcacaatgtgtgtacagcttgtgccattattcttaatctcctaaggggaggttgatttttttgtcacacggagtagtttccctttggtatgattc

SEQ ID NO: 460392 - DNA, 371 bp, Homo sapiens
ttttctggaagctaacacatagtcagtgccaaagtagtgacagaagaaatcttgagaggaagcatttttgtcttgtacttgaaacagctgctgggcccaccatggctcctgtgaagatcagccatgtggtatcattttcttctcaggtatattaatcagcaggcatgatttgttttcttaataactgaaaggagtgaaaaaaataggagtcttggctccactttcaggaaactcccaatctaatagaagagacattgtgagttcagagtctaagagaagaaacagctcttgccctcaggttgttcccacagaagtgcaggatgcgcaaaagaagtcttctcagaagttgaaagtacagaaagcagcaccct

SEQ ID NO: 460393 - DNA, 304 bp, Homo sapiens
cccgagtagctgggattacagacacgcagcaccacacctggctaattttttgtattttagtagagatggggtttcaccatgttgaccaggctggtctcaaactcctggcctcaagtgatccacccgcctcagccatccaaagttctgggattacaggtgagccaccatgcctggccaagttctcatactatttctgtcacatctgcagttaatttcctccactgaagtcttgaaagcccactaggagggttggaatcaacttcttccaaattcacattcatgttgatgctgtgacctcctccca

SEQ ID NO: 460394 - DNA, 1494 bp, Homo sapiens
gaccgtcgtaaactagaattttcttgcggcttcttagctttacgatggcaacaagtatggcggctgctagtggtagatttgaaagtgcgaagagtatcgaagagcggaaagaacagacccggaatgccagggccgaggtgttgcgccaggctaaagccaattttgaaaaagaagaaaggcgtaaagaacttaagcgacttcggggtgaggatacatggatgctacctgatgtgaatgagagaattgaacagttctcacaggaacactctgtgaagaaaaagaagaaaaaagacaagcattcaaaaaaagcaaagaaagaaaagaaaaaaaagagcaagaaacagaaatatgaaaaaaacaatgagtcatctgatagctcatcaagctctgaagatgagtgggttgaggctgttccatcccagactcctgacaaggaaaaagcctggaaagtgaaagatgaaaagtcaggaaaagatgacacccaaattatcaagagggatgagtggatgactgttgattttatgtctgttaaaactgtgtcatcatcatcactcaaagctgaaaaggaaactatgaggaaaatagagcaagagaaaaaccaagcgcttgaacagtccaaactgatggaaagagaattgaatccgtactggaaggatggtgggacaggtcttccacctgaagactgtagtgtgtcatcgattactaaagaagctgaacttcttcaaatacaggaggagaagaggaaattcctagaaagcacagattcacttaacaatgaacttaaaaggttgtgcggtctgacagtagaagtggatatggagaaagttgcagctgagattgcacaggcagaggaacagaccggcaaaaagcaggaggaaagggagaaggaggcggcagagcaagccgagtgcagtcagggcagcatcattcctgaggaagaacaagcaccaaacaaaggtgaggagaagaaagacgaggagaacattccaatggagacagaggagacacaccttgaagaaacgacagagagtcaacagaatggtgaagaaggcacgtctactactgaggacaaggagaatgggcaggagggggttgacagtatggcagaggaaggaaccagtgatagtaacactggctcagagagcaacagcacaacagtggaagagccaccgacagatcccctaccagaagatgagaaaaaagaataagtgttgccatgttttatgtgttctaaatagttttttaaatgaaaaaaagttttttggttttttaaaaaaatacctgttaggctactcctcctcacttttggtgtccatttgtgtgaaatgcctttttccatccctttattttaagtttatgtaagtccttatgtgttaggtataccgattattcttaggtttggttgattaacataatcccagacttcttggagcctttgttcatattttcttagttttttgtctttgtcttagttggattgggttaatttgaaga

SEQ ID NO: 460395 - DNA, 2735 bp, Homo sapiens
  misc_feature (1)..(2): n is a, c, g, or t
  misc_feature (4)..(4): n is a, c, g, or t
  misc_feature (6)..(6): n is a, c, g, or t
  misc_feature (12)..(12): n is a, c, g, or t
  misc_feature (17)..(17): n is a, c, g, or t
nnancntttgcnttccnaggtgaagaccctgaaacaagaagaatgagaacagttaaaaacatagcagacttgaggcagaatttagaagagactatgtccagtcttcgtgggactcagataagccacagcaccctggagacaacatttgacagcactgtgacaacagaagttaatggaaggaccatacccaacttgacaagtcgacccacccccatgacctggaggttgggccaggcatgtccgcgacttcaggcgggagatgctccctccctgggtgctggctatcctcgcagtggtaccagtcgattcatccacacagacccctcgaggttcatgtataccacgcctctccgtcgagctgctgtctctaggctgggaaacatgtcacagattgacatgagtgagaaagcaagcagtgacctggacatgtcttctgaggtcgatgtgggtggatatatgagtgatggtgatatccttgggaaaagtctcaggactgatgacatcaacagtgggtacatgacagatggaggacttaacctatatactagaagtctgaaccgaataccagacacagcaacttcccgggacatcatccagagaggggttcacgatgtgacagtggatgcagacagcattgaaagagtgaataaaggaagaacaaccattggagagacagagaaatcagctttaacacaaagatcaaaggacaaccagggttagctgatattttttgaaatggagagaagaggaaatatgcaatactatacaattccatggataagtgatgtttgacaactggcaactagtttcttatcagtggctttatcaaagttagtttcaatgaaatactgaaggagcatgctaggttatgaaaaggtgaagaagttaggaggttgaaacaataaagggagatcttcaggaaagttgcagggaaggactcttattgatgtataatttttatcttatctgcttataatagaatttactaatgaatcttatgaggatggtaaacatattgagaagaagaaaagaggaagaagaaaaggaggaaaggaggagaaaagaggaggaggaagaggaggaatgaggaggaaaaggaggagaacgaagaggaggaagagtagtcaaatttgttataataacaatagctataatagacataagtattgaggacctagtgtgtgtagctaacataccatattacttaaatatattattttactttatctttacaatagccctataaagtaggttttattactaccattgaggcaaataattcttacatcaagtagcttacccatagatactttcttaataaataataattgcagaatttgaatttagatcttatgttttaagtattattcataaaattattaatttagataaaggtttttatcatgcctggatgaaatattttgacttcataaattatttaatttttccattttgacctaaacatatctatactataaatagtttttttaaaattcagcttcaaaaaagttggtaaattaattcaatgtataatggtatctatttccattgcagattgtcaatagatcttaaaacacaggtgacagaacagtcatttcacatgtgtgagagcgtctaaaaagctagttagcttgctgatatcaataaagcaatttaacagtgttttgttcttttatatatattatatataatatataattatatataattacatatatataatttataatacatatattttatatataatggatgtaatatatataaatctgtcattatcttgaaatctaattattactgaaatatctatttctaacaggctcaggaaatagaaaaatggaagagggagaaatatgtttggctcataaaatgaaaaatactaaaagagcacttatatgagggaaaaaggaattttggtccttttatattacatgatattacttttcatgatgagagatatcctagctaattaaatggttaattttatttaagaagttatatctatacatgaaacacttcgttattttgccttcaagaactaggcatgaattcttttttttttttaataggctaactaatgggttcagattttcaatttgggatcattaaattgaaggcattttggccggcagctgataaattctgcatcttcctcactccggctgcatagagtgggtggcatggacttatttattagaggcatatgggttccatttatatttttttcttgcttgacttaatttgcattttaaatagttaaagttatttgcaataagcttggttttttttaaagccttaccagagctcccatatgtttttttaggataagttgtaaatgacagtgttttcattataaaattattttctaaactaaatcgttttttattacaaaacttttctaggtttattaatgaaaattcacagagtatacaaaagtgtgaagaagaatctaaaaagaatctgtaatcctctcatcccaaagacaaccaagaatattgcattaagatatttccttctaggcttctttaccctttctatttacatagtttggttacatcatatatatagtatagtaccctgctttcttcactgtatttatataataaataatactgtgtaatattagatattatttttgaatatgatttttaatgattgcatgtccttctgttatgtggaataaattacatatctaaagagctagtgcaataaaccattaaatttaaggtattcat

SEQ ID NO: 460396 - DNA, 2105 bp, Homo sapiens
atacacctcatgtaaatgatgagttaatgggtgcagcacaccaacatggcacatgtatacatatgtaacaaacctgcacgttgtgcacagattgaaaatgttgatgtctgccttagttttctagcagccagaggggtaaatgttcaaggtctatctgctgaagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaagaatttgtgagtctactcaacccttgctactcaaagtatgacttgtgtgtgagcagcaacggcatcattcagaagattgttggcaatgcagaacctcagggcccactgcagacctgctattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctggaagcaaaaatctcagcaataaaaagtctttgctacagccaaaggaaaaagaagaaaagaacagggacaaaaataaagtttgcactgaaaaaccagtcaaagaagagaaggatcaggtgacagagatggctccaaaaaagacctccaaaattgcaagcttgatccctaagggcagcaagacaacagcagctaagaaggaaagcttaattccgtcttccagtggtattccaaaaccaggctctaaagttccaacagtaaagcaaaccatttcacctggcagcacagcaagcaaagagtctgagaaattcaggactaccaaggggagcccttcccagtccttatctaagcctataaccatggagaaagcaagtgcttctagttgtcctgcccctttggaaggaagggaagctggccaagcttctccttctggttcctgtaccatgacagtggcacaaagcagtgggcagagcacaggaaatggtgctgtccaactccctcaacagcagcaacatagccacccgaataccgcgacagtggcaccattcatttacaggtcagtacttattccttctgagacttcaataaatgcttcatagtactctttgtcacacactgggtgttcagagttctataaatataatgtggattctggaagttaatagatttcctattagcctaacttcctatctaatataaattattctgtacatagtttcaaacttccactttgatgagtgactagtgactataactgctatttctttctattttcatggttaatttcagggcacattcagaaaatgaagaaactaatatatcacggtatatctgattgaatagtctgtatttgatgtttttctccacttccttattgtctaccctttgatcactttttcattcttccagttgatatttccttttaacattctgatttttaatagaatacctgaaagtgaatataaactggcaattaatgtaataatttaatgggtttatcagagagcataatatcattttgcagcaataa

SEQ ID NO: 460397 - DNA, 6220 bp, Homo sapiens
  misc_feature (1)..(1): n is a, c, g, or t
  misc_feature (6)..(6): n is a, c, g, or t
ntgtcnagtcaaagtgagtggcctcaaccaatgctggcatttgtaggccagaaaacagtagcagagttgctgtgctgtctggtgggtaggaagaccattgaggatgggtccctcaaatcccaccatcaagatggctcaccaatcaaagctgacacagctggccaggactgcctgacttcatggtaattttgatctttcaggcaaagaaggggaactacgccttcctgtgggatgtggccgtggtggaatacgcagccctgacggatgacgactgctcggtgactgtcatcggcaacagcatcagcagcaagggttacgggattgccctgcagcatggcagcccctacagggacctcttctcccagaggatcctggagctgcaggacacaggggacctggatgtgctgaagcagaagtggtggccgcacatgggccgctgtgacctcaccagccatgccagcgcccaggccgacggcaaatccctcaagctgcacagcttcgccggggtcttctgcatcctggccattggcctgctcctggcctgcctggtggctgccctggagttgtggtggaacagcaaccggtgccaccaggagacccccaaggaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcaccagacctggagtcctcttcaagcagcaatccaacccagagcaggggccctccccactcaggcatctgataacctctgagatttccaggcctatccctgtgcagtcatcctacaggcctcaagccatcaacctgatcttccacccccagatgtgtgtgcttttcagccgacctctgaaaaagtcccctggcttcagtgactttgtgggggacagccccgctgtcggcctcaagctcagtaaagctgatctgaggaggctgtctgacatgatcaaaatttcttcttctagaaaccaaaaggaggatgcccagccctagttcttctgccctgcaccaaggacaggcttctccacgttggggccactcctcagactggggctgaggggcgggcaacagacaccgctggattctgtgagcagatgggtggacaggagcagctgcagggaaccacaaagggctgttttcttaagaagaagctgcctagttcctaaatcagaaatcccccgaatagtgccaaggtaaaactaattccatacctaatgtttgtcttttcaagttctaaaggagaagcagacacattaaagaagaaaagaccagtggtcctaaaggccacgaggacatggagggacgcagtctatggcctgtgcgttttcatttaaaagtcattccatttaataatagatgatagaaatataaaaaattgaaatattaaacatattttaaatattattaaataacagagatgggcaaggtctaacggataactcaggtctctatgtgaccttctgctcccaaggtgaaggggtcacttaattgagtgcctccagcttcgttttcaggaaactttcactcccaaaagtatctgctcatgaattagcatctgtgtcttaactagagccttgttttgtactcctagccttggcaaaagtaaatgagataaaagctccagacaattttaactgacctttccttgctgtggacacaataaaagaggcagcatttctgttcctaatgtaacatttttgtatctaaaatattcttttatgccattagttgtttttaataaaactgtttattcttattatcctcaccctttgtaccaagaaactgcacataaataaccctcttctatgccaataactttaatcattgtctttttttttttttttttttgtctctcagtggtggtatttagtcagaggagattacttatgagagaagtgaacctattccagataaatcaggaacctggttcatatcttccacatattcctaaaattctcgtataaaagctctaagccacttccgttaagagttgtgagtcaggcaagcctctgcatctcactcttccaaggcctagctccctgggcaaggggtgcagggagaagggattcgtgcaccttagatggagacaaatgctagacaaatgctatggcaataaaataagtgagacctgcttttgcattttggctctggactttacagttgtatgattttggatttgaagtgataagaatgaattcacagagctatatgtgtgattcatgattgctgaaatgatgttttcccagttcataagctcccctcttctgccagctgagcctcttgcagaacctatacagttcccaaagaccagagctggctcttgacaagcaaagccatgcttccttttgctttgtggcaaattactttttttcctgcaaaacagcatggcctagtgctgattcagtagatcagagtaggaaaagacagatctggcttaaaaatctgttctttgccactcactagatgggtatccttgatcctattaccaatgtctctgagccttctttctccccctcacctgtagaatggattctgagtcctgagctgttttgaagatcagtgataatgtggtagttaaaataatgctttgttattcagtatcctctctctgttagcttgttggttgtacatttttatattcttaaagggattatcctatagatataaatatatattttaccatgtccaagacaaaatcgggatcttaaaacaccttaacttcatttaacccattccattttttataattgtaattttacatatattttcaacaaaacttcaataataattttttaactattgttacatacagtaaggaatcatttgggcttttcaatatatttatttttttctgtgtctgtttatttcttcctctatgtctctgtttctttctgagatatttttcttctgcctgaaaaaacacttttaagaattacaaataaagctgctacaaatatccatttgtaggtttttggtggccattaagtttttaaatcatttgggtaaatacctaaaagcgcaattggtggtttggataataagactgtgtttgtcacaatttaccgaatttgtcagaaattaccaaactgtcttccaaagtgactgtattcaccatcaataaatgaaagttcctattgcttctcatttgatactatcactgtttcggactttgtccattctaaaagatagttgtgctatctctttgttttaatttgcagttccctaatggcatatgatgtggagcatctttttatatgcttatttgatatctgtatgttttctttgatgaagtgtctgttcaggtcttttgcccatgttttaaattgagttgtttgattttttattgttgaatataagagttctttgtatatttttgataataatctttttatcagatatgtctgttgaaaatatattctcccagtctgtggttgtcttctcatgctcttgacagtgtcttcagcagagcagaaatttttaattttaatgcagtcaccttattgggtttttatttcatagattttgcctttgctgttgtgtctaaaaagccatcatcatactcaaggtcatgtagattttctcctatgatatcttgtggaagttttatagttgtgtactttgcatttaggtctatggtttcttttgagttaatttttgtgagggtataaggtctctgtctaaattctttgtgggtttttttttttttttttgcatgtggattttcagttgttccagaacatttgttgaaaagagtatctttcttcattgcgttacctttggttctatatcaaaatttagttgactttatttatgtggttctacttctgggctctatattcttttccattgatctacttgtctgttcttttgctaatactgcattgtagcttcatagtaagtcttaaagtctgatagtatcagttctctgactttgttcatttgcaatgttgtgttggctattctgggtcttttgcttcttcatataaactttagaatcattttgttgatatccacaaaataactactgggattttggttgagactgtatttagtctattgatcaagttgtgaagaactgataccttgacaatattgagtgtttctatccatgaacatagaatatctttctatttatctggttctttgatttatttcatcaaagtttttcattttttatatagatcttgtaatattttgctagatttatgccaagtaatttaatatttttggcactactgtagatggtattgtggttttaatgtcaaattccatttattgttgacatatagaaagtcaatttaatttgtatattaaccttatatctgaaggctttctataattgcttttgagttttgggagttctgttgttggttatttcagattttcaacataaagaaatctgccacctatgaaagagttttatatctttcttcccaatccgtatactttttatttccttttcttgtgttactgcattatcttgcttattgcatagttttaacactttgaaaaggaatgaagcagggtcgtgttattctgtttggtgttctctgaacttcctggacttgtgatttggtgtctgacattaattggggaatattctcagtcattacttcaagtattttatgtttctttatttcttcttcgtatattcccattaagcatttgttacatcatttgtagttgtcccacagttcttggatattatgttctattttttcatgtttttctctttgattttcagttttagaagtttctgttgacatatgcccaagctcagagattcattcctcagccatatccagtctacgaattactctatcaaaggtattcttcttgttacaatgtttttgatttatatcatttctttttgaatatttcttaaaatttccatctctctgcttacattttacctctgctttgcgtattttctactttttccattagagcctttagcttattaaggatagttccaaattctcggcctgataactccaacatgtctgaaatatatgagtctggttctgatatttgttctgtctcttcaaactgttttttgttgttgttgtttttttttgtattttgcctttagtatatattgtgactttttgtcgtaagcctgactgacatactcagtaaaaggaattctgataacagatctttagtaatgtggtgggcaggtgaagtgttctatcactctgtgattattaggctttcgtccttttgtgatcctatgccccttgaatatgaacttcacaagggcttctcagtctccctgacccctgctccaggtaggacaggttgactagagtgggctagagttgggtctttctctttctccaggttggttaggctctgttaaaaccacaaaagagtaggctttggtaagatattttttattgaccacaggcctttttaagaacagaatgctttggcatatttcataatggttacttctcccttctattttcaaatacatgaggaaagttttctctgatactcactttgagaacctgagagagctcctggaagtaaaactcataaaaagtgaggggcctctgtatgcctgcccccactggagtttctaactctcagattcatccacactgagctttcagcaattcaccagttacagtttgggttttcctgccccagtatttgttcccacagaggtttctgcttgtgggtctctgttctggcaagttgtgattctctgtatacgctcgtgtgtctctcttatttttggggaggaggtttatcctgtgaccttacgtttatgacagatctaagaagagttgatttttcagtttatgtatttttcttttgtttacttgttgttagtgaagacctcaaagctccttacatgcaggtctagaatccagaagaggctttaaaaaatgctc

SEQ ID NO: 460398 - DNA, 4854 bp, Homo sapiens
cccctccccagtagcagccgtggcactgagagccatggctctttgctgggaaatgtattatacagcacagtactcccctcataaaaatacaataaacggccctgcaagtggtcagcaaagtgatgactccaacccagtggtgttcttggaggggcctctttggaagcaaagctgggaagatggaaccgaaatctttgggataagagggccctgtaaagaggccaaagaaagggaaatacacccccctttgatcacaagggattgtaattactcagatattgattgggataatgagtttgccaaaactctagagaaggagagatattcctgcaggtattttgcttttgcagaatttgctgagctctcctgtgaagtcaaagggaaggcaggagaccacacctgtgtttgtgatatcacagacacgctgagatccacaaatgtgtcattagcccaccaggttggcacagaacggctgcatctgaaggtgatttaacacagtacgtatttgttaaagaaaatatagaaaacctacaggagaaaggaggatattatccacaatcataccaccaaaggtaatcactgttaatattttagggaatttccttccaatctttttttttcttttttatcttaaaataaaattcaagtcatattatatttgcatttttatagtttcttttttcatttaatattatatgatgagcctattcctgtccctttcgtattattctacaatatctttttttaatagtttcacagtattcaattttgtggatttatatacatttagttaatctttataactggatatttagatttcctgcaaatttgcaccattgtaaacattactgcaatgaacatctttgtattacaataatctttgaccacaatttctgattgtttccttaggagacactttcctagaagtggaatcactgtttcgaaggctcttgttatatgctggttaattgtccccctcaactccccccacctgaagtgtcacatcaatttacaatctcattaatcagtggctatgacatccttcgcctctggcctgaagccatgagaaatgacaataagaaaaccaccctcaagttggcttgattccctgcccatgacatacaaaggcgcatccagtttgcagagaaaaggctgggttaaccaggctgctgttggtcaagtggctgtaagtggtgcctgaggaatccatattgctgttattaacttgcaaactgttgatgtaaagggttggggtggaatactttgcttctgtaattagaactggtttccttttcctgcaaatttggggactctcctgttattaatgacctttttggatccatgcccaggatttagagatattgtctttggatctaggtaatgaggtcgctactgatcctgaacaaatgggagaagttatttaataattactctgcactgtctgtcggtgacctttcatttgtcgagatgagaggcatctgtttatcatcacccctatgtggaagattttgattttccgggattagttctcctggattgaatccattttgctttctgcctttttagaaaagtttgccatttaaaggtaccacatgctgtagcatatgagggagctgcacctgaagtgatatgagtggaaaccatcttagacaggctggaaacacaagttcttcttaatctggggtgcacaatcaacttctagagctgacagacttgtatgctgctgaggcaagtcagtggcttctcagtggtttctggcggcaagactcaagatttgaagtttgagaggaaataagcctcaaactttgagaggaggtaggaagagattaggctttttctcttttctgcacttaacagtgagatggatagatggcccagtgtgctcagtggctctcagctggggagaacacggatgccataattgggcagacactgtggtggacaaaacagagccaaagctcagagaggctctctgagcgcccccaaagagacgttcctcccataccaggtcttgaagggcttctggagggcttggtagagacaacctgggaaagacgatgacagcgactgaaggcttaggatgaaaaccagattaatttgacttgcacagagaatcatgtgctgccaagtgtgagtggtgtcttacagagcctgagcctattactttacctaactttgtcttccttttaaaaatatccctgctaaatggccgttgagccactgcttgcatttctcctatggagaactcaccacttctcaattccctctggtctccactccatttccagcaattctcataaaattcctttttctaaaatattgagattttaaaaatctgttattttgactttagcccattgacctttgctcttatgttggggcattaattggcatttgtcttcttccttaggacagtccttcaggctttggagcagggttgtcatgccaccctatgtcttctggtgaaacattccagttctctatgttttccatgagccatgcttccaagttctttcacccccctggccacactccttaaaatcagtcgtgttttgtggttctctgaatatgagaattgcaaacaatactcaagtctggtttgtccctcacatactagaacaggtttatcttctcctttcatccagacaatacggttttattaatgcaatctaagtaagggaattttttgaaaagggaaggggggaagcacggttggtagaagaccttcaaatctcttctgaagaattaggtggaagaagccctacggaaagacaacattccacaaggctggcgagactttcacagggagggagcgggctgcaggtagtcctgccctctccccattcccacagccctttggagccctttcttcttcttggataaacagggaaaccagagctgggattgggcaggaggagaaaagcagagagcagcttggagttagaagacacagggcaacaatgatttgagagtccctgcatttctcacactgaccccagaaccaggcaatttctcaggggagaaggccctgtgctcctagaatgagtgagtgccctgtgttacaccccctgaatggtctgcacctccactttgataacatgcatcacatgtgtaacaaatgttcagctttgaacttcctcactaggttgtgagggcacagtccctacttatctgtttaatgatccttaatccacagtgtcaaatacaatgtaggcactcaacaaaaatgtgctggataaatgaacaaagaacaaatcaacgaatctccaggagtgcttgctccaaggtttctgttgatgggttctatccatcagtccatttggcagctcctgttaacttgcctagttccaattggctctctcctcctgcagcgaattctccactgtccagccatgttaagagatagaatagaatcatgaaaacataaaggggttagggctaaagagaactttagaagttatgcacagtttattgataaaaagacttttttccctcatccacactccactaaattctctcactttctttctttcttttcacatcccagctctacaaagcaattcccttgcagataccctcaactccttttttccttattctctccactgaacttacctgggaaaaagccccgactatctgcttactttgttcctgacctgaagcagcttagcattactggagaaaatcatcttcttgaaattgataaactgggctccaaggagacactctcgacccctccaccgcattggtctccagcaatgcaacctttacaacctgtcaggtgctactcttatttctgttgcccattttggaggactgtttccttgaggaggcccatttaggtgtcttttctacctatctacccttctagacttgatctggaaaggatcttagggatcagctgatctcctacctttcagtgtttgtatctttaactgggaaacttccctgtataaaaaatcttatgtggaactcttcattataaaacagtggagttgctcttgttgaaaaatgctgagggccaagggccagggtctctccatgtgagtcccctactgtatctgccagagcacctgagggtgtgtttgtgccttagggtctcagcagagcccattggaaatcactgatttagcctgcaaaccttattatctggatgagggaactgctgtcctgagaggtgacatcacatgatagatcctggacccagcatgtttaatctgggggctcctcccagcagagcatggcaccccttgctctgaccatcatgctttttggcttccctcacctgactctgattcccactgagctgtgtggtggccaccactgcctcctatttggatgcagaaggtcagtttctctgcagacagaccagccctttcagggccactctcccgtgcactcgggccctgtagcacctcccacctcatccttcctagggactgaagcccaaagcctcttacaaaactgtcttctgagggccccttggctgtcctgtttgtaaaaccattcacagtcagccatgcctttcatttccttaatcttaaattgcatcaaaaagggagagattagaggtaaaacctcaataaaggactgaacaaaagcctgcccccacttcggattctcacacctagctttgcctttttcccctccctcttctctgacagactgagtgtatgaacctttttttttttttttaacttagattaaaacgctatttagaaaaggcccgcaagtttgaagtcacctctggttcatacattaaacatcaaatgtacattaactgtgaattatggtcatgaaaagtaaatcctttaatgccgttttctgtgttccactgctgaagcttagcattaa

SEQ ID NO: 460399 - DNA, 3500 bp, Homo sapiens
cgttcgtgcctctctgccccctgtccccctcttgctgcatagtagccacatccatgtctcttgtaccctgcaatctggaggccactgccagaagctggaaatctcaagtagagcagcaaaaggcttgaggatggattcttggctcctggtgcattgccactccctgccaccctcctccttgtcttctatcttctcctggtggcgtcaggccttgcttcgtgtcccaacaggagcctctggggctggcacagccctcactgcctacaacctgggcctggtggttctcctagggtgcctctgggaggtcatggtcaccccgctgctggctaactgcagctacttctgccagccagtggactacagatggagaaagcatggaatgagggtagctaaggcttctcaccagctgatatggatgttgagtcactggatgttggtgatgggctcatgtcctgtgactcaaagtatgatccttgggccagcagcatcatttgggagcttgttggaaatgcagaatctgtgctccaccccaggcacactgattaagaatcttcttttcaacgaacaagatgcccacatgctcattagattccaaggttctgggctggggcacatttggagagtccttctgtggtcactccagtagcttctccccttctttcctgtgcgaacaggcatcttcctggagacaggaagccctgcccagcatctagaagaccacctgaagctttcacactttgagaccttagatcctgcgagggtttgaatttcaaaagcttcaattaaagcacacagtaggtcataaattggtgtttgactgttgttatttccctttagttttactctcttcttcagtaaaacaggtagaattaccatatcccactctaaggggtagttgaggcccctggagaagtctggagaaaggagacctccagagttgatgccatctcttcctcctctccaggtgttctttactttatgaatgaagccagagcagcccaccttcctgcatctctaccaccatggcaccatgccctgtgatgggtgggctggagtcaaatatgtagcaggcagccagggtcagtttgtggccactgctgccccctcttcctacagtctcctcactgagtgccccttccctgttgggttcaacacatctgtgctcctgtaagccctcagcctcctcgttctcttcctcaacttctaccaccagacacatctgagaagcaagcaagagaggctgaactaggagcaggacccagggactgaaaccagcacagcatccccacagagaattgggtggaaggcagcatggcttccagcttactggtgctgagcagattgctctgggtctccattgtatcctctgaaggaaggaggaggattgccttctgtccagatctcaggatcaaacaaataggtccaatttcctgtgctcacttcagttagagcacttctcatgtgactttgtagctttgtgtgcatctccttcctctactagacctaagcccctcacgggagggactctcttattcttgatgttccccacacctggaatttcaataaacatctcaataaacgtgtgtgtttggatccttggatcccatgactgccgtcataaccttggtgaagaagagggctgggagtaggaaagaggtcaaggttcgcttgatctctaaccctatagtgggaaattgtgacggagaatattcaagagtgggtgtgggtctgtttgatttcaggtgtagctgtgtaaatagttagccctgcatatatttttgtctactcacaactgcctgcatgtgtattcatagagttgtgtgattctgtgtatgtgcctggggagtgggagagggccatgtgcacatgtctgaatacttgttttcaaatatacatgcatgtttccatttgggtttctctccatttgtgttgtttgcctgcctcttctgtaagtctctgaaagtgccacattggcaaataaaagccactgggatcaataattctcctgttctgatgggagacatggaagcccactgagaaatctccgaatacatgttccactaagagcttccaaaaataaatgggaaaaaaggagaaatggggcacacccatcttcttcacagagagggaaactgaggaccagcaaaggggaatatatgactgagatactatggcagaagcaaatattggctgagctgttcaaacccagaataggatgggtttcttgaaagcagtttgcctgggagctgtctctatgtctccagtatgatgacttttctcctttataattgcccttcggctgtttttcatctctaggtaagttcttattttgccatgcctcaatagtcaagaaaattaaagaattgctgaaggttatgcagtgctatttggggactgtgtctccatctggccttttagttaatcaacccaaggccaggcaaggctacatcctgtggacagaatactcagagaaaattccctctaaattacgcaggatgtgagcacattccacaccttttccatgcactggttgagtgcctttgggtgggcggtggggggtggtgaggtgcttattttaaggcaaactgttatatttttttaaacacaggagtaaggtttgttcatttgcttagcagccaagggaagggaaaaattagtcacttcacagtttagcattaatatttgcccagttctttgtggctgcctctgcctgataaagcagcgcaaagggaaatgatatgttccaggtcacgtctgaatggaatgagacttttgctggggagagcctttgtgaggcagtgtcccagagagagtttgggggaaattctcaatggactgaaggcccttcatttttctatcctgtactactatgtaacaactccagctctgatgtaggagtgctttgtaggtattgttcattagtgtaggttgattgtgtgaatatgataaaccaaagtggtttatatttagcaaaaataccaaaattcttaactaatattgtagacgttcatctctatgaactgtttaagataatgacaaggaagggtggtggtagacatttaagtatataacatagcagggctgggctactgctcagagaaaaggaggctcagagtactgggagggaatgttccagagacagaagtagggggcaggcccccaccccctgtctcccatgagcttccagcaactgacggtttgggctcctggctgtcacctcataaatcagagtacatctaattgagagataaaaaccacctcccagtggccttcattgtcctcttcctgctaaaaattctgtggagacctctcctcccaacccacccccatacatactccactgtccactcagctgaccacatgtccccaagagctgctgcagcctgaccagtcctcttggagccaggaatcagaagaaaagatgatttgatttcctcctttcctaccctccctttctctttttcttgcaattctccatatacatggaggaacatctttct

SEQ ID NO: 460400 - DNA, 1227 bp, Homo sapiens
tcttgctgccggggctccggtgggagtcgtgcgctggaagaataacgtctgttgagcagagcctggcgaggagggggatgctgctgttgcagcagtacatggaatttcaaatgatgaatgaaacacgcttttaattattaccagagctccatgctctgcgtttcttcaaatggaaatgttgtgctgaaatgaatttgctgttaatcggttgcctcatgcaaggtagtgtgctgggagcaaagtaggttgtggacttatctacaaagcttcctcctctcaacagactttaatcagttggatggtgctacacaggaatacgtgagaatttgtgtgagaaaggcgataggtgcagacctgtgtgactggcaggtcgggtggtaggggaggtttgagagaagcttttggctgaagtagtgttgggtgcaggtactgaagtgtgatgtctggctggatggaagagcgcaggcctctgggctgcgggaaactgctgtgcatcacagcagccatagacgctgctccgcatggtgcctgtgagccaggctgtctgtccgatgggcctgactttgagcagtcgtgggccacggctgtaccctgcttgggaccctcagaggcaccgttgttgtctttgagaacaccgcctccatggcgagagacccaagaaatcttggccaggggttgctatgaagaaagcctgggcttctgtgtgctggggctcatgggccctcgcctctggagagggcaggaaaaggtgctgacacctgtctcctcagcagcagcatctgtgttgctatctgaacgtggtttggtggcgcctctggtgggtcagcggctcatgcaccaggtgaaccggcagcagcaacactgcttctgaggaaggcctggtgcggttaccccgcgagggtcacgtgaaaaagtatgttggtaagattcctggccaggcttttaataaatggtaactacgattacagtttaaaaaggggcaaaaaattgtttcttcagacactcttaatggtaactacgattacagtttaaaaaggggcaaaaaattgtttcttcagacactctaaaatgtaaactactaaagtcctaaaataaggcattgattttagaagtttctattcttagagcatgtcccagtgttgagatacgtggtttttttgttttgttttttctggtgagtttggaatccgcccctctctgtcagggttctgacagtgtctgaatgcc

SEQ ID NO: 460401 - DNA, 719 bp, Homo sapiens
tactactactaaattcgcggccgcgtcgacagaaaaccaaggacaattgcttctgtattcagtatccacttcttaatgtggctttatatgtaaaaataataatgcagtggttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaacgtaaagctgctttctgcttatcttattgcactgctagttgtatgtaggtattaattttattgctgcttactgcttttgttttcttattatttagctctgctctttttcctaatggctatattatctatagctatttacttgtaactgtactacatgtaaactgattttttgttctgattttttttctaatatttttaggaaaatattaagctttataaaatagcaataaaaaataattcatttaaaaaaaaatggtgg

SEQ ID NO: 460402 - DNA, 4543 bp, Homo sapiens
gactacgatccaggctggagttgcgctcggccggtctgagcgctggcgctgcccggacgccgcggggtccccgccagcccagggcactcggcgcggggatctgcgcgcctcgctctcccttcccgatgccgccgcccggctgctgatcgccgcaccaccttccctcatcggcttgggtccgtggaggtccctgcagaggcaggaagcctccttaggaaagcagggatggaggtaaattgtttaacactaaaagacctgatcagccccaggcagcccagactagattttgcagttgaagatggggaaaatgcacaaaaggaaaatatatttgttgatcgatcaaggatggccccgaagactccaataaaaaatgaaccaattgatttatcgaagcaaaaaaaatttactccagaaagaaatcccattactccagttaagcttgttgacagacagcaagcggaaccatggacacccacagctaacctgaagatgctcattagtgctgccagcccagatataagggaccgggagaagaaaaagggactattccgacccattgaaaacaaggacgatgcatttacagattctctacagcttgatgttgttggggacagtgctgtggacgaatttgaaaagcaaaggccaagcagaaaacagaaaagtttaggactcctgtgccagaagtttctagctcgctatccaagttatcccttgtcaactgagaaaactaccatctccctagatgaagttgctgtcagtcttggtgtggaaaggagacgcatctatgacattgtaaatgtgctggagtcgctgcatctggtcagccgggtggctaagaatcagtatggctggcatggacggcacagcctgccaaaaaccctgaggaacctccagagactaggagaggagcagaaatatgaagagcaaatggcctacctccaacagaaagagctggacctgatagattataaatttggagaacgtaaaaaagatggtgatccagattcccaggaacaacagttactggatttctctgaacccgactgtccctcttcatctgcaaacagtagaaaagacaagtctctgagaattatgagccagaagtttgtcatgctgttcctcgtctccaaaaccaagattgtcactctggatgtggctgccaaaatactgatagaagaaagccaagatgccccagaccatagtaaatttaaaacaaaggtacgacgcctctatgacatagccaatgttctgaccagcttggctctgataaagaaagtgcatgtaacagaagagcgaggtcgtaaaccagccttcaagtggatcgggcctgtggacttcagctcaagtgatgaagaactggtggatgtttctgcatctgtcttaccagaattgaaaagagaaacatatggccagattcaagtctgtgcaaaacagaagctggctcgccatggttcttttaacacagttcaggcttctgagaggatccagaggaaagtgaactcagaaccgagcagcccgtacagagaagaacaaggatcaggtggctactctttagaaattggaagcctggcagctgtctatagacagaaaatagaagacaattcacagggaaaagcctttgccagtaagagagtggtgcctccatcaagcagcttggaccctgttgctcctttccctgtcctctctgttgacccagaatattgtgttaatcctttagcccacccagtattttctgttgctcagacggacctgcaggcattctccatgcagaacggtctgaatggacaagtggatgtctcacttgcttctgcagcctctgctgtggagagcctgaagccagcactccttgctggccagcctctagtgtatgtgccctctgcctcactgttcatgctgtatggaagtctgcaggagggaccagcgtcagggtcagggtcagagagggatgacagaagctcagaagccccagccacagtagagctgtcatctgcaccctcagctcagaagcgcctctgtgaggagaggaaacctcaggaggaggatgagccagccactaaaaggcaaagtagggaatatgaagacggcccgctgtcgcttgtcatgcccaagaaaccctcagattccacagaccttgcctctcccaagactatgggtaacagggcatctatacccctcaaagacattcatgtgaatggccaactccctgctgcagaagagatttcaggaaaggcaacagcaaactctcttgtttcttctgagtggggaaatccttcaagaaatacagatgttgaaaagccttcaaaagaaaatgaaagcaccaaagagccttctttgctacaatatctttgtgtgcagtctcctgcaggattaaatggtttcaatgtacttttatctggcagtcaaaccccccctactgtgggcccgtcctcaggtcagctgccgtctttcagtgtcccttgcatggtcttaccatctccacctctgggcccttttcctgttctctattctcctgcaatgccgggcccggtttcttctactcttggtgctctcccaaacacaggacctgtgaatttcagcttgcctggccttggatcaatagcccagcttctcgtcggccccacagctgtggttaatccaaagtcgtccacactcccttctgcagaccctcagcttcagagtcagccctcactaaacctaagtccagtgatgtcaaggtcacacagtgtcgtccaacaacctgagtcccccgtttacgtgggacatccagtctcagtagtaaaattacaacagtcaccagttccagtgacccccaagagcatccaacgcacacatcgtgagacgtttttcaagacacccggcagccttggagaccctgtcctgaagagaagagaaaggaaccagtcacgaaacaccagctcggcccagaggagactagaaatccccagcggcggcgctgactaacctgccgctttgccaggtgggggtgggatcaaacgccctgagagtcccggatgtccgaggcgggatgcaaaccatcccgtcctgagcacgggtccttcctctctctttcatccacacttctgttaacttcccaccaccatcaatcatctgatttcctgaaagtaattaattgtgcatttaataccagttagagttccgactctgcatggtgtcacagtgaaagcgccgactgacttatggttttgattcaagaatcgtcttattgctggaagtagatctgaataggctaccggagccttgtttttctaaaggggggcgctgtctagcacttaactaggggttttattttatttttattttttgacccaataaaatgttatatgaaagaatgaaaatattaatttaagagactctgggagtctgaataaagtagctttatattaactacaggataatattagccttattacccccacaagattttttaaaacttgagtcttctatagagttaggttaaaaatgtggttctaaccatcaacaattgcatggttaaatgaccctgaactaaaactgatgggttccctatcaaaacaaataaaaatatacctttttcaggtttcaatctgtgcagggtatatgcatgttaattctaccatgcttaagaacttccacaaaatatttcatggagaggtctgcatttagacggaaacagaaatggcttttcccctcactgttcctgaatgctctatacttgttttaacatttttgctatctttttttattattctgatcatgatatgaccatttaacctcagaattcataattcctgaggggtgttaagaagcagtcccattggtgaggatattatgacttggtgaccattcttaggagtagaaaaccaaggacaattgcttctgtattcagtatccacttcttaatgtggctttatatgtaaaaataataatgcagtggttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaacgtaaagctgctttctgcttatcttattgcactgctagttgtatgtaggtattaattttattgctgcttactgcttttgttttcttattatttagctctgctctttttcctaatggctatattatctatagctatttacttgtaactgtactacatgtaaactgattttttgttctgattttttttctaatatttttaggaaaatattaagctttataaaatagcaataaaaaataattcatttaaaaaaaaatggtgg

SEQ ID NO: 460403 - DNA, 5313 bp, Homo sapiens
gactacgatccaggctggagttgcgctcggccggtctgagcgctggcgctgcccggacgccgcggggtccccgccagcccagggcactcggcgcggggatctgcgcgcctcgctctcccttcccgatgccgccgcccggctgctgatcgccgcaccaccttccctcatcggcttgggtccgtggaggtccctgcagaggcaggaagcctccttaggaaagcagggatggaggtaaattgtttaacactaaaagacctgatcagccccaggcagcccagactagattttgcagttgaagatggggaaaatgcacaaaaggaaaatatatttgttgatcgatcaaggatggccccgaagactccaataaaaaatgaaccaattgatttatcgaagcaaaaaaaatttactccagaaagaaatcccattactccagttaagcttgttgacagacagcaagcggaaccatggacacccacagctaacctgaagatgctcattagtgctgccagcccagatataagggaccgggagaagaaaaagggactattccgacccattgaaaacaaggacgatgcatttacagattctctacagcttgatgttgttggggacagtgctgtggacgaatttgaaaagcaaaggccaagcagaaaacagaaaagtttaggactcctgtgccagaagtttctagctcgctatccaagttatcccttgtcaactgagaaaactaccatctccctagatgaagttgctgtcagtcttggtgtggaaaggagacgcatctatgacattgtaaatgtgctggagtcgctgcatctggtcagccgggtggctaagaatcagtatggctggcatggacggcacagcctgccaaaaaccctgaggaacctccagagactaggagaggagcagaaatatgaagagcaaatggcctacctccaacagaaagagctggacctgatagattataaatttggagaacgtaaaaaagatggtgatccagattcccaggaacaacagttactggatttctctgaacccgactgtccctcttcatctgcaaacagtagaaaagacaagtctctgagaattatgagccagaagtttgtcatgctgttcctcgtctccaaaaccaagattgtcactctggatgtggctgccaaaatactgatagaagaaagccaagatgccccagaccatagtaaatttaaaacaaaggtacgacgcctctatgacatagccaatgttctgaccagcttggctctgataaagaaagtgcatgtaacagaagagcgaggtcgtaaaccagccttcaagtggatcgggcctgtggacttcagctcaagtgatgaagaactggtggatgtttctgcatctgtcttaccagaattgaaaagagaaacatatggccagattcaagtctgtgcaaaacagaagctggctcgccatggttcttttaacacagttcaggcttctgagaggatccagaggaaagtgaactcagaaccgagcagcccgtacagagaagaacaaggatcaggtggctactctttagaaattggaagcctggcagctgtctatagacagaaaatagaagacaattcacagggaaaagcctttgccagtaagagagtggtgcctccatcaagcagcttggaccctgttgctcctttccctgtcctctctgttgacccagaatattgtgttaatcctttagcccacccagtattttctgttgctcagacggacctgcaggcattctccatgcagaacggtctgaatggacaagtggatgtctcacttgcttctgcagcctctgctgtggagagcctgaagccagcactccttgctggccagcctctagtgtatgtgccctctgcctcactgttcatgctgtatggaagtctgcaggagggaccagcgtcagggtcagggtcagagagggatgacagaagctcagaagccccagccacagtagagctgtcatctgcaccctcagctcagaagcgcctctgtgaggagaggaaacctcaggaggaggatgagccagccactaaaaggcaaagtagggaatatgaagacggcccgctgtcgcttgtcatgcccaagaaaccctcagattccacagaccttgcctctcccaagactatgggtaacagggcatctatacccctcaaagacattcatgtgaatggccaactccctgctgcagaagagatttcaggaaaggcaacagcaaactctcttgtttcttctgagtggggaaatccttcaagaaatacagatgttgaaaagccttcaaaagaaaatgaaagcaccaaagagccttctttgctacaatatctttgtgtgcagtctcctgcagtcaccagttccagtgacccccaagagcatccaacgcacacatcgtgagacgtttttcaagacacccggcagccttggagaccctgtcctgaagagaagagaaaggaaccagtcacgaaacaccagctcggcccagaggagactagaaatccccagcggcggcgctgactaacctgccgctttgccaggtgggggtgggatcaaacgccctgagagtcccggatgtccgaggcgggatgcaaaccatcccgtcctgagcacgggtccttcctctctctttcatccacacttctgttaacttcccaccaccatcaatcatctgatttcctgaaagtaattaattgtgcatttaataccagttagagttccgactctgcatggtgtcacagtgaaagcgccgactgacttatggttttgattcaagaatcgtcttattgctggaagtagatctgaataggctaccggagccttgtttttctaaaggggggcgctgtctagcacttaactagggtaagcattcttaacatgtatttccacttgccctgagtaaatctgtggtgagagaagcttcctttctgcagtttaaaaaagctactgcttccttaggcttcatcaggaagccaccttcagttgtgaatcctatggtgttatttattttgttcctgaaatgggatttagtgcaaaaagtttacaactacagtctttaacacatttttttcagggtatgacgacttgaatgtttatacttttattctataatttgccctgcacttattttacaacctagtaataatgtggataaatgtatctacatgacacatgtcaagaccaaaataactgtgaatgacacaccttgctgtaaatgaactgtgctaaccctgactgtgggcttgagaacaaagatgaactctagaactctagcagcctaactgctgcttctcaaataactgtgtgaacagtgagatattactgtttgtttctaaaaatcctactgtgcccagtttccttcactacatgccctgcattttttatttaaatatttagctgtagcgccatcagatatggatgccttctaacaattgctgtttgtaaaataaatcaggatggtagaaagtgattatatggaaaattggaacctggatgagaccttttcgttgaattctgaagagtaatgatgtgaaaattgatacagggcaagagatgattctttgtttttcttctacttcatgtccagaagagtaagagggaaaatggacatatgtttcatatccaagggtattcaaactgtagttagttggtacctctgaaaaatgagaatggtgagcgcacgggttggttgttctagcatgaatacaattctggaaactgttatgcaatttcccttttttaacccacattactttaggggtgcattaagtcgccaaactatactagttctttgtattcctagacttgctgatatttacctctctcttgtctcttcagagtaaatggttcccttctttccttcctactttccttcattctctcttccttccctccttcctacttcttttcttccttcctcttcctctcttaaaactatcttagatgtagaatcctggtgtagggttttattttatttttattttttgacccaataaaatgttatatgaaagaatgaaaatattaatttaagagactctgggagtctgaataaagtagctttatattaactacaggataatattagccttattacccccacaagattttttaaaacttgaggtaggtagctacattaaataaatttgctacttatataaaaatttttatcaacactaaacttttaaagtttacaagttttttttttcttttttacagtcttctatagagttaggttaaaaatgtggttctaaccatcaacaattgcatggttaaatgaccctgaactaaaactgatgggttccctatcaaaacaaataaaaatatacctttttcaggtttcaatctgtgcagggtatatgcatgttaattctaccatgcttaagaacttccacaaaatatttcatggagaggtctgcatttagacggaaacagaaatggcttttcccctcactgttcctgaatgctctatacttgttttaacatttttgctatctttttttattattctgatcatgatatgaccatttaacctcagaattcataattcctgaggggtgttaagaagcagtcccattggtgaggatattatgacttggtgaccattcttaggagtagaaaaccaaggacaattgcttctgtattcagtatccacttcttaatgtggctttatatgtaaaaataataatgcagtggttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaacgtaaagctgctttctgcttatcttattgcactgctagttgtatgtaggtattaattttattgctgcttactgcttttgttttcttattatttagctctgctctttttcctaatggctatattatctatagctatttacttgtaactgtactacatgtaaactgattttttgttctgattttttttctaatatttttaggaaaatattaagctttataaaatagcaataaaaaataattcatttaaaaaaaaatggtgg

SEQ ID NO: 460404 - DNA, 1390 bp, Homo sapiens
gactacgatccaggctggagttgcgctcggccggtctgagcgctggcgctgcccggacgccgcggggtccccgccagcccagggcactcggcgcggggatctgcgcgcctcgctctcccttcccgatgccgccgcccggctgctgatcgccgcaccaccttccctcatcggcttgggtccgtggaggtccctgcagaggcaggaagcctccttaggaaagcagggatggaggtaaattgtttaacactaaaagacctgatcagccccaggcagcccagactagattttgcagttgaagatggggaaaatgcacaaaaggaaaatatatttgttgatcgatcaaggatggccccgaagactccaataaaaaatgaaccaattgatttatcgaagcaaaaaaaatttactccagaaagaaatcccattactccagttaagcttgttgacagacagcaagcggaaccatggacacccacagctaacctgaagatgctcattagtgctgccagcccagatataagggaccgggagaagaaaaagggactattccgacccattgaaaacaaggacgatgcatttacagattctctacagcttgatgttgttggggacagtgctgtggacgaatttgaaaagcaaaggccaagcagaaaacagaaaagtttaggactcctgtgccagaagtttctagctcgctatccaagttatcccttgtcaactgagaaaactaccatctccctagatgaagttgctgtcagtcttggtgtggaaaggagacgcatctatgacattgtaaatgtgctggagtcgctgcatctggtcagccgggtggctaagaatcagtatggctggcatggacggcacagcctgccaaaaaccctgaggaacctccagagactaggagaggagcagaaatatgaagagcaaatggcctacctccaacagaaagagctggacctgatagattataaatttggagaacgtaaaaaagatggtgatccagattcccaggaacaacagttactggatttctctgaacccgactgtccctcttgtgagtccattgtaacttcatgagtaatggcagagaaagagcaagtgatggtctcttctgcagattcactgctcagatgggaagtgccaggttgacaaccctggagggagatgttctcttattctcctcactgaagaaagagaagcagatggctccccaactggactgcccacttgacctcattgaaataaacctggctcatggcagttcactcgagtttggcctgttgggagaatagatcactagcattactcccatttttagattggcagccccatgctggttctttttgtgcaactgtaagatttactttgaaaaagttatattttcaaagaa

SEQ ID NO: 460405 - DNA, 542 bp, Homo sapiens
atggattctattataggaagtataagtgtaaagcattgagtggtttaaaatatgcatctcagagtttatgcctactgtagagtaattttacaagccacaagaaaatctgcctcatttcttcctgagctgacttctgtgatgtgtatccagtaagcttctgccaatgacaagggtgatctttccatctgctgatagggctagatcattttggcaagctgcaagtatagtctttcttgtagaaaatcatatactttgatgcttttgtttcattccttgtgtagcatctgcaaacagtagaaaagacaagtctctgagaattatgagccagaagtttgtcatgctgttcctcgtctccaaaaccaagattgtcactctggatgtggctgccaaaatactgatagaagaaagccaagatgccccagaccatagtaaatttaaaagtaagaatcttcacctccatcaacttactagcacataaagggtgggatttcatgtgttgatattttctgcttccaagattaaaaatatatatattgtttttg

SEQ ID NO: 460406 - DNA, 5738 bp, Homo sapiens
gactacgatccaggctggagttgcgctcggccggtctgagcgctggcgctgcccggacgccgcggggtccccgccagcccagggcactcggcgcggggatctgcgcgcctcgctctcccttcccgatgccgccgcccggctgctgatcgccgcaccaccttccctcatcggcttgggtccgtggaggtccctgcagaggcaggaagcctccttaggaaagcagggatggaggtaaattgtttaacactaaaagacctgatcagccccaggcagcccagactagattttgcagttgaagatggggaaaatgcacaaaaggaaaatatatttgttgatcgatcaaggatggccccgaagactccaataaaaaatgaaccaattgatttatcgaagcaaaaaaaatttactccagaaagaaatcccattactccagttaagcttgttgacagacagcaagcggaaccatggacacccacagctaacctgaagatgctcattagtgctgccagcccagatataagggaccgggagaagaaaaagggactattccgacccattgaaaacaaggacgatgcatttacagattctctacagcttgatgttgttggggacagtgctgtggacgaatttgaaaagcaaaggccaagcagaaaacagaaaagtttaggactcctgtgccagaagtttctagctcgctatccaagttatcccttgtcaactgagaaaactaccatctccctagatgaagttgctgtcagtcttggtgtggaaaggagacgcatctatgacattgtaaatgtgctggagtcgctgcatctggtcagccgggtggctaagaatcagtatggctggcatggacggcacagcctgccaaaaaccctgaggaacctccagagactaggagaggagcagaaatatgaagagcaaatggcctacctccaacagaaagagctggacctgatagattataaatttggagaacgtaaaaaagatggtgatccagattcccaggaacaacagttactggatttctctgaacccgactgtccctcttcatctgcaaacagtagaaaagacaagtctctgagaattatgagccagaagtttgtcatgctgttcctcgtctccaaaaccaagattgtcactctggatgtggctgccaaaatactgatagaagaaagccaagatgccccagaccatagtaaatttaaaacaaaggtacgacgcctctatgacatagccaatgttctgaccagcttggctctgataaagaaagtgcatgtaacagaagagcgaggtcgtaaaccagccttcaagtggatcgggcctgtggacttcagctcaagtgatgaagaactggtggatgtttctgcatctgtcttaccagaattgaaaagagaaacatatggccagattcaagtctgtgcaaaacagaagctggctcgccatggttcttttaacacagttcaggcttctgagaggatccagaggaaagtgaactcagaaccgagcagcccgtacagagaagaacaaggatcaggtggctactctttagaaattggaagcctggcagctgtctatagacagaaaatagaagacaattcacagggaaaagcctttgccagtaagagagtggtgcctccatcaagcagcttggaccctgttgctcctttccctgtcctctctgttgacccagaatattgtgttaatcctttagcccacccagtattttctgttgctcagacggacctgcaggcattctccatgcagaacggtctgaatggacaagtggatgtctcacttgcttctgcagcctctgctgtggagagcctgaagccagcactccttgctggccagcctctagtgtatgtgccctctgcctcactgttcatgctgtatggaagtctgcaggagggaccagcgtcagggtcagggtcagagagggatgacagaagctcagaagccccagccacagtagagctgtcatctgcaccctcagctcagaagcgcctctgtgaggagaggaaacctcaggaggaggatgagccagccactaaaaggcaaagtagggaatatgaagacggcccgctgtcgcttgtcatgcccaagaaaccctcagattccacagaccttgcctctcccaagactatgggtaacagggcatctatacccctcaaagacattcatgtgaatggccaactccctgctgcagaagagatttcaggaaaggcaacagcaaactctcttgtttcttctgagtggggaaatccttcaagaaatacagatgttgaaaagccttcaaaagaaaatgaaagcaccaaagagccttctttgctacaatatctttgtgtgcagtctcctgcaggattaaatggtttcaatgtacttttatctggcagtcaaaccccccctactgtgggcccgtcctcaggtcagctgccgtctttcagtgtcccttgcatggtcttaccatctccacctctgggcccttttcctgttctctattctcctgcaatgccgggcccggtttcttctactcttggtgctctcccaaacacaggacctgtgaatttcagcttgcctggccttggatcaatagcccagcttctcgtcggccccacagctgtggttaatccaaagtcgtccacactcccttctgcagaccctcagcttcagagtcagccctcactaaacctaagtccagtgatgtcaaggtcacacagtgtcgtccaacaacctgagtcccccgtttacgtgggacatccagtctcagtagtaaaattacaacagtcaccagttccagtgacccccaagagcatccaacgcacacatcgtgagacgtttttcaagacacccggcagccttggagaccctgtcctgaagagaagagaaaggaaccagtcacgaaacaccagctcggcccagaggagactagaaatccccagcggcggcgctgactaacctgccgctttgccaggtgggggtgggatcaaacgccctgagagtcccggatgtccgaggcgggatgcaaaccatcccgtcctgagcacgggtccttcctctctctttcatccacacttctgttaacttcccaccaccatcaatcatctgatttcctgaaagtaattaattgtgcatttaataccagttagagttccgactctgcatggtgtcacagtgaaagcgccgactgacttatggttttgattcaagaatcgtcttattgctggaagtagatctgaataggctaccggagccttgtttttctaaaggggggcgctgtctagcacttaactagggtaagcattcttaacatgtatttccacttgccctgagtaaatctgtggtgagagaagcttcctttctgcagtttaaaaaagctactgcttccttaggcttcatcaggaagccaccttcagttgtgaatcctatggtgttatttattttgttcctgaaatgggatttagtgcaaaaagtttacaactacagtctttaacacatttttttcagggtatgacgacttgaatgtttatacttttattctataatttgccctgcacttattttacaacctagtaataatgtggataaatgtatctacatgacacatgtcaagaccaaaataactgtgaatgacacaccttgctgtaaatgaactgtgctaaccctgactgtgggcttgagaacaaagatgaactctagaactctagcagcctaactgctgcttctcaaataactgtgtgaacagtgagatattactgtttgtttctaaaaatcctactgtgcccagtttccttcactacatgccctgcattttttatttaaatatttagctgtagcgccatcagatatggatgccttctaacaattgctgtttgtaaaataaatcaggatggtagaaagtgattatatggaaaattggaacctggatgagaccttttcgttgaattctgaagagtaatgatgtgaaaattgatacagggcaagagatgattctttgtttttcttctacttcatgtccagaagagtaagagggaaaatggacatatgtttcatatccaagggtattcaaactgtagttagttggtacctctgaaaaatgagaatggtgagcgcacgggttggttgttctagcatgaatacaattctggaaactgttatgcaatttcccttttttaacccacattactttaggggtgcattaagtcgccaaactatactagttctttgtattcctagacttgctgatatttacctctctcttgtctcttcagagtaaatggttcccttctttccttcctactttccttcattctctcttccttccctccttcctacttcttttcttccttcctcttcctctcttaaaactatcttagatgtagaatcctggtgtagggttttattttatttttattttttgacccaataaaatgttatatgaaagaatgaaaatattaatttaagagactctgggagtctgaataaagtagctttatattaactacaggataatattagccttattacccccacaagattttttaaaacttgaggtaggtagctacattaaataaatttgctacttatataaaaatttttatcaacactaaacttttaaagtttacaagttttttttttcttttttacagtcttctatagagttaggttaaaaatgtggttctaaccatcaacaattgcatggttaaatgaccctgaactaaaactgatgggttccctatcaaaacaaataaaaatatacctttttcaggtttcaatctgtgcagggtatatgcatgttaattctaccatgcttaagaacttccacaaaatatttcatggagaggtctgcatttagacggaaacagaaatggcttttcccctcactgttcctgaatgctctatacttgttttaacatttttgctatctttttttattattctgatcatgatatgaccatttaacctcagaattcataattcctgaggggtgttaagaagcagtcccattggtgaggatattatgacttggtgaccattcttaggagtagaaaaccaaggacaattgcttctgtattcagtatccacttcttaatgtggctttatatgtaaaaataataatgcagtggttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaacgtaaagctgctttctgcttatcttattgcactgctagttgtatgtaggtattaattttattgctgcttactgcttttgttttcttattatttagctctgctctttttcctaatggctatattatctatagctatttacttgtaactgtactacatgtaaactgattttttgttctgattttttttctaatatttttaggaaaatattaagctttataaaatagcaataaaaaataattcatttaaaaaaaaatggtgg

SEQ ID NO: 460407 - DNA, 896 bp, Homo sapiens
ttcctgctcaccggtgggctccgggcacgcccggcagggtcctgggggcgcaggcaaggggacgtaggcagagtgctccggccagcatggagggactggtcttccttaacgccctggccactcggttgctgttcctgctgcactcgctggtcggggtctggcgagtgaccgaggtgaagaaggagccgcggtactggctgcttgcgctgctcaacctcttgctcttcctggagactgcgctcaccctcaagttcaagcgcggcagaggctacaaatggttttcaccagccatatttttatatctgattagcatcgttccatcattatggcttcttgaattgcaccatgagacccagtattgcagtatccaggctgaaggaacatcacagaataccagcagaaaagaagacttcaatcaaacattgacatccaatgaacaaaccagtagagctgatgatctcattgagacggccaaagtttttgtgaataacttatctacagtatgtgagaaagtttggacattgggactccatcagacattcctgttaatgctaataattggaagatggcttctacccattggaggcgggatcactcgagatcaactctctcaacttcttcttatgtttgtggggacagcggctgacatactggaattcacaagtgagaccctagaagaacaaaatgtgaggctctgttggaaaaattccactaatagaagacatactaaccccaagtggcaacttgttctattttgagggtactggttttctatccacgttctatgccatatgtgcatgtgagaagccttccatcaatgtccaccaagtcatgataaaatgtgaagtagaaaagaatcaaaagcacagccttcaacaacccattggagagtcccc

SEQ ID NO: 460408 - DNA, 2356 bp, Homo sapiens
agtggttcagtcttaacgtctgtgtgcaataactacacgccacgtgtgatgagaaaactgaggcacagagttattaagtcatcccttttgggaccagttagttgtcagttgagagagaagagtgaagactccaggctcccaatcttactcactccagcagttcagaggagaaaggatatgctgcagaatattgggtcgggaacagggaacttgacagcatttgagctgtcacaggaagaatgggtgagagctgcatccggagagaggaaagtagaaactgtaaatcaaccagagccttatcgaatcactaaatgtttgtggcgagctcatcacatgccagatactctggaaggagcagagaaactggaagaagaacactgttatatgaacacagttggaagaatggcaagcaagagagagcaagaggtgggcagggccctgagtgggcagcatcttgtagtctaagaataatggcagtgtaaaatttgcttgctggcttatggattattgaatagtatgttaagtactcagaataaaaataataattttacagttattctctttctttacatttaggtaatcgataaacattattacatttttatgtttagctataatagagttttaaagcaaaaaaacaaagagaagatttgtacaatgctaaaaatatttcaagattagtacattcagatttaaaaatctattaaagaaaaatataggaagtttttgtgatattaatatggattttataaaactttgctatgtgttatttttcattacacagtataataaaatgagacattaaaacattgtaaaattggttctttaaatactatatggtacaatcccactcgtaagtttaaggctcaaattacttgctagttataggcacccccatcttaaggaccatattagctttttatttttttcagagtgttcagctgaaaggcattttactttctttagtaagtaaagaataactcctgaaaattactctctacaaaagcaaactcttgattgaaagcacagtgaggaaaatatttctctctcaggtggtggctgataatcctgtctgtatgacatttctgttaaacaggccaaagtttttgtgaataacttatctacagtatgtgagaaagtttggacattgggactccatcagacattcctgttaatgctaataattggaagatggcttctacccattggaggcgggatcactcgagatcaactctctcaacttcttcttatgtttgtggggacagcggctgacatactggaattcacaagtgagaccctagaagaacaaaatgtgaggctctgttggaaaaattccactaatagaagacatactaaccccaagtggcaacttgttctattttgaggtaatattattagaaactactttcctctattgtgatgaaatttgaattctcacaggtgcaactgaaatcctttgagcctgaattggccatctcaagtcaaaagaaatgtttcattccttttccacattatagtccttaaacatatgaaataaaacttctaaggaattatctctagtttttagtttcttgaactgtctcacatagatcatgactctgaatgctttagcactctagttctccccctttggtacaagaaactttataaatgtttctcctaatatatgaagcatcacacataatatttcagctcttttgaaatgtcttttcaattcgatccctggtttcttagaataattattaatcctcccactgacattccttgaaatcagccatttgaatatccatgttaatatctatattttctcccctatcatttttctcccataatgtttccataattttgtaaaactaaagacagcaatatgggaccaagaggctttgtcataattcatgcatatgttgggctttaagtctcagattatttatttttcacttcttcattattccattattatcatgtaaggatttttttcattgatttattaaatcaccaagatattttggccacaagaggtttattaggaatatactaaaaaacttgactgagaagacttttctgcatgtgatcatactttttattacaaatttaacattttgtctgtattctaggaatagtcctgcactagtctatgccatccttgttatatggacttggagcatgctgcagtttccacttgacctggcaggaaaggctaccattgatataaccttggtttctcttttgtctttcactctgccgatcctcaccctcccatatcttgtggtttattgccttgctaagaaaatttgtatttaagaaagacattttgtaaactttcaggggtgataatgttatgcagctgtttgaaaaa

SEQ ID NO: 460409 - DNA, 873 bp, Homo sapiens
ttcctgctcaccggtgggctccgggcacgcccggcagggtcctgggggcgcaggcaaggggacgtaggcagagtgctccggccagcatggagggactggtcttccttaacgccctggccactcggttgctgttcctgctgcactcgctggtcggggtctggcgagtgaccgaggtgaagaaggagccgcggtactggctgcttgcgctgctcaacctcttgctcttcctggagactgcgctcaccctcaagttcaagcgcggcagaggctacaaatggttttcaccagccatatttttatatctgattagcatcgttccatcattatggcttcttgaattgcaccatgagacccagtattgcagtatccaggctgaaggaacatcacagaataccagcagaaaagaagacttcaatcaaacattgacatccaatgaacaaaccagtagagctgatgatctcattgagacggccaaagtttttgtgaataacttatctacagtatgtgagaaagtttggacattgggactccatcagacattcctgttaatgctaataattggaagatggcttctacccattggaggcgggatcactcgagatcaactctctcaacttcttcttatgtttgtggggacagcggctgacatactggaattcacaagtgagaccctagaagaacaaaatgtgaggaatagtcctgcactagtctatgccatccttgttatatggacttggagcatgctgcagtttccacttgacctggcagacccatgtattagaacttcagaagacataggagcagttaaaattgtcctcattggaggtccttggaatcctactggtcttactttaataaaaacataaaccccta

SEQ ID NO: 460410 - DNA, 810 bp, Homo sapiens
gcagcccctccagtccctgacagacagcagccctgcccctgggatggccaccagctccagggagcacagcttgcattctaactggatcctgcgggcaccgcgcagacactccgaggatatcgctgcccacactgtgcatactgtagacggccagtttcgaaggagcaccgagcacaggaccgtgggcactcagaggagactcgagaggcaccccatttatttgcccaaggctgtggaaggggccttcaacacctggaaatttaagcccaaagcctgcaaaaaagacctggggagctccagacagatccttttcaacttctcaggagaagatatggagtgggatgcagagctctttgcgttggagccccagttgtctcctggggaggactactatgagacagagaaccccaaaggacagtggctgcttcgagaaagactttgggagcggacggtgccctgactccatctggattccttgacgtgtctcagactgggtccctgagaagctgtccgctttcagcgcagcatgaggtatttggtagagttgaaaatgccaattgtaacacagtcaacccactcagcacactgcctgctggtgccgtgccagtgccaaacagacctgtggcttcccaggggacaggtctcaggacactctcagagcttgagtttctctgcgtgggctgatgaccagggacttacagcctggctggtcttcaagagctgaaggaatggaaggtcttgagtggagtgtctgggctcactcccctgacctcacctggcctggtcctcattctccacgtgtctgtccag

SEQ ID NO: 460411 - DNA, 5913 bp, Homo sapiens
gattttcttcatggaagcgatgtccccccagcaggagactctagggggacagccggggcgctcctcttccctgacaggagtgtctcggctcgcgggaggcagctgcaccaagaagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcctcttttttggtataatatataaagtcagcagggactcccctttcccttagggcatactactgtcagtcagaactgcaagatgtgaatgaagctcttaacggcttggagtgtctttctggaagaaattgcctttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcagaattaaccatcc

SEQ ID NO: 460412 - DNA, 5352 bp, Homo sapiens
  misc_feature (4)..(4): n is a, c, g, or t
  misc_feature (7)..(10): n is a, c, g, or t
  misc_feature (12)..(13): n is a, c, g, or t
catncannnntnnagagatagagagttctaaaatgttttctgcccccacattcttggaaatgctctacatttttggaaacacctacagtcaaaatgagctttaagcagagcttttgaccttagcagtatcttctgcagacctgtgtcaggctctcacctcccaaaggattggaatgcaccagagctaggggtcgagacaaggccccagcctgtatctcaggctgaaacgtgaaaaccaagttaaggaaaatatggtgaagaagattcttgcatacccctactccagctgagtgcccaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcctcttttttggtataatatataaagtcagcagggactcccctttcccttagggcatactactgtcagtcagaactgcaagatgtgaatgaagctcttaacggcttggagtgtctttctggaagaaattgcctttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcagaattaaccatcccaccagagcaatattgccctttgtagaattgttctagttaatgatcccaatctctgcctaacattggaaatttcatagagtataatctaacattggaaatttcatagagtataattaatgttgaatttgaaccttgagcttttagtcagaacctgtggtcagtctgtctttttaggaaaagtggttttttaaaatactttttttctaatgttatttaccaaacaaacaagtcatgttttagatacaaagtcttcattttcttagcattgtgttttcactgtgctcctggaatgagatatagtcagtattcttatgtcaaagaaccataagatcacttcgattgtgtgagattttcttatctaagtttggaccattctaaccagaatacccagatgaccccagacacataccaagacatcagtgcttttcaggtcatataaatgtatttaatatgac

SEQ ID NO: 460413 - DNA, 6007 bp, Homo sapiens
gtctccatccgccgccggttctgcagcccggctcctccctcagtctaggcgcgcgggctgtagtgggcgatcgcctttccccgacccctcgccgtgcccctgggcctcccgaagtggcctgggcgagcactgactgccctttggcggtgtcagccccaaagtcagggccggcgatgtctgcccgggagcggcagccggcgctgaagaagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcctcttttttggtataatatataaagtcagcagggactcccctttcccttagggcatactactgtcagtcagaactgcaagatgtgaatgaagctcttaacggcttggagtgtctttctggaagaaattgcctttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcagaattaaccatcc

SEQ ID NO: 460414 - DNA, 2335 bp, Homo sapiens
ggggagacgatggagcgacgggtagagcagcttgggccgagccgcgggggtggaatccagacgccgggcgggggagggggcggcggggcggcgggacggtgggagcgggagccgagcctcgcggcccggggcacggcgccgcccgcccctccccggcagtgcctcccgaccccctgccctccgctgggacatggcctgaggccccgcccgccgcccgggacccctcccccacgctgcccccggaccctcgccccaggaccgcggggtctcttcccggccccgccgcccgccccggcgagaacaggcccggcgggcaaggcggcggcggaccgagggaggcctggcccggcagcggggagaagggtgcggcgcagcccgagtttcccaccttttctcctggcccagacgcggctggggcggacgggatctctcgcgctctgcctcctcctcttgcttcatggagccatgcgcctgggtggaggctcccgagagaagctggcctgcgggcgggccggacgagctgcgcggacggggcggggcgaaggaggccggcaggcggaggaggaagcggcggggcggaggcggcggcggccgggaagaactagaggtattccccgggcggctggaggactgagtcgagccgggacccgagtcctccggtatcccagcagccaccggaggcagtgaggtaatggaggaagaatgtagggagacctccagtggaccgcactccttctagcgagccgcggaaaccatagagatcagggctcagccggagggccggcccactgctgtcacgtggcctccatccgtgcgctttattggctggtgctggctttacggggttgaattttggacgctgcctgccattcgtgggaccgagtttcaggcagctggaataaagagagacatcgggggaaagccgcgagaaggccagcgtccctggctgggagcagagctagccgagtagggcgcccggctgtcaaactggccggcgcagtgcacgctgggccgccccggagcggtcgcagagcccgtcgggagtcgtagtccgggacgggcccgcggcattgtccgcgacgcagctcgggatccgggtcggggtgtcggccgggttgctgccgggcaccgtcgagcgttagccacccagcattgagctgccagcggctgttctccctaagcaccctcgctcacgtcgcctcgcctcgcctcgcctgaccggccgcagccttggataccagccttaaatcgagccgactacggcccagccccgcccgcggcgaggtgcgcggggttcggtgccagccgctcgcccctggcggggccagcctcttgatgcaccggggacgggcgcccccatccgactcttcgaggggcggcagggccccatctgtgtctttcgctctcgagcccccagctagagttggcttcagcggaatacctactgtgcgggattattcaacaagccgattgatcacattcttcagctctagcagtgcaaaggcttcactgaaaaagaacattacaaattttttttgaaagaaatttgggggaatccactgaagacctacatttcccggaaggttaacagcccccttctcagttttcctggtaaagtgtttttatattggtagaataccttctgtcacactctatatttttcttatctcaagtagaaaaaaattttgcccttttgcttgggactgttaacagccctggtagtggaaagtagaaggaaatgattctgtgaattttctgttatataaattttagccagtttaggacttttgaatgaggggccatacagccaaggatttaggatttcagctcaggaaagaaaactgcataggtgtttaattgtgtcctagccacttattagctgggtaactttgagcaagttttatacatatccttcccatgagtttttcatttctaatactggctgtgtaatacagtatgtttcatagacttgctgtaataatcgatggagtgtatctaatagtgtttattttactgtaactgggccacagttaggaagtactcaattaaaattagccgtcattattcctagtattaatatggtgatgaacagctaaagagcatttaaataattatcattaatatggataaattttgaccatacctgaataaatatttataatataactgttgagagtatacaagtttaatattttagggaaatacaatgtcaaattctatcaagctctattttcaaactaaaacaatagcagtttgctttcagatattttgaatattattgtgacatttcccccttctacctttctgggaccttggatacaggaaccatgtaagg

SEQ ID NO: 460415 - DNA, 1770 bp, Homo sapiens
ggggagacgatggagcgacgggtagagcagcttgggccgagccgcgggggtggaatccagacgccgggcgggggagggggcggcggggcggcgggacggtgggagcgggagccgagcctcgcggcccggggcacggcgccgcccgcccctccccggcagtgcctcccgaccccctgccctccgctgggacatggcctgaggccccgcccgccgcccgggacccctcccccacgctgcccccggaccctcgccccaggaccgcggggtctcttcccggccccgccgcccgccccggcgagaacaggcccggcgggcaaggcggcggcggaccgagggaggcctggcccggcagcggggagaagggtgcggcgcagcccgagtttcccaccttttctcctggcccagacgcggctggggcggacgggatctctcgcgctctgcctcctcctcttgcttcatggagccatgcgcctgggtggaggctcccgagagaagctggcctgcgggcgggccggacgagctgcgcggacggggcggggcgaaggaggccggcaggcggaggaggaagcggcggggcggaggcggcggcggccgggaagaactagaggtattccccgggcggctggaggactgagtcgagccgggacccgagtcctccggtatcccagcagccaccggaggcagtgaggtaatggaggaagaatgtagggagacctccagtggaccgcactccttctagcgagccgcggaaaccatagagatcagggctcagccggagggccggcccactgctgtcacgtggcctccatccgtgcgctttattggctggtgctggctttacggggttgaattttggacgctgcctgccattcgtgggaccgagtttcaggcagctggaataaagagagacatcgggggaaagccgcgagaaggccagcgtccctggctgggagcagagctagccgagtagggcgcccggctgtcaaactggccggcgcagtgcacgctgggccgccccggagcggtcgcagagcccgtcgggagtcgtagtccgggacgggcccgcggcattgtccgcgacgcagctcgggatccgggtcggggtgtcggccgggttgctgccgggcaccgtcgagcgttagccacccagcattgagctgccagcggctgttctccctaagcaccctcgctcacgtcgcctcgcctcgcctcgcctgaccggccgcagccttggataccagccttaaatcgagccgactacggcccagccccgcccgcggcgaggtgcgcggggttcggtgccagccgctcgcccctggcggggccagcctcttgatgcaccggggacgggcgcccccatccgactcttcgaggggcggcagggccccatctgtgtctttcgctctcgagcccccagctagagttggcttcagcggaatacctactgtgcgggattattcaacaagccgattgatcacattcttcagctctagcagtgcaaaggcttcactgaaaaagaacattacaaattttttttgaaagaaatttgggggtaaatttaattttaaatactgatttttgataacatttgatcttatgacagcatttgtatttttaattacagataggattacactaaaagtcatttctgacctgctcccttacccttatggctaaaataaactgctaggccctgaagcaaaggcgagccatgttctagagcaatgtctttcttgtattaaaatacggccccatgctcacaaaaaaaaa

SEQ ID NO: 460416 - DNA, 1785 bp, Homo sapiens
ggggagacgatggagcgacgggtagagcagcttgggccgagccgcgggggtggaatccagacgccgggcgggggagggggcggcggggcggcgggacggtgggagcgggagccgagcctcgcggcccggggcacggcgccgcccgcccctccccggcagtgcctcccgaccccctgccctccgctgggacatggcctgaggccccgcccgccgcccgggacccctcccccacgctgcccccggaccctcgccccaggaccgcggggtctcttcccggccccgccgcccgccccggcgagaacaggcccggcgggcaaggcggcggcggaccgagggaggcctggcccggcagcggggagaagggtgcggcgcagcccgagtttcccaccttttctcctggcccagacgcggctggggcggacgggatctctcgcgctctgcctcctcctcttgcttcatggagccatgcgcctgggtggaggctcccgagagaagctggcctgcgggcgggccggacgagctgcgcggacggggcggggcgaaggaggccggcaggcggaggaggaagcggcggggcggaggcggcggcggccgggaagaactagaggtattccccgggcggctggaggactgagtcgagccgggacccgagtcctccggtatcccagcagccaccggaggcagtgaggtaatggaggaagaatgtagggagacctccagtggaccgcactccttctagcgagccgcggaaaccatagagatcagggctcagccggagggccggcccactgctgtcacgtggcctccatccgtgcgctttattggctggtgctggctttacggggttgaattttggacgctgcctgccattcgtgggaccgagtttcaggcagctggaataaagagagacatcgggggaaagccgcgagaaggccagcgtccctggctgggagcagagctagccgagtagggcgcccggctgtcaaactggccggcgcagtgcacgctgggccgccccggagcggtcgcagagcccgtcgggagtcgtagtccgggacgggcccgcggcattgtccgcgacgcagctcgggatccgggtcggggtgtcggccgggttgctgccgggcaccgtcgagcgttagccacccagcattgagctgccagcggctgttctccctaagcaccctcgctcacgtcgcctcgcctcgcctcgcctgaccggccgcagccttggataccagccttaaatcgagccgactacggcccagccccgcccgcggcgaggtgcgcggggttcggtgccagccgctcgcccctggcggggccagcctcttgatgcaccggggacgggcgcccccatccgactcttcgaggggcggcagggccccatctgtgtctttcgctctcgagcccccagctagagttggcttcagcggaatacctactgtgcgggattattcaacaagccgattgatcacattcttcagctctagcagtgcaaaggcttcactgaaaaagaacattacaaattttttttgaaagaaatttgggggaatccactgaagacctacatttcccggaaggttaacagcccccttctcagttttcctgctgctcctatcagtgacaaatcagcgtattagaacatgcatgctggctgatcattctgatcaagtcaacaagcttcacaacttactctgaatgaggtcgtccgtgagaacttcactgttttacggggacaggagctacttctttgctgaactgcatcacggtttcaactgctga

SEQ ID NO: 460417 - DNA, 1176 bp, Homo sapiens
tgctagagcacagacacatgcatacctttgcacacacatacttgctctgcagttaacacagagacccgctgccagactgtgtgagtgttgatgaccccctacatcttcccggtgtgtcctgagctggctgcagttcaccacatgccacccataagggactctgccctggggaagatggagaccaagatctctgccagtggagaccactggatgcatcaaccgagagccctgctgcactgttccaggaacagcctggaaaatggaggtgcagcttccctggtaccccaagggcagagcacattacacatcacagtgccaggggcccactttcatttgcaaaatgctttaaacccaactcttgaactagaatggattgtgttgatgtatcaacatggcatcctgttcccaggctctttcctgaagtctgcagggtctgccagagaccacgtgcccctttcccccagccctaatctctccctcaagcagaatttgtttaaagccactattgaaagactcacggaattcccccagccttgctaaagaaagagagagagagagagccctatgtaccaaggtcatccaagcactgcatttgtacttggctgtagggaggaagggttggaaaaaagagaagatgttttctatcttggacctttacctaaaataggcaccatcgtgctcagtggccttgcttgtaaacttctacaggagggtgagttggagagaagtgatcactggacaggtctgtgacagaaggcattcagactttgggatggtggtgacccttgaattttaaggttcccttctaacctaataggtttcatggcaatgtttcagtttcatttgacacaccctagcatagtgccttcctaggtgccaggcagtgctggaggcacttacaaacattaattgaattaattgtcacaacagctctgttgaggatgataattttattatcatcccaatttcagagatgagcaaataggcatggagagttgaagcaacttgctcaagttcacagagccaataagtgacagagttgggactcaagcccaggctgcctggtttaagagcccatgcttttgaccaacctgcttttataaatctgtgacttctagccagtgccagatctgccagcttatttctatggattatgtattttagagcggctttgcc

SEQ ID NO: 460418 - DNA, 2543 bp, Homo sapiens
ggagcctgccgggagagtggtggcatctgagaggctggtcgtggactgtggttgggggaggtgggagctgttttaaccgtgtgccccctctcctgtgccggcgtgggcatcccccggggcagtggaacgcgggcgctcctccagcttccgagtccagccagcctgggcgcggggcgccgcccccgagacacccgaggagtccgttcctccctggttacgtggactgtggagctggtctcttgtggctcagcgccgtgcggaggttgaagcgtacctgcggaggtcgcaccagggcgtgaggaggaggaggaagggcatgagccgagcttgaggaatccgtgctccaaactctacactcaagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcactattgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctgagccatctctcccttgtcttgtgtctgcccgacgtgttaacactttctggcattcctgtgaggacacaggtgtacctcttggcccactttgcgaaggggagggactcttggggacagggctcctggttttggctgactggacttgcatgggggtgcctgtgggccttggggatgagaagaaatacagcaggcccggagtccgggcctatggagaaagggccccgccggcccgcccgccagtctgggctcctgcacatctggcgatcccgccacatctgggcagccggcgctggagcatgaacggctctcaggcgggcgccgcggctcaggccgcctggctgagctcctgctgtaaccagtcggcgtcgccgccggagccccccgaggggccgcgcgcggtgcaggcggtggtgctcggcgtgctgtccctgctggtgctttgcggggtcctgttcctgggcggcggcctcctcctccgcgcccagggcctgacagcgctgctgacccgcgagcagcgcgcgtcccgcgagcccgagccgggcagtgccagcggagaggacggcgacgacgactcctcggcgcccggctgcgctcggtggtcgcggcctccaggcagcccctgactccgagcggtccggagcatgcccgacggctgctgcggtcccgaccccttacccgaagcggcgcgccccacacaggagcagtgaggtgtctggaaggtttcatacgggaagtgacatgttaagatctggatcttaaagaacttggggttcccgaagaagctcggtgccatcaacaggaaaggatgagactttggattccagaagaacactgctggggcttccccccgagtctgccacttgctgtcgtgcaggcggagtggagagtgacacggccacgtaattggttgaaaatttgaacggcatgctcttgtacctgggagggcgttccaaaggctatgaaaacattgggaacagactcaaccacttcaaaggcacaggtggctggtgaatggaaccctttgctgcctgctggttcccaattttgaatgtatctttttgtttaaaatgtctttgttacaaaccaaacgttacaagaattgtaggggaaatgaattaaaagtagaaacaatatttcatcctttg

SEQ ID NO: 460419 - DNA, 2654 bp, Homo sapiens
ggagcctgccgggagagtggtggcatctgagaggctggtcgtggactgtggttgggggaggtgggagctgttttaaccgtgtgccccctctcctgtgccggcgtgggcatcccccggggcagtggaacgcgggcgctcctccagcttccgagtccagccagcctgggcgcggggcgccgcccccgagacacccgaggagtccgttcctccctggttacgtggactgtggaggttcgcgcgtagtggcggcgggggatacgggacccgggcgggaattccttcctgcgtccgtcccgagtctcttgatatggagccaagtaagttttctggttttgcttttagctggtctcttgtggctcagcgccgtgcggaggttgaagcgtacctgcggaggtcgcaccagggcgtgaggaggaggaggaagggcatgagccgagcttgaggaatccgtgctccaaactctacactcaagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcactattgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctgagccatctctcccttgtcttgtgtctgcccgacgtgttaacactttctggcattcctgtgaggacacaggtgtacctcttggcccactttgcgaaggggagggactcttggggacagggctcctggttttggctgactggacttgcatgggggtgcctgtgggccttggggatgagaagaaatacagcaggcccggagtccgggcctatggagaaagggccccgccggcccgcccgccagtctgggctcctgcacatctggcgatcccgccacatctgggcagccggcgctggagcatgaacggctctcaggcgggcgccgcggctcaggccgcctggctgagctcctgctgtaaccagtcggcgtcgccgccggagccccccgaggggccgcgcgcggtgcaggcggtggtgctcggcgtgctgtccctgctggtgctttgcggggtcctgttcctgggcggcggcctcctcctccgcgcccagggcctgacagcgctgctgacccgcgagcagcgcgcgtcccgcgagcccgagccgggcagtgccagcggagaggacggcgacgacgactcctcggcgcccggctgcgctcggtggtcgcggcctccaggcagcccctgactccgagcggtccggagcatgcccgacggctgctgcggtcccgaccccttacccgaagcggcgcgccccacacaggagcagtgaggtgtctggaaggtttcatacgggaagtgacatgttaagatctggatcttaaagaacttggggttcccgaagaagctcggtgccatcaacaggaaaggatgagactttggattccagaagaacactgctggggcttccccccgagtctgccacttgctgtcgtgcaggcggagtggagagtgacacggccacgtaattggttgaaaatttgaacggcatgctcttgtacctgggagggcgttccaaaggctatgaaaacattgggaacagactcaaccacttcaaaggcacaggtggctggtgaatggaaccctttgctgcctgctggttcccaattttgaatgtatctttttgtttaaaatgtctttgttacaaaccaaacgttacaagaattgtaggggaaatgaattaaaagtagaaacaatatttcatcctttg

SEQ ID NO: 460420 - DNA, 2804 bp, Homo sapiens
  misc_feature (625)..(625): n is a, c, g, or t
ggagcctgccgggagagtggtggcatctgagaggctggtcgtggactgtggttgggggaggtgggagctgttttaaccgtgtgccccctctcctgtgccggcgtgggcatcccccggggcagtggaacgcgggcgctcctaccttcccaaggcttcccggaaggttccaagcccaagcctggggctggcggtggtcgcccgccctccagagaacagccccagaggaagtcccgggttccctgccccgtgtggtttcaccggtagggaacttggttgtggaaggcgttgtggtccttcgttttgggttgggggctccaagctgggcacaggtaggcagggaagagtttagaaagggctggatacccttagccggtaaatggggtccagccacgcttagtggctctgttgcaccggcggagcggaagggcgcacggacagcggcgctacttagaggctcggagccctttgaaccgggaaattcccccgttggctccaaagagcttctaacgacctccaaggcggtatgggcccctatgaggcgtagcgggcttggaagattcgccgcttgctccttttattccctatggtttacgcaccaccgtttgggctgttggcgtaaaacctnggcggtgccatggattgagagcttggtcggcatctgagacgtgattgctcgtgacgcgatgctccgagctggccacgggagccggccatggttgcgaaggacggggccatgccttgggcttgtgcgttggcacaccgtgtggcttcgtggcacccggcagccacacggcgagagtatccacggtaccaagtaaggacgtggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcactattgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctgagccatctctcccttgtcttgtgtctgcccgacgtgttaacactttctggcattcctgtgaggacacaggtgtacctcttggcccactttgcgaaggggagggactcttggggacagggctcctggttttggctgactggacttgcatgggggtgcctgtgggccttggggatgagaagaaatacagcaggcccggagtccgggcctatggagaaagggccccgccggcccgcccgccagtctgggctcctgcacatctggcgatcccgccacatctgggcagccggcgctggagcatgaacggctctcaggcgggcgccgcggctcaggccgcctggctgagctcctgctgtaaccagtcggcgtcgccgccggagccccccgaggggccgcgcgcggtgcaggcggtggtgctcggcgtgctgtccctgctggtgctttgcggggtcctgttcctgggcggcggcctcctcctccgcgcccagggcctgacagcgctgctgacccgcgagcagcgcgcgtcccgcgagcccgagccgggcagtgccagcggagaggacggcgacgacgactcctcggcgcccggctgcgctcggtggtcgcggcctccaggcagcccctgactccgagcggtccggagcatgcccgacggctgctgcggtcccgaccccttacccgaagcggcgcgccccacacaggagcagtgaggtgtctggaaggtttcatacgggaagtgacatgttaagatctggatcttaaagaacttggggttcccgaagaagctcggtgccatcaacaggaaaggatgagactttggattccagaagaacactgctggggcttccccccgagtctgccacttgctgtcgtgcaggcggagtggagagtgacacggccacgtaattggttgaaaatttgaacggcatgctcttgtacctgggagggcgttccaaaggctatgaaaacattgggaacagactcaaccacttcaaaggcacaggtggctggtgaatggaaccctttgctgcctgctggttcccaattttgaatgtatctttttgtttaaaatgtctttgttacaaaccaaacgttacaagaattgtaggggaaatgaattaaaagtagaaacaatatttcatcctttg

SEQ ID NO: 460421 - DNA, 1555 bp, Homo sapiens
tgaaggacaagattgtgtgggtttttaaatcccgtagcaaatgggagggggtacgggtgatgggaacagatggggaagagacacaagtgcttcattggcaccttgcacggatgcctcatgctgactttctccctctggcaccatcattagtgcctctggcttcagagccagatcttaataaaaaggtaaatcttcacaaccacagtggaccaataaacaatcaaacgaagaatctactaacttatttcttcccatcctttcccaaacataatctaatacatgtgcctccagcccataagagccatggcattttccccaattactctgcatatgtgaatttactgtgtcttttgaaaggcagcttatcctccaacggattttgtcggcagcctatttcttcacactattcaggccattttcttccaactaaatattcagttgttgtcactaaaaatatatcaataggataaagaaatctaaaagtcaaaaattaagcaaagtgacatatatttgcatggattgaatgcttcaaggaaaaataaaagcaactgagctcactctgctacataaaatatttgtgcctttttccccttttgcctctgttcttagaaaacaatgagctgtctccttgccaaccagcagctcccttggtaggggcatgcagaagacctgatgacacaaaccctccaaagagtttcaccctcaccacaacaggtggcttcctgctcggcagcccatcctgcatcacttcagtggacttctctgacatctactagaccacattaaatgaatcacagccttgaaactgaactggaaggacttccttcaaggagccagcatatgaacttgctgcctatctttagcaaggagatgcaaatgacatccacaaacctcttctgctgtatacctggatgaaagcaaggctagctgtgtgtcctatggcaccaaggactgaaagattgtaagaagtaagagtaagtaaatttttagctgctatattccctaatagctagactttaaaagtatttttaactcttttcctctattcttgctaggtgaacaaggctaaaacctgggtttagttttcattttataaattattctttaaaaataaattatttcaactgtcttgaagagtctgtaaaacaaggtctgtgaagtcacagagggaaaaagaatcagaaatcagtagacagcagttagaccacgggtgtttgttatacattcgttctagacattcatcaaaagctcagaaagggaaagtcaagcgtgccaaatcaataaagtttctatcgtatttcatctctttggatttgcagaatgctttggtaattctgtttctcaagcctgcacatcacgagcaaacaagtatgcttatgggtgtcttagcccagtaggctgtttatcagaaagctaccagtcccctgtgagaagctggctttcctccaaaatgtagaaggtgtttaaggggacatatttctttggtacaccctaaagcaagcttgtccaatgtgcagcctgcaggccgcatgtggctcaggacagctttgaatgt

SEQ ID NO: 460422 - DNA, 3484 bp, Homo sapiens
ccttacccagtgaggcagtctcagttctgaagccaagaacttgacttcgtgaaatggtacatggaatgcctacacagaagacccaaggctgcgatgctggatacctcaatttgggagctggagactggatatgcaggattgagttatttgagctgagaacccaagaagggctggcaatagctgaaggcttgagtgctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagctgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcgccttggctgctcttcccatacctgtcccaatgtgctgctcccccatcttgggacaccaccccaaagcccaaccctgtctctttggcatccaggaggctgaagatgagacagtcagtcctgatggcagctgtgcagagtgggggtgaggaggccaacttactgcttcctgaactggccagtgccttctatgacatggccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgtatgactgttgtcacaaaatgtgttcttatcatgaggtgtgactggaacacagggcccagacctccagctcttagaccctggtggagggaggagggaaagaggggacgcatccctgcctcatggcaggggatgctgggcagttactgtcctgtcgtgcctcctggtgtgctggccatgagtgggttgtctcaagtgggagtctggcttggataatgcggcagttggggagggagcaaactcatgggtccctgtcacttctgctcagggtttagtcccagggtgggtgcatgccatggaaaagtgggacaagtttcccactgccgagaacttcacccttcatagcagccatcactgtaccttatgccaaaggacaggctttattcctgtcaagagcgtacacctttgagtatctacttagtaaaaaatggccctaagcctcatacctctaaaggcgattttatattcctcctgtttctgtttctgtttctttctctgttgccatcccctcatacctgtatgcacactctgcctcaacagtcacaaaaacacattcatccactctaaccagcttcacaggctagacagacacatacacagcatcgtaaagcatttgttaaggacctgcacgctcaccaaggctctcagcaatggcctgcacaagcacatgcctacaaccccctcgtcctccaacccaatagctcccttctcagctgccctcctctcccttcagggcccctgtgtggaccacccccaccattccctttctccattcacctgaaatgctcctgtccaccccctttccagccccacctggatgacttcttacatcgttccttcttccctcacgtctccgtctcctagcaaccccatcccgttccctgaatcccttccaaggaaattagagataatggatctctcctctctccatcccaacccctctttattgatcctcctttaatgaaagttaattataacaatgatttaattaatagaatccctctcttcctttattgcttcccgtattaagactattaataaatacgagctgggctgacagaggcatccatcacccgcctgggattccccccatccctccttttaccttcccccctctccctctccctctcttggcctataaacttgcc

SEQ ID NO: 460423 - DNA, 2313 bp, Homo sapiens
agcgaaggggatttcccggtcccatggggagatcacagaagagagggacatcctgagaccggcaacagggagaccatgtggcacgcatcctggagctacaggatgacatccagaccatcagtgagaaagtgctgacgaaggaagtggagctggacaggcttagagacacagtgaaggccctgactcgggaacaagagaagctccgttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagctgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcgccttggctgctcttcccatacctgtcccaatgtgctgctcccccatcttgggacaccaccccaaagcccaaccctgtctctttggcatccaggaggctgaagatgagacagtcagtcctgatggcagctgtgcagagtgggggtgaggaggccaacttactgcttcctgaactggccagtgccttctatgacatggccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccggtgggaagtcgacttcccacgggaggcagaggtttcagtgagctgagaacgcgccattgcactccagcttgggcaacagaacaagattctgtctcaaaaaaagaaaaaagaaaatcagtttctttttttattcttcaagagttgaaaagtacctgatattaagtgattttttaaaaccattcatcttccctagaattttttagcagtc

SEQ ID NO: 460424 - DNA, 2898 bp, Homo sapiens
tggcagcttccatgtggtgttgggcctgcaggttcacaaaagtccagagtttaggagcagtgcaaaggggaaatgtgggaccagaacccccacacagagtccccactggggcactgcctaatggagctgtgagaagagggccaatgtcctcaagaccccagaatggtagatccagtgacagcttacaccatgcacctgaaaaagccagagacactcaatgccagcccctgaaggagctgtccaaggctgtgggatcccactccttgcatcactgtgccctgattgtgagatgtggagtcaaagggaattattctggagctttaaaatttaatgactgccccactggattttggacttgcatggggcctgtagcccctttgttttggcaaatttctcacatttggaacagggtgcagcttatgacgctctacatgagggctattttattaggaatgctggagaactcagcctgtgcaaaaaccaagcctgaatgtgtgggatctgattttcagggaatccagactttaagagtaacactggtagggctaggaggggttgtgaacatctgagcatttctgaggaagttttagaaaatcaagtaggtaccaggtgccagaaaatctcccacctcccttgtcccagtaaaaggataaagcattcagtggcccctggtagctctttttcaggttctcacagatctcaaacaccctatcccttcccttccaccagaggacttgacgccccacccaaagcacactccgacccacttcccacacggcagccagaatgggaaatcagcctcaacccacataggaatcatgatgagtgcggctgacactcaccacgtgcttcatgtacaccaggcactggatgtgcatgtacacaggccctgcacataacatcctgtttgaagggcacaaaaatcccaagaggatggtattgctactcccgctttacaaaaagaaaaaggaacagaggctcagagagtcccaacacaccatggctcatcagcagggagcgagtttttaaccccaagtctgtgagatcctggtgctcccaactagtatattttagtgcctctttgaaccatgacattggccatgaagaaagtggtagcatctcatcacatgttctagagaggccactggaacatcttctagactttctaaagagagagttaacctcttcttctaatcaatatataagaaccatgtgtcacattaataaagctaatcatgtaattgcagatatatgtatacatacatacacatatatacatatgtatacatgcactcatatatatacctatgcacagtagatgcatacatatatgcatacatttgtatgtatgaatttacatacacaattgcatatagacaaacactatatacatgcatatatataaagtataaggtcagaaactaaatacagtatatatgtatgtatatatatgtaaatgtgtatatatatatgaactcatgtatatacattcacatatatatgtacatatgagtcagatcagaaattacatttatttttcttgttcatgtgtttcttcttcagtgatatatccccaccattctgtgagaatggttggaaattctgatcacttcacacccaaattctctggtttgttgcaaattttttttctcaaaataatactactcaaattttaaaaatatatttatttttaaaagagttgggcatatctgatatagcttaggctaagctaagtgttcatggtttctatccagtgaaatatgagtgaacaagagtttggggagatttaaggatggattcatatgcagccattagaatatttccggaatacctacctactagaagcggaacttataacatattatgatcatgcttgtggaaatttatgctggctagcatttgggggacatcgcctggatcaaggccaaggtcactcttgtctctagcacacatgcagatatgcttctcatcacagtagataccttaattcagaatgatcctacagaagcagacatccctaccagattgctattgctgtgaatgcaactccgaaggggactggaccacaggcagctggactttacataagttacaacaggaatttctgtccaatggataagcttggcctttatgacatacacatcagaggaaagagttagccaacaggtaggagctactgtgaggctgatttcaaatatgttgcctttttcctatcttcagcctttaagatagtgcaaatctttctattttctccctacctccagctttaagtcccttccagtgattgccaaaatctgaagcccaaaagtggggataggaagaaagcttgacccaaaagtgtccttggatgttgtgaatacaatgcgttcataatttttcttgtcacactgtatcacacactagttctagcttttatgtctcatgatcctccaccagaatgtataaaatttaaaaaagactgtcagtactaacaactgctgttgctgagtggagcagagagaaacagtcttcaccaagccctgcccaggttgtacatctatgagcaaaatgctattgttgctatttgaagccactaagttttaaggcagcttgccacaaagataaggatacctggaacactatgtgtcaagtcactgggcagagacatcatctaatttaatctttaaaacagctgctttggaagatatccctgctttatagatgcagaattaggacttgaaggaccaagatcacattgcaaggaagaagagaacaaatcagttggaagaaacagaatgagcaaagtcaagaagacgtaaaagcaaggtgcatctgactttacaattcaatagaataaaaaacacaacaatgacgaaaatggtgtaaaatctgttcattataaagtgactaccttcaccc

SEQ ID NO: 460425 - DNA, 2817 bp, Homo sapiens
tggcagcttccatgtggtgttgggcctgcaggttcacaaaagtccagagtttaggagcagtgcaaaggggaaatgtgggaccagaacccccacacagagtccccactggggcactgcctaatggagctgtgagaagagggccaatgtcctcaagaccccagaatggtagatccagtgacagcttacaccatgcacctgaaaaagccagagacactcaatgccagcccctgaaggagctgtccaaggctgtgggatcccactccttgcatcactgtgccctgattgtgagatgtggagtcaaagggaattattctggagctttaaaatttaatgactgccccactggattttggacttgcatggggcctgtagcccctttgttttggcaaatttctcacatttggaacagggtgcagcttatgacgctctacatgagggctattttattaggaatgctggagaactcagcctgtgcaaaaaccaagcctgaatgtgtgggatctgattttcagggaatccagactttaagagtaacactggtagggctaggaggggttgtgaacatctgagcatttctgaggaagttttagaaaatcaagtaggtaccaggtgccagaaaatctcccacctcccttgtcccagtaaaaggataaagcattcagtggcccctggtagctctttttcaggttctcacagatctcaaacaccctatcccttcccttccaccagaggacttgacgccccacccaaagcacactccgacccacttcccacacggcagccagaatgggaaatcagcctcaacccacataggaatcatgatgagtgcggctgacactcaccacgtgcttcatgtacaccaggcactggatgtgcatgtacacaggccctgcacataacatcctgtttgaagggcacaaaaatcccaagaggatggtattgctactcccgctttacaaaaagaaaaaggaacagaggctcagagagtcccaacacaccatggctcatcagcagggagcgagtttttaaccccaagtctgtgagatcctggtgctcccaactagtatattttagtgcctctttgaaccatgacattggccatgaagaaagtggtagcatctcatcacatgttctagagaggccactggaacatcttctagactttctaaagagagagttaacctcttcttctaatcaatatataagaaccatgtgtcacattaataaagctaatcatgtaattgcagatatatgtatacatacatacacatatatacatatgtatacatgcactcatatatatacctatgcacagtagatgcatacatatatgcatacatttgtatgtatgaatttacatacacaattgcatatagacaaacactatatacatgcatatatataaagtataaggtcagaaactaaatacagtatatatgtatgtatatatatgtaaatgtgtatatatatatgaactcatgtatatacattcacatatatatgtacatatgagtcagatcagaaattacatttatttttcttgttcatgtgtttcttcttcagtgatatatccccaccattctgtgagaatggttggaaattctgatcacttcacacccaaattctctggtttgttgcaaattttttttctcaaaataatactactcaaattttaaaaatatatttatttttaaaagagttgggcatatctgatatagcttaggctaagctaagtgttcatggtttctatccagtgaaatatgagtgaacaagagtttggggagatttaaggatggattcatatgcagccattagaatatttccggaatacctacctactagaagcggaacttataacatattatgatcatgcttgtggaaatttatgctggctagcatttgggggacatcgcctggatcaaggccaaggtcactcttgtctctagcacacatgcagatatgcttctcatcacagtagataccttaattcagaatgatcctacagaagcagacatccctaccagattgctattgctgtgaatgcaactccgaaggggactggaccacaggcagctggactttacataagttacaacaggaatttctgtccaatggataagcttggcctttatgacatacacatcagaggaaagagttagccaacaggtaggagctactgtgaggctgatttcaaatatgttgcctttttcctatcttcagcctttaagatagtgcaaatctttctattttctccctacctccagctttaagtcccttccagtgattgccaaaatctgaagcccaaaagtggggataggaagaaagcttgacccaaaagtgtccttggatgttgtgaatacaatgcgttcataatttttcttgtcacactgtatcacacactagttctagcttttatgtctcatgatcctccaccagaatgtataaaatttaaaaaagactgtcagtactaacaactgctgttgctgagtggagcagagagaaacagtcttcaccaagccctgcccaggttgtacatctatgagcaaaatgctattgttgctatttgaagccactaagttttaaggcagcttgccacaaagataaggatacctggaacactatgtgtcaagtcactgggcagagacatcatctaatttaatctttaaaacagctgctttggaagatatccctgctttatagatgcagaattaggacttgaaggaccaagatcacattgcaagtaagtggagaaaccagaattcctacccatgtctctctggctgcagaacccacatgcttttgataagtaacactcac

SEQ ID NO: 460426 - DNA, 1926 bp, Homo sapiens
  misc_feature (2)..(3): n is a, c, g, or t
  misc_feature (5)..(5): n is a, c, g, or t
  misc_feature (15)..(15): n is a, c, g, or t
  misc_feature (17)..(17): n is a, c, g, or t
  misc_feature (20)..(20): n is a, c, g, or t
  misc_feature (22)..(22): n is a, c, g, or t
cnnangctctctccncnctnancccttatcccctgactggccctggtgtgtgtttctccccatcatgtccatgtgttctcattgttcaactcgcaattatgagtatatacccagtaatgcaattgctgggtcaaatggtatttctgattctagatccttgaggaatctccacgttgtcttccaatttacattaccaccaacagtgatttccaacagaaccaatcaagaaaatcataaaagagattgtggatatagtgaaaaagacgcaggtggtcaagactttcaagataaggattttggagaaaatcaaaagttaatggaaatgaaaacagaggatttaacaggtgatgacttgatgcagatgaatgcttccaaatcagggccagatgatgaggaagaagagaataagagtctactcagtgtgaagataacaaggatcaagatctttattaaaatgatacacttccacttgaccaataccatggctggagctgtagcaactgggatgcagggagcagtgtcccaaagctgtgcagggcagtggggcagaaaccattctgtcctgctaggactctgggcctgtgataaaaaggctgctgaagtttccaattttccctcatcttgctatctacttctgcaccctccacactcttccaacctgtgcacattatccagttccaaagttgcatccacattttcagtgaataagtctcatgagatctgatggttttataaatgagttcccctgaacacactctcttgcctgctgccacgtaagacatttctttgcatttctttcattttccaccatgattgtgaggcctccccagccatgtggaactaaatgcctaagaattacatcaggagtaaaagtgaagaaaaagactgtaaactgcgtgctaactgctttgaagaatgagaagtcatgccaagcaaaatagtagataattgcaagaaggggactaatggtccatggatggagctggaggccattatctttagcaaactaacagaggaacagaaaaccaagtgagaaccacatgttctcacttataagtgggagctaaatgatgagaacacatggacacatagagggaaacaacagacactggggtctattggagggtggagggttggagcagggagagatcagatctaataattaatatgtactaggcttaatacctgggtgatgaaataatctgtacaacaaccctcatgacacaagtttacctgtgtaacaaaactgtgtttgtacccctgaacttaaaataaaacttgaaaaaaaaaaagaaaataatgtacaacaacgaaaaccaaaaaactcacagattcctggaaaattgaatttaaaaatgctgtaaaacaggaggtgaataggtgaaaacaccatgtataatgttagaaatatttataccagttgttctgtccttaatgcaagtgatacttttattttaactgtattagtttgctgctatttctaaaggcaaaatctgtgtgtaaatattttatacatataaaatataaactattattcaaataatgggacacttttttattcaatatcaatgtcaaagtcttttctttgtgtgcatgtgtgtgcacatgtgcgtatgtgtataaaacagtatattaagttcatttattgcaaataatactttatcacattgatccttttcttcaatctctattgaatcacaagtctgtgaacagattcttgaataaaattattcttttcataatgtctctagtatgtgttatctgtaaatattgcctataacattttatttgtgactatattgtgtttctgtgtctccatgatttctctccttttatagaaagtaaatattttctgtaaagaaataaatgtttagtagtatatgagaacaaaagttagacatctaatgagtgccaaaaatagagcct

SEQ ID NO: 460427 - DNA, 1545 bp, Homo sapiens
ttggtgtggctgttctagaggatcccaggtggacaggggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccattcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcatttacatatctctgcttcatttcttctattaatatg

SEQ ID NO: 460428 - DNA, 2326 bp, Homo sapiens
gagtcagtgctcgcttctgcgcctgcaggatgtccatgtgtctgctggcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcccctcccggcaccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccattcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcatttacatatctctgcttcatttcttctattaatatg

SEQ ID NO: 460429 - DNA, 486 bp, Homo sapiens
ctccaaattccaaggaacaagcgttactgagtccccgcgggcttctttgatcccgcaggtttcatccgcctcccagtgctgggctatatctatcgagtgtccagcgtgagcagtgatgagatctggctctgagccgagggcgagacaggagtattctcttggcctctggacaccctcccattcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccc

SEQ ID NO: 460430 - DNA, 2461 bp, Homo sapiens
gagtcagtgctcgcttctgcgcctgcaggatgtccatgtgtctgctggcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcttctggctacccgggtggaagtgccactgctgggcattgttgtggctgctgggcttgcactgggcaccctcgtggggttcagcaccttggtggcctgcctggtctgcagaaaagagaagaaaaccaaagggggtggccatgggtacggtgacatgcatcccagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccattcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcatttacatatctctgcttcatttcttctattaatatg

SEQ ID NO: 460431 - DNA, 1337 bp, Homo sapiens
accataagactctcctaaaaagtactctcctacccgtttctaatcagttccttccacttcaggcaaccacttctgactcgtatcactatagatagatttgttttcttttgttttcttcctccatctctgacagcttcttgatctgtccccaggtgggtggctgtggttgacgggtgttgctctgtgaaaaagttctaaggtgaaacgaaccagaccccatccctgtcccattgttaccctgaggcatccgagctccccttcttactcaccatggggactgctttaagagtactcgggtgtcctccagctagttttctgttccaagcatcgcttcagcaaccctttgacctggatttgagcccccacgaatggacgccacttgcgcgagaccagctcggtcagggagaccctaacccagctacaactgaggtggaaattaagaagaaaggccctggatctcttttagtttccatggaccaattagcctcctacgggcggaaggacagaatcaacagtataatgagtgttgttacaaatacactagtagaagacaaaggagagaaagaaaaaggaaagaagatgatgacccagggagggaaggaggaagaagctgtagaaagaaagagaaaagcaaaggatgagagcaggaaagggcaaaggggcaagaaagaaggagacaggaggagacagaacaaggaaggaaaggtgaaaaggggagaggagtgtgacttgtatttctaactcaaccatgagctgttctagatttttggaaactgtgactttaagctaaatgatatactgtataacaaaaccagttttaccataggccagttgatataaacaagagttaagttcctatggcatatagtacatcatgtggcttaaagttgctgttttcaagaacctattgaggacattaagtgaggacttactgtatacttaataggtatttgtgaggaagaccatttgaaacgatttaaatttcctgttcattcagattttgatttcttcctttatttatatcagtatggattaatggttttctattttatctgagttacaatccatttgatgtttagacttcctctgatgtggccagtggaaattccttcaagctggcttctgatccctttcacatgtcttcttcacttcctggctttctggtaccacaaggtattccaggatactttcgtgtttttccagccccagggctggaatcagccatttctcaagaagccctgagtcttttagtggaaaaatggcatttagaagtagagatctaggctgagtatcagctgaggcaggaggatcgcttaaagtttgagaccagccttagc

SEQ ID NO: 460432 - DNA, 793 bp, Homo sapiens
ttgtgggaggatggggagggctgtgtgcaaggccccagagttctctcaatccatctgcagagcccccagagtccttgggaaactgaaatcgtgttcggtggctctgaggcaggaacacaagcctgtcgttggcactgtctactgctgcctgggtgtctggggcctccacactcaggcccccatgccatggcacagacgggacaacagcctggcgcgaaatgcccaaatgaaatgggatccagcctggcctttcctggccagccattgccaatgcagctggacaacttggcctgacttcatgtacgcttcccatgcaagaagtccatgtcaggcccagtggacacattcagcttatcgggcaatgttaccagggtttggggcagaaggaacagataaaagggacaattctaaggaagatgattgaaagactgaccccaatgtggagaggatgattccagcactactcgtactgcactaggatcagacaacttgaaatctgcctttgcttttattgggcaatctgttccagggatcacagcccctacctgtaactgtcacctcttttgaggtacaattacattctttcctctcatcccattgcaatgtttccatgctgagagggctccagagagatgtagggaagctctgctagtctctgtgctgaagctcagtgcctggcatacctctgcctttgatgaggctctggcacagccctgcatcattcttcatttgcctgcgcattaaagaatgcccctggtggtcatcagagcgccttgtgtcagaggctttgtct

SEQ ID NO: 460433 - DNA, 1576 bp, Homo sapiens
ctgtgggtcaggaatccaggcacagctgagcggagtccacaggctcaggatctctcaccaggttgcaatcaaggtattggcagggctgcagtctcagctgaaggtttgaacggggaatgatcctcttccaagctcatgagtgtggtttttggaaacattcaatcactccagggctgttggccagtggtcatgctctcagttccttaatatgtgggtctctccacagagtaactcacaacaaggcagctagtttcttcagaataagcaagagagaaaagctggagagaggtagtgccagacaaaagacagtcttttataatctaatattggaagtgacattccatcatttttactgtattctattcatccgaacaaagtcactaggcccggccccaagggggtgtgattacacaggatgtgaataccaggaggagaagataattagggggttatcacagaagttcatctaccaatataataaatatgctgattttattaaagcaacagaccactgccatcggccaaagaactgttataataaatacatagattgacaatgtatattatataaacaatacccactagacttatgtgctatacaacatgccaattatataaggttgtttaggaaagatgctttaaaatctttttcaaacttttattgtataagttttcaagcacttataaaagtaggagataggataacaaaaaaataataaaataaacatgatcattcttgtttcactaataccccaaccctttacccccaaaccactagttattgaaaagcaaatctcagacaccaccttacttcatctttagtaattcagtgtaaatatccacatatcttatgtaccattactcaattaagaataccttaatttcatctactattcagttactgttcaaatttctccaattatttcagaaatgtcttttaaaaaaaaacagttggtttgtctgaaagaagctttaactttaaatgaaacttggagttttaaccattacttaagagcaggcattttaattactgacacagaactattctgtgagaaaaatgacttcaggacattttattatccaggaatcaccagcaaagtgatgggggatgctgaaaattttacccacgggcagaggaagcttcaactcatcaaagccttgccaatggacagtggagaaaacagtgagggtgccttctcacactcaacagagtcccgcttattcaccagggtttgtgactggccatggttagagacaaggctgaaaggaagcaagacaggactgcgaaggtgaagaagctgcaagtggaggtgtctaaatatcatgccctaggcaccaggaccggggcaggaaatcagaaccgaaaagagtatctttctcttgtctgactccatcaagtgaccacacatggaaaactggatttctggtgtggaaggtccccaaaaaaggaaaaaggagagatggtaactgagacccagagaagtgccttcctcgacattccccagctcactctatctgccaggcctttaatgtttccatcattaattcaatcttcaaccatcaccgactgagtgtt

SEQ ID NO: 460434 - DNA, 910 bp, Homo sapiens
accacatccagagctcgctcagctgctgcccagcctcggctgtgaggataggctggctgggcagcacgtctctccccacagggctccctgagaccaccaggaagagcccccaaccaatcttgggattctcccttcgtgcggttgtctgggacctttttccagggtcaaagcagatcgtgaggaggaagctgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccattccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgacccggcatgggctagcagggagaccgcgggcggggttggacggagctgcaagaaccggaatagccagagttggcctgaaggaagcaccgtggacaggcttgtgggcgaggcagaaccccccagccaggacaagcttggcatggtccacgtctggatagggggcacacctgcccggaaactgagaggaacctg

SEQ ID NO: 460435 - DNA, 2178 bp, Homo sapiens
ataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcaccccaagcctgggcttgagctgcagaatgactccaccttctcacctgctccaggaggtttgcagggagctcaagcccttggggaagggggatgccttcatgggggtgaccccacgatttgtcttatcccccccagcctgccccggcctttatgttttttgtagataaaccgttttaacacatagcgccgtgctgtaaataagcccagtgctgtgtaaatacaggaagaaagagcttgaggtgggagcggggctgggagg

SEQ ID NO: 460436 - DNA, 2834 bp, Homo sapiens
ggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggtgaggggctgccggggtggcgggaggctcggagggagccggagggaccgggcgcggttggctcccgggagcaactggagagtgaggagatcctcatccggggaagccccgcggccgcgtctctacagcgccccttctcgggctctggccctcccgctggttattctggacctgggggcccccagctgggacccgagtccggtgcggggagcctagtgggcctgggagctgctatttttagcgggcgcggcgggcgcgaggagcctatttatagatcaaacaatccgcgctccctgcgtcaatggaaccccgcgtgcgtcacgcgcgcagacattccaggccccccctcctcgccccgccccctcgggctccccgggccgcacctccccctggccgcctcccgccggaaccgcaccgccccccgcgcccttgtatggccaaagctcgacgggcggcctgcgtcagtggcgcccccgcccctccccgtgcaggagggtcgggctcggccggggagtcccagtggcggaggctacgaaacttgggggagtgcacagaagaacttcgggagcgcacgcgggaccagggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttgcaagaagatccagggatctggcggccctcaccttctcggcaagaagattgtactgaagtccctacctgtgcccgtgtccccacgtaggccctccaaccccctaggctcgtcagttgtttagtcagctggcttaaaatgcagattcctgggatctacccccagagactcagatctggggaggattgattagtatcaggtttaaatttatatgtacacatatatggtatttaaaatcatgacctttccattccacctaataaatgttatctattatcgttttgggaaataaaagcatgtgttagaaaaatcagc

SEQ ID NO: 460437 - DNA, 2915 bp, Homo sapiens
ggcgggggtcccctcgcggcgcccgggacccccggcctccaggcatgggcgcccctgcggtgcagagcagctcagggccggctggtgcgcgaccccggaaagcgggggtggagaggcgagcggagcccgcggggccaggtgaggggctgccggggtggcgggaggctcggagggagccggagggaccgggcgcggttggctcccgggagcaactggagagtgaggagatcctcatccggggaagccccgcggccgcgtctctacagcgccccttctcgggctctggccctcccgctggttattctggacctgggggcccccagctgggacccgagtccggtgcggggagcctagtgggcctgggagctgctatttttagcgggcgcggcgggcgcgaggagcctatttatagatcaaacaatccgcgctccctgcgtcaatggaaccccgcgtgcgtcacgcgcgcagacattccaggccccccctcctcgccccgccccctcgggctccccgggccgcacctccccctggccgcctcccgccggaaccgcaccgccccccgcgcccttgtatggccaaagctcgacgggcggcctgcgtcagtggcgcccccgcccctccccgtgcaggagggtcgggctcggccggggagtcccagtggcggaggctacgaaacttgggggagtgcacagaagaacttcgggagcgcacgcgggaccagggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcaccccaagcctgggcttgagctgcagaatgactccaccttctcacctgctccaggaggtttgcagggagctcaagcccttggggaagggggatgccttcatgggggtgaccccacgatttgtcttatcccccccagcctgccccggcctttatgttttttgtagataaaccgttttaacacatagcgccgtgctgtaaataagcccagtgctgtgtaaatacaggaagaaagagcttgaggtgggagcggggctgggagg

SEQ ID NO: 460438 - DNA, 1163 bp, Homo sapiens
tgatcgagctggtaccaggtcaggctcagaaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcaccccaagcctgggcttgagctgcagaatgactccaccttctcacctgctccaggaggtttgcagggagctcaagcccttggggaagggggatgccttcatgggggtgaccccacgatttgtcttatcccccccagcctgccccggcctttatgttttttgtagataaaccgttttaacacatagcgccgtgctgtaaataagcccagtgctgtgtaaatacaggaagaaagagcttgaggtgggagcggggctgggagg

SEQ ID NO: 460439 - DNA, 1043 bp, Homo sapiens
atagccaggcaggagttattttatagaatggaagtaatttctacggggccaagcaataataaggaaattggaagtcaaggactatcttccgaatggagaagaagctccatcaaccacagaaggaaattatgatcactcctgccatcctgctcctttgtgtatccaggatgaaggggagaattggagtcttgcacaatgaaaggacaacattgctgccaaaacaatccatcgtgactgtagacatattttccaccctcatcctgcaggttttctgccagttgttggcccctcaccaattttgctcctgggcagtctgaggtggaacataattttgtataaaacaaattatgctcaacctcacttataatcagggaaatgtgagtcaaaaccacaataaaatatcacctcatgctgtttaggattgctgttatcaagtagacaagaaagaagtgttggtgaggtgaaaaacaaaagggatttgaaatacatctgcctggttttcaaaagccaatgtgggtgaggaagggacgcaggaaggaaggttgtcctcgtgacacagggtgaccctcgccattccctgctgaggggaagcagctgatgtttgtggcagagccctaaggtcggggatgttatctccaccccagccatcccctcatgtcatggtgcctgctgtttccacaacctctcctgctaagaagatgaccctagattgccagatccggctagtttcaaaacatgcccaggttctcattgctgcatgttcattgatggggctgagaagagggaaagtggaaaccagaccgtctaggggaattccagaggcagagagcttggggtatttgggaagccagggagtgaaaaatatgtcctgttcttggacacaggggccaatccaaatggcgtgtctttttgtccctgtttgtatgctggcccaggaaagctgccaggtgcttttggtggagcagccagaaacagctctccaaagccctctgacagagactgtggcagcggaagtgatgagtgacaggtcttttctctgaatg

SEQ ID NO: 460440 - DNA, 1217 bp, Homo sapiens
ctctgcagaatgtctggggtcctatgttccaggaacctgtttactttcaaattttccctgtttcagttggactcaggagcatctggtgagccaggtcactctctgggtcttacccttggcttttctcattgcggaaactgccagacagcggtggtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccctccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccag

SEQ ID NO: 460441 - DNA, 3109 bp, Homo sapiens
ctctgcagaatgtctggggtcctatgttccaggaacctgtttactttcaaattttccctgtttcagttggactcaggagcatctggtgagccaggtcactctctgggtcttacccttggcttttctcattgcggaaactgccagacagcggtggtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccctccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccaggtatggcttcccacattcccacaggagccatggcaaaggccaaaggggccaagggaggccactgtccccacaccccatgcttcccttcgagagggggatttgctccctccaacaggacagtttccaggagcatatgttcggtattgacctggtcaagtttcctagctactctctcccctcgcctgtccaaaactccacatatgctctgcccaggaagcagggatgagcggggagagtacacggcatattggtggctccaaacttcctcccaagcgatgctgtctcagatgtgcccctcctgcctcctccgggggcgctgcggttcaggtggtcctgacccagctgggacccacttcacatccccaagccctgccctcccctgtgtggtgccagcaggaggagcggccctcaccacgcccaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccaggtaccccaggggcaggagggacctggcacacaaggcccacctgattgtctaatcccccctgctggggatgctcggcttcttggggagccactctggagtgggaagatgcagctagtggagaagcgcctcctacccttgaaggagaaacagcatgcgagggcagcccctagtcgtggcacagcccggttggactcaagttcttctaagtttgcagctggccaaggagcagagagagacgtccctgtcccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagttcccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttcaggctctctggggccgatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgc

SEQ ID NO: 460442 - DNA, 1850 bp, Homo sapiens
gacggtgaaaaaggatggagatagtgatatgtgtcacaatcagtatttttcacagaaaggtttctaatcaccctgctgggacaaacacctcagtgactgtccactggaacataaatattttattctgtcctttgatagttccagtactggaagtcctcaccaaagcactcaggcaagataaagaaataaaaggcattcaatttggaaaagagaaagtaaaattatttcacttcactgacaatgcaaccttatttctagaaaaacctgaagactcccccaaaagactttttatcttgatatatgactttagtacagttacaggatacaaaatcaacatccaaaaatcatttcctagcagattgtctgtgatgctcaagcagattgtctgtgatgctcatcacatcctggtttcattattcactttcttttctaacttggtaggaagattttctgagttcacaggagattttgttttcacttatatttccatatgcctggtgacaaggacaggatgtctaggacttcccaaattaaatggagcagctaaaaatttatgttcgcacaacaaccagaaaaaccatgcctttcctatgtggataatcagcaaagctgaggacatcgggaagcaactcaggattgccagtttacagctcttctggatgtgcactggttaatgcatggaattcagcaacagcagactttgttcctttgatggatccagaagatcgccacatcaaggaatatggtggtaaaactgcaagataatctgccacccctaacaactatagaagttctaaggatgttagagactcatagagaggaattctaatggccatacttgaaccgttgcagcaatacactcagaagattggtgaaagaaaagaaaggcattttgaaagtgattttcaaaaaacagttaatccagaattccatatttagcaaaattatacttcaagaatgaatgtgacatgataatgtcaatgaaaagaaaaacaaaataatttgtcaccccaaaaaattattgaacaagaatgctaaagaaagtagtgtataacgtatatggctgtgaaatatattatgattaaagcctagaggattttggaagatgtgttaaatgggcatgtgtgtttcaagttttctacatttaaagtaatgctataacatccattgaagtaggctgagaaatgttaagaataaatatcatacctgagaatcagtatctgagagaaaaataatgtgggacatacatgtaattttaaaatatataatagccacgtttgaaaaagcaaaatgaaacaagtgaatttatgtattttatttaatccaatataatcattgcattatctatttaatatgtaattgataaaaataaaatatatatattcttttattttataattaatttttgaaattcagtttgtatttgacccttataacaaacttcaattttgataatttttttaagtagaaatactttatctgcatttgaattcctaaaacttacaggtggaaaggtagcataacatgcctaagttgttcaaacaatttaaaaattttccaatagtgaacttaaatgtaagtttaatatatatttaaaattaaaattaaataaagctaaaaattcaatacctcagtgacaatagccacattgtaagttctcagtgaagatatatgactagtggctcctaggttgaaaagcaaaaatacataactgtatagctaagaagccaataaatgacttaaaaatgtattccaagcaatattcaaataatcaatggaataaacaacatgggaaacagtgaggaataatcataaggatcaggcagaatacaaataatggtcaactctaa

SEQ ID NO: 460443 - DNA, 1094 bp, Homo sapiens
gacggtgaaaaaggatggagatagtgatatgtgtcacaatcagtatttttcacagaaaggtttctaatcaccctgctgggacaaacacctcagtgactgtccactggaacataaatattttattctgtcctttgatagttccagtactggaagtcctcaccaaagcactcaggcaagataaagaaataaaaggcattcaatttggaaaagagaaagtaaaattatttcacttcactgacaatgcaaccttatttctagaaaaacctgaagactcccccaaaagactttttatcttgatatatgactttagtacagttacaggatacaaaatcaacatccaaaaatcatttcctagcagattgtctgtgatgctcaagcagattgtctgtgatgctcatcacatcctggtttcattattcactttcttttctaacttggtaggaagattttctgagttcacaggagattttgttttcacttatatttccatatgcctggtgacaaggacaggatgtctaggacttcccaaattaaatggagcagctaaaaatttatgttcgcacaacaaccagaaaaaccatgcctttcctatgtggataatcagcaaagctgaggacatcgggaagcaactcaggattgccagtttacagctcttctggatgtgcactggttaatgcatggaattcagcaacagcagactttgttcctttgatggatccagaagatcgccacatcaaggaatatggagagatgtccaaatttctaccaaagcaatgctgttctgtccgcagtaggcagtttgtgtggaggtccaggggcccagccaggttgcagctgatgattctgtagaaaggcctaaaattaattttagaaaagcatactcaagacaatagactattattacacggataaaaaatataagaataaagagtgtaaacacgttaccaaagtgaattcttgaaatggaagagaaacttggccttctttagcttcaccatttgttcctgccttccacctccaataatagtatatgtctcaatccttgtctatactccaaatttgaattgtataattaaattggttaaaacttacaa

SEQ ID NO: 460444 - DNA, 1910 bp, Homo sapiens
acttctccccagaccccatacctagaatgaaggtattggttttgtcaaaaccggcattcatgggatttgactttcatcctgcatatcacctcctaatgcctgcaggatatggaagtcatcgggaagtgcaggcactctgtcagcagaaaaatgggagatgggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattgctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagataaactagatgacaccagctcctctgaaggaagcaccattgatatcaaaccagaagtagaagaggtccctgtggaacagcctgaggaatacttggatccagatgcctgcttcacagaaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtaccattaaatttgtctggcttaatttaatggggacttctgggacctgcagagactgtaaagggcgagggtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaa

SEQ ID NO: 460445 - DNA, 426 bp, Homo sapiens
tactactactaaattcgcggccgcgtcgactgagcaagcaacctgagagagagagagagagagagcaaggaggaagccgcaatgccttttaagaactagtctgagaggccacacaccatcacttctgccctattctattaattagaaatgcatcaagtccagcctatacttatggagaggggaattaagctctatctcttaaaaggaagattgtcaaagaatttgtgaatacatttaaaatcaacacaaagagaaaaggaacaatcttagtgattcctttcaaaggaaaccataagacattggtacagatagtttatttcggagatgatcccagaaagcacaaattagaaattagagaattagaaattagagaattagaaattagagaaattagaaattagagaaagtgacacagggaagggagaa

SEQ ID NO: 460446 - DNA, 1889 bp, Homo sapiens
ccccgccgaccatgcgccgcctcccgcgggccctgctgctgcagctgcgcctcgccctgctggtggccgcgggggccccggaggtgctggtcagcgcgccgcggagcctggtgtgggggcccgggctgcaggcggccgtcgtcctgccggtccgctatttctacctgcaggcggtcaactcggagggccagaacctcactcgctctcccgcaggtgaaacaccattcaaagtcgtagtcaaatctctttcacctaaagagttggtccggatacatgtccctaaacctttggacaggaatgatggaacatttttgatgagatataggatgtatgaaactgtcgatgaaggcctgaagatagaggtcctttatggtgatgaacatgtggctcagtctccctatattttgaaaggaccagtgtaccatgagtactgtgagtgtccggaagatcctcaggcctggcagaagactctttcttgtccaaccaaggaaccacagattgcaaaagattttgcttcctttcccagcatcaatctccagcaaatgctaaaagaagtccccaaaaggtttggggatgagagaggtgccattgttcattacacgattctcaataaccatgtttaccggagatctttagggaaatacacagacttcaagatgttctctgatgagattttgttatcattgacaagaaaggtccttctcccagatttagaattttatgttaatcttggagattggcccttggagcatcgaaaagtcaatggaacccctagccccatacctatcatttcatggtgtggctctctggattcaagagatgttgtccttccaacgtatgacatcacccactccatgcttgaagccatgcggggtgttacaaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaaggaaaatgatgaagaagccaagaagattgcaaaagaaggacagttgatggctagggacctactacagccacacaggctttactgctactattaccaagtactgcaggtacattgccagctggaaggaaattgctacaagcaactcttcggctaacttcaaaggatagcttgagtggcctcataacatggctgagcaagcaacctgagagagagagagagagagagcaaggaggaagccgcaatgccttttaagaactagtctgagaggccacacaccatcacttctgccctattctattaattagaaatgcatcaagtccagcctatacttatggagaggggaattaagctctatctcttaaaaggaagattgtcaaagaatttgtgaatacatttaaaatcaacacaaagagaaaaggaacaatcttagtgattcctttcaaaggaaaccataagacattggtacagatagtttatttcggagatgatcccagaaagcacaaattagaaattagagaattagaaattagagaattagaaattagagaaattagaaattagagaaagtgacacagggaagggagaa

SEQ ID NO: 460447 - DNA, 1050 bp, Homo sapiens
gatactcggttctagcatctcaacagaccaagacacgctccaatttgccaatgtttgaagcaggattgtgttacttcaagtttattagtgttttgtttattccatcatctgttagctccctgcagcatttttagaaggtaccaaataagaaaaacgtggatgaagatggagaaagcatacaaaacttttacacactggtttgaagggcaagccgttgtacattccttgaagtcaggtgctctgctcaacagaaggtgtgctgaataacgttacaggctctgttcccgggagacgtggaagctgtcaccgcgcggaacataaagaacaggccaagaccagtgcaggcatcgacgactttctccattcagagcctccgcgcatcccaaataaataaacacatcaaaacgtgcaaatacttccttaagttttcttggttccgatcgccctgtttaggcctcttgcgggtgttatttttcacaaaatgtcagtgaggaaaagaacaaactgtgctacacgcacacgcgtgggccgcagggctgggcagggcacagagggagaggcaaaccgttcccaggcacccctggatctcacggcatccccgaagtccgctgctgtgggatctgatggtggaggcagtagggtcatgggatctgagaggggttgtaagtcatcaggggggtcttcctccccacagcttggaaacttattattcgtatacaaaagcagtgagttcaacaacagcagcagcatgtgtccaaagcaattcagtggaagaaaggatctgggccggactcagcagcactcacaccaacaagcatgggtctgcagagcctgcagccagtcaaaagccatacagaaatggctggccctgggctccggtgtggatcagtgggctcgcggggagccctgggagagggtctgtgcagttttcactgtgaaaacgctgctagtacacacataatcctgaaaggaacggggaagagaggagattgtacagctacaggcaagagctgtgctgtttcagagatctcccagcagacgtccgagcac

SEQ ID NO: 460448 - DNA, 439 bp, Homo sapiens
  misc_feature (428)..(428): n is a, c, g, or t
  misc_feature (430)..(430): n is a, c, g, or t
gatactcggttctagcatctcaacagaccaagacacgctccaatttgccaatgtttgaagcaggattgtgttacttcaagtttattagtgttttgtttattccatcatctgttagctccctgcagcatttttagaaggtaccaaataagaaaaacgtggatgaagatggagaaagcatacaaaacttttacacactggtttgaagggcaagccgttgtacattccttgaagtcaggtgctctgctcaacagaaggtgtgctgaataacgttacaggctctgttcccgggagacgtggaagctgtcaccgcgcggaacataaagaacaggccaagaccagtgcaggcatcgacgactttctccattcagagcctccgcgcatcccaaataaataaacttctggcctcgttggcatcagcggtggagctntnccggccagg

SEQ ID NO: 460449 - DNA, 355 bp, Homo sapiens
gatactcggttctagcatctcaacagaccaagacacgctccaatttgccaatgtttgaagcaggattgtgttacttcaagtttattagtgttttgtttattccatcatctgttagctccctgcagcatttttagaaggtaccaaataagaaaaacgtggatgaagatggagaaagcatacaaaacttttacacactggtttgaagctgtcaccgcgcggaacataaagaacaggccaagaccagtgcaggcatcgacgactttctccattcagagcctccgcgcatcccaaataaataaactgtagcaggtataaatcggataaaatgatgagggcagtcgcaaacattgaggag

SEQ ID NO: 460450 - DNA, 1755 bp, Homo sapiens
aggagaagagggcaggcccgcagccgccctccggaggaggactcggggcctcgcgggcgccggaggaggttcctgggcctcggagggccgccccggcgcgccgccccggcgcgagcgggcgcgggcgggggaggggaagtgagaggttgtttatgaccggggactaatctcctccgcgagtcccagcgctccctctggggagtgcggttgaggggctgtcctcgcacggagcctcgctcggcctcgggggagccacgagaggtgggagttggacccgcagcgggccaggagccctgtcattggaggacccgccaaaaaggaagcaaaccctctttttctttatccaaccccaaatagctagggcctagggggaagactcacatatcgataaatggtttgttgcccgttttattctctgggaaatacaactgatcttaccaaagaaataacctgtctcttgccgtgtttacttagagccatagaatacctgtttcagagctgaaggggacctgagcccatgataatccattacctcgtgagaaagcggaaaaactgacttcagcttgcccagatggcgcagagaatgggtttcccgtaaccccgcctgtgtctttccttcagcctcgtcccaaatgccgtgggagggaaggcactctctgtcaagctgctgtcaccttacctgaagtaaggagtccacgcctgcatgtccgaggaaaacagttttctcaaacacattagttgaaaaactgaagacgctgcctaaaatacaagctgagttagagacagcccttgtaagactaggtctggttgttaaaaagagcctgggacctttctcccgtttccctcttgcttcctctctcgtcatctgacataccactctctttccccttccaccatcattggaagcttccaaaagcagaggctcgctctttccttgcctaacgcagccatggcttgtggtcccaagaagcatctgaagtgagtagcagctccaaagcactggatgctggataaattgaccagtatgtttgctccttgtccatccaccagtccccacaacattgacaagacagaagagaatttctctctgatctatgacaccaagagtctctttgctgtacatcatattacacctgaggaggccaagtacaagttgtgcaaagtgagaaaaatctttctgggaacaaaaggaatccctcatctggtgactcatgatggtcgcaccatccgctacactgatccccttatcaaggtgaatgataccattcagattgatttggagactggcaagattactgatttcatcaaattcgacactggtcacctgtgtatggtgactggaggtgctaacctgggaagaattggtgtgatcaccaacagagagaggcaccctggatcttttgacattgttcacatggaagatgccaatggcaacagctttgccactcaactttccaacatttttgttattggcaagggcaacaaactatggatttctcttccctgaggaaagggtatccgcctcaccattgctgaagagagagacaaaagactgccaaacagagcagtgggtgaaatggtcccagggtgacatgttagatctttggaaagctgtttaacatatcggagcctctattatttcatggtaaaacaagaataataacttccttattgaattaatatatggggaatgtccatgcttgcagttttgcaaaacacatagcatagtgtgaaaaatgtacctaatactattaa

SEQ ID NO: 460451 - DNA, 868 bp, Homo sapiens
agcggcgtccgcgcgcgcggggcggccgcggcggtgagcctgcgcgtcagggccgctggcctctccttggctgttggagagccatagaatacctgtttcagagctgaaggggacctgagcccatgataatccattacctcgtgagaaagcggaaaaactgacttcagcttgcccagatggcgcagagaatgggtttcccgtaaccccgcctgtgtctttccttcagcctcgtcccaaatgccgtgggagggaaggcactctctgtcaagctgctgtcaccttacctgaagtaaggagtccacgcctgcatgtccgaggaaaacagttttctcaaacacattagttgaaaaactgaagacgctgcctaaaatacaagctgagttagagacagcccttgtaagactaggtaggtatttacagggcctctcccactagctttgtttttccagagtttgttctttatccggaaattcttaatttgcctactgatcatttaaagaaagggttctattaacattgacacagaagagacactttgtggcactttttaaaaatctgagtctcgtgacttggtataacttctgaaacttactgttaatttatagcagagctatttgagtaatatgctcttctatgagtatgaacaatagaagaagtgtgatttttaaagtgatttggactacaaaataagagcatggaatataggctttacagccagtacttgctgaggatgtactgtgtattaggtgtggtgcatataaaaaataaataaaatgtggtccctgtcttcaaagagcttatgttttctaggaaaatgctacatattactagctactccaaggcagaaagttgttagacaccaaatcag

SEQ ID NO: 460452 - DNA, 1254 bp, Homo sapiens
aggagaagagggcaggcccgcagccgccctccggaggaggactcggggcctcgcgggcgccggaggaggttcctgggcctcggagggccgccccggcgcgccgccccggcgcgagcgggcgcgggcgggggaggggaagtgagaggttgtttatgaccggggactaatctcctccgcgagtcccagcgctccctctggggagtgcggttgaggggctgtcctcgcacggagcctcgctcggcctcgggggagccacgagaggtgggagttggacccgcagcgggccaggagccctgtcattggaggacccgccaaaaaggaagcaaaccctctttttctttatccaaccccaaatagctagggcctagggggaagactcacatatcgataaatggtttgttgcccgttttattctctgggaaatacaactgatcttaccaaagaaataacctgtctcttgccgtgtttacttagagccatagaatacctgtttcagagctgaaggggacctgagcccatgataatccattacctcgtgagaaagcggaaaaactgacttcagcttgcccagatggcgcagagaatgggtttcccgtaaccccgcctgtgtctttccttcagcctcgtcccaaatgccgtgggagggaaggcactctctgtcaagctgctgtcaccttacctgaagtaaggagtccacgcctgcatgtccgaggaaaacagttttctcaaacacattagttgaaaaactgaagacgctgcctaaaatacaagctgagttagagacagcccttgtaagactaggaaaggccttgtgaggacataaccaggaagagagtcctcaccagaacctgaccatacctgcaccctgatctcaagcttccagcttccagaaccatgagaaatcaatgtttgttgttttagccacccagtctacagaaatttgttatagccaccctagctgactaccacattggacatcacagcaaacactacaaccagtaagtctctgcttgtattaactggaacatttccaaagcctgtcctactcaggataaatgcacaaaagaaaaattagtagttgacggcagaattcttaagagagcagttttgcattttttaccaagtaatacttatttaacttctagggcagtaaagtaagagaaattgttactctccacctcctgccatcatgaatttaggaaatgtagaaagttattctgttaataaagatgtgaacttgctgttgaagagaaa

SEQ ID NO: 460453 - DNA, 1848 bp, Homo sapiens
tacttctcactactgccacaaatatcaccatgctcaaaggcaccattatctctcctctggattacagaagtagcctcttaacagtaggcatactgatctcttcacaatgtaagatcatggcacttctcttctcaaaactccccgacagtttcccattagccagagcaaaagccaaagtctctggagtagctaaaagctcctgtataatttatgtgctccttttttgcccctctggtggtttgccttgtttcgccctgccttgctcacttcgcttcagccacattggccttgttgctgttcctcacacacaccgtgcatgccccgccacacatgccttacctgttgctcctgttggttcctttgcctggagtactcttcctcaagaatgtcctccttgccttcaagtctttgctaaatgttgccttctttgttttatttatttatttatttaagatatgatcttgagctgtgtcccaggctgcagcaggaaaggcctagagctcataaagaacatagctttgcctcttcataaattctagtcacatgcatcaaacatgctttcagaatacatatgaacttgcttctgctgcacacttatgaagcaaccaccaagtctcccaaccttagaagttgcaaatgtattccttttcattctcagtaagcttttaaaatatttttttcccttggtgtccaatgtaaacatattgcaattaactttgggaaaaaaaacaagattctttaaatatattgcattcatatgcttaaaatgtaggttaccaatatagttttaattttttatagaagatacaaacaataaagtgccgctgatagaccctgaaggaggtctgcctctcccaaaggcagacggcaaacaatataggctacagacacaaacactgggacttcgtattaattgtgctgccacacaaagggggtgtggtttggggttgaggggctcactggccagtttttccatgtttctcaaataaaactctggtgtcatcaagaaacatggtggagggagacatgaagactttagagacaggaaccactgcagaaatatcaggagatggggaggcagaggaaagaaaggagagatctgtggatcccgtgagcaccccaaattggaaccactccttaccgtgtctcaaggaagcaacagacctccaaactgcatggtgtacctcaaaagagcaagacccaagcaaaaagaatgctgcctgatttcctgacattaacaatgaacacagccagactcaagaggaggaagctactgggaccacggcagtcaaggaaacaccatcaacacccagtcttcctcccacattactcagagacttttatctttgccatccttaaacacattcctgcaggtctccagatcccttccagcccatcttagataaaactgtgcaggaaaaatgtgcttctaatatagaggtttccatctggacaccttgtatttgaatcacaactcaaacttttttaatgccaccctctgtttccctactggatcttaaagacaattggcactgaagcataataaaataatcaattatgtctcatctatgctatgctatttgagagcatttccctcaaaatctcttctatactttgatttaaaagtaagatttataccaaaaagccaatgaatgaatattaatgtgatattttagatgatatctaatgaaaaatctcaaatatcatacaatgtaattaatttatattcttaatataccagtttctcaccaactatgagaatttgattcctaaaaatccccttggtagaagaattcagattcgtgaaataaaagatcttacagaaaaagaatattagtagttaatgtt

SEQ ID NO: 460454 - DNA, 1425 bp, Homo sapiens
tacttctcactactgccacaaatatcaccatgctcaaaggcaccattatctctcctctggattacagaagtagcctcttaacagtaggcatactgatctcttcacaatgtaagatcatggcacttctcttctcaaaactccccgacagtttcccattagccagagcaaaagccaaagtctctggagtagctaaaagctcctgtataatttatgtgctccttttttgcccctctggtggtttgccttgtttcgccctgccttgctcacttcgcttcagccacattggccttgttgctgttcctcacacacaccgtgcatgccccgccacacatgccttacctgttgctcctgttggttcctttgcctggagtactcttcctcaagaatgtcctccttgccttcaagtctttgctaaatgttgccttctttgttttatttatttatttatttaagatatgatcttgagctgtgtcccaggctgcagcaggaaaggcctagagctcataaagaacatagctttgcctcttcataaattctagtcacatgcatcaaacatgctttcagaatacatatgaacttgcttctgctgcacacttatgaagcaaccaccaagtctcccaaccttagaagttgcaaatgtattccttttcattctcagtaagcttttaaaatatttttttcccttggtgtccaatgtaaacatattgcaattaactttgggaaaaaaaacaagattctttaaatatattgcattcatatgcttaaaatgtaggttaccaatatagttttaattttttatagaagatacaaacaataaagtgccgctgatagaccctgaaggaggtctgcctctcccaaaggcagacggcaaacaatataggctacagacacaaacactgggacttcgtattaattgtgctgccacacaaagggggtgtggtttggggttgaggggctcactggccagtttttccatgtttctcaaataaaactctggtgtcatcaagaaacatggtggagggagacatgaagactttagagacaggaaccactgcagaaatatcaggagatggggaggcagaggaaagaaaggagagatctgtggatcccgtgagcaccccaaattggaaccactccttaccgtgtctcaaggaagcaacagacctccaaactgcatggtgtacctcaaaagagcaagacccaagcaaaaaggttaaagaagtccacaattcctcaacaaaactttgggaccagacacatttcgggattcagaactttttgggttttaaagatataagagtaagtgttctttatattattacatggcaactccaatgcagtactctgtaataaagcaccctgatatttctacagaaacatttattaaagtttacattgaataaaatccgatgcggccgcttccca

SEQ ID NO: 460455 - DNA, 1370 bp, Homo sapiens
tacttctcactactgccacaaatatcaccatgctcaaaggcaccattatctctcctctggattacagaagtagcctcttaacagtaggcatactgatctcttcacaatgtaagatcatggcacttctcttctcaaaactccccgacagtttcccattagccagagcaaaagccaaagtctctggagtagctaaaagctcctgtataatttatgtgctccttttttgcccctctggtggtttgccttgtttcgccctgccttgctcacttcgcttcagccacattggccttgttgctgttcctcacacacaccgtgcatgccccgccacacatgccttacctgttgctcctgttggttcctttgcctggagtactcttcctcaagaatgtcctccttgccttcaagtctttgctaaatgttgccttctttgttttatttatttatttatttaagatatgatcttgagctgtgtcccaggctgcagcaggaaaggcctagagctcataaagaacatagctttgcctcttcataaattctagtcacatgcatcaaacatgctttcagaatacatatgaacttgcttctgctgcacacttatgaagcaaccaccaagtctcccaaccttagaagttgcaaatgtattccttttcattctcagtaagcttttaaaatatttttttcccttggtgtccaatgtaaacatattgcaattaactttgggaaaaaaaacaagattctttaaatatattgcattcatatgcttaaaatgtaggttaccaatatagttttaattttttatagaagatacaaacaataaagtgccgctgatagaccctgaaggaggtctgcctctcccaaaggcagacggcaaacaatataggctacagacacaaacactgggacttcgtattaattgtgctgccacacaaagggggtgtggtttggggttgaggggctcactggccagtttttccatgtttctcaaataaaactctggtgtcatcaagaaacatggtggagggagacatgaagactttagagacaggaaccactgcagaaatatcaggagatggggaggcagaggaaagaaagcgtgagcaccccaaattggaaccactccttaccgtgtctcaaggaagcaacagacctccaaactgcatggtgtacctcaaaagagttaaagaagtccacaattcctcaacaaaactttgggaccagacacatttcgggattcagaactttttgggttttaaagatataagagtaaatggcaactccaatgcagtactctgtaataaagcaccctgatatttctacagaaacatttattaaagtttacattgaataaaatccgatgcggccgcttccca

SEQ ID NO: 460456 - DNA, 2407 bp, Homo sapiens
gtggggcacaggcggacggagggccaggagaaggggctgtgctgccagcaggcagtgctttgagctctaatggatgaacattgctaaccagcgaaggtggagagagggcacccgtctgagaagatgaagaggcagcaaagcacagctggcctcggggaaccggaagccacagggacatcaggctgtgtgctgctgtctgtcggccaccagctgggggactatcctggacctggaagggcatccctgacactccccaccagatgccaggggcacccccagccccaggtgagaaccacggatcccatggcgaatgaggtcagcctgtgggaagtggggctgggactgctctgcacagcttaataggaaagttgggttctatttggtggggttttggtcatgccaatggctggtcagggctgtccgtgaggaactgatttgaggacaagttagagaaggggctgccgaggccagtggggcactcgctgtctgggtctaagaaaaagaaaataaaggctggtgatgtgacagttggtgggagcacagacggaaggaactggcggtggagacacacggttggccctgcacagggctacggtagctacctgggggtcatcctattaattctcctcatggtcccaagaggcggctgtgaggatccctctcctgaggacaaaactgctccagagccacacagaaccaagatccgggccaactccaaagcgggcgatcttgacccctcacccgtggtcctgaggcagggatcggagccccctggacacacagacactcccaccttgctgaagataattcgctttctcatccgtgaaagaataaagtcggactaactcatctccacactcacttccaactctaacaacctgtgttaggaaatcaaaggtaaggactctgaccacaaacccaagaagcaaaacccgagactcacggaacgacgccaccattgcagttcccagcttgactagttgtttttcttttctggtctgttctgctcttttggtttaaataattaaagatccttgttgacaagtaaaaaaaattctttatgaagctaaaaaaagtgctgtcttgaaataatggtgaaattttaaaattagttttgtacttaaacatgtccccaaagtgaagcacagcggccaacgtccgtcacggtgccgagcagtgccagccgctctaccatggccgacggcctgattcccaagggctgcgtccaggggccaaaggtacaagcggccagcactgtaactggaaaccacgcgggcaccagcgtgaactcagacccgacagccagcaccgtaactggagaccatgcgggcaccggtgtgaacccagactccacggccagcaccgtaactggagaccatgcgggcaccggtgtgaactcagacccgacggccagcaccgtaactggagaccacgcgggcaccggtgtgaacccagactccacggccagcaccgtaactggagaccacgcgggcaccggtgtgaacccagactccacggccagcaccgtaactggagaccacgcgggcaccggtgtgaactcagacccgacggccagcaccgtaactggagaccacgcgggcaccggtgtgaacccagactccacggccagcaccgtaactggagaccacgcgggcaccggtgtgaacccagactccacggccagcaccgtaactggagaccacgcgggcaccggtgtgaacccagacccgacggccagcaccgtaactggagaccacgcgggcaccggtgtgaacccagactccacggccagcaccgtaactggagaccacgcgggcaccggtgtgaacccagactccacggccagcaccgtaactggagaccatgcgggcaccggtgtgaacccagactccacggccagcaccgtaactggagaccacacaggcaccggtgtgaactcagacgcaacggcaccctcctgggctgctccagccaccaccagaacccgttctgcagctgaactcgaagctgattctggaaggaactgaggaggatgaggacgagatccttctacctcaaccgggatcaattttttaatgatttctttcttttagaaaaatgttaataagatactttgttctaaaatgaccaggatttcagcagcttctacatttcttcatgtcaatcaaagcttaggcacgtgggttacttcactgttctctgtaccctttccaaataaaacccggggccgcctgtgtacccaagagcctgggcactgagcagagagagaaaacgtccagggcaacagcgttcacattccggcggtgccatagagcagacggggggagtccgaggcggtgccgcagagcggacgcggggagtccgaggcggtgctgcagagcggacgcggggagtccgaggtggtgcc

SEQ ID NO: 460457 - DNA, 556 bp, Homo sapiens
ctcagggtggagaccgcagccttgatcaggcccagcctcactgctgggcacagcctgaggatcgccatacatgatgctgaggtgtcccaacgttggggtgcccagagccactcagccgagaatgtggtgctttctgtaactgccctcatttctttacagtatagatctggactccatcctttgcaatgtgtggggttctaggaagaggccagccagccgtggaagtgtcctgggctctgtcccggagacgacgaacttggctccccacgagggcggcctattccccacagtgtcccccgggggccacacctgcacccaccttgctgaagataattcgctttctcatccgtgaaagaataaagtcggactaactcatctccacactcacttccaactctaacaacctgtgttaggaaatcaaaggtaaggactctgaccacaaacccaagaagcaaaacccgagactcacggaacgacgccaccattgcagttcccagcttgactagttgtttttcttttctggtctgttctgctcttttggtttaaataattaaag

SEQ ID NO: 460458 - DNA, 2059 bp, Homo sapiens
gtggggcacaggcggacggagggccaggagaaggggctgtgctgccagcaggcagtgctttgagctctaatggatgaacattgctaaccagcgaaggtggagagagggcacccgtctgagaagatgaagaggcagcaaagcacagctggcctcggggaaccggaagccacagggacatcaggctgtgtgctgctgtctgtcggccaccagctgggggactatcctggacctggaagggcatccctgacactccccaccagatgccaggggcacccccagccccagtatagatctggactccatcctttgcaatgtgtggggttctaggaagaggccagccagccgtggaagtgtcctgggctctgtcccggagacgacgaacttggctccccacgagggcggcctattccccacagtgtcccccgggggccacacctgcacccaccttgctgaagataattcgctttctcatccgtgaaagaataaagtcggactaactcatctccacactcacttccaactctaacaacctgtgttaggaaatcaaaggtaaggactctgaccacaaacccaagaagcaaaacccgagactcacggaacgacgccaccattgcagttcccagcttgactagttgtttttcttttctggtctgttctgctcttttggtttaaataattaaagatccttgttgacaagtaaaaaaaattctttatgaagctaaaaaaagtgctgtcttgaaataatggtgaaattttaaaattagttttgtacttaaacatgtccccaaagtgaagcacagcggccaacgtccgtcacggtgccgagcagtgccagccgctctaccatggccgacggcctgattcccaagggctgcgtccaggggccaaaggtacaagcggccagcactgtaactggaaaccacgcgggcaccagcgtgaactcagacccgacagccagcaccgtaactggagaccatgcgggcaccggtgtgaacccagactccacggccagcaccgtaactggagaccatgcgggcaccggtgtgaactcagacccgacggccagcaccgtaactggagaccacgcgggcaccggtgtgaacccagactccacggccagcaccgtaactggagaccacgcgggcaccggtgtgaacccagactccacggccagcaccgtaactggagaccacgcgggcaccggtgtgaactcagacccgacggccagcaccgtaactggagaccacgcgggcaccggtgtgaacccagactccacggccagcaccgtaactggagaccacgcgggcaccggtgtgaacccagactccacggccagcaccgtaactggagaccacgcgggcaccggtgtgaacccagacccgacggccagcaccgtaactggagaccacgcgggcaccggtgtgaacccagactccacggccagcaccgtaactggagaccacgcgggcaccggtgtgaacccagactccacggccagcaccgtaactggagaccatgcgggcaccggtgtgaacccagactccacggccagcaccgtaactggagaccacacaggcaccggtgtgaactcagacgcaacggcaccctcctgggctgctccagccaccaccagaacccgttctgcagctgaactcgaagctgattctggaaggaactgaggaggatgaggacgagatccttctacctcaaccgggatcaattttttaatgatttctttcttttagaaaaatgttaataagatactttgttctaaaatgaccaggatttcagcagcttctacatttcttcatgtcaatcaaagcttaggcacgtgggttacttcactgttctctgtaccctttccaaataaaacccggggccgcctgtgtacccaagagcctgggcactgagcagagagagaaaacgtccagggcaacagcgttcacattccggcggtgccatagagcagacggggggagtccgaggcggtgccgcagagcggacgcggggagtccgaggcggtgctgcagagcggacgcggggagtccgaggtggtgcc

SEQ ID NO: 460459 - DNA, 895 bp, Homo sapiens
aagagactgagaaaagaccccaagataggggcagaaccaagaatgctgtcctccaagacaacggaaggaagcatttgccacatgacaaatgatgcgggtgggatcaagtaagacaaggacagaaaatagaccatgacatttagctatgtggaaatcattgatgacatagattagagcaatttcagtgaagtgatgaagtgaaagtttaaatttgatggtttaaggaaaggatgggaggatagaaatggaagatagtgtatacattggtcgtctcttaaaaataataatccaaactggaaacaactcaactatcccatcaacagtttttatttttagtagagatgatgtcttgccacattgcccaggctggtctcaaactccaggcctaaagggatcttctgactttggcctcccaaagtgctgagattataggatcgaggctatcaagctacagatgatcttacaaatggaaccccaaatgagctcaactaacaactaccaaggacccctggaccaacccgctggccctttcaatggcctaaagagttcccctctggaggacactacaactgcagggtcctttctttgcccctatccagcaggaagtagctagagtggtcatcacccaattcccaacagcagttggggtgtcttgttaagtgggggagattgagaggtgaagccagctgggcttctgggttgggtggggacttggagaacttttctgtctagctagaggattgtaaacacaccaatcagtgctatgtgtctagctagaggttgtaaatgcaccaatcagcactctgtaaaaacggaccaatcagcactctgtaaaatggaccaatcagtaggatgcgggcagggccaaataagggaataaaagctggccacctga

SEQ ID NO: 460460 - DNA, 826 bp, Homo sapiens
cgtcgacgcgagaagacgacagaaggggacagacaggctgccagccctcagcatggacccggcacatggaatctgtgatcttaaaagagtcaagtgactacctttggcaaccaaaagagacactgccttttagaaggcatatcatctgaaactggctgaaagagctgtcttacttaggaagaaaaatctctcctttggaaagagctggaacttttagaggggagagagattccttttcctcagccgggcacagagccaacctgaagtgtagcactgtggtgacctggcgggatctgctctccagtcactcccgagggcccttctggggacaaggagacttttctgtgcggcctgttgatttgagatcgaggctatcaagctacagatgatcttacaaatggaaccccaaatgagctcaactaacaactaccaaggacccctggaccaacccgctggccctttcaatggcctaaagagttcccctctggaggacactacaactgcagggtcctttctttgcccctatccagcaggaagtagctagagtggtcatcacccaattcccaacagcagttggggtgtcttgttaagtgggggagattgagaggtgaagccagctgggcttctgggttgggtggggacttggagaacttttctgtctagctagaggattgtaaacacaccaatcagtgctatgtgtctagctagaggttgtaaatgcaccaatcagcactctgtaaaaacggaccaatcagcactctgtaaaatggaccaatcagtaggatgcgggcagggccaaataagggaataaaagctggccacctga

SEQ ID NO: 460461 - DNA, 816 bp, Homo sapiens
cgtcgacgcgagaagacgacagaaggggacagacaggctgccagccctcagcatggacccggcacatggaatctgtgatcttaaaagagtcaagtgactacctttggcaaccaaaagagacactgccttttagaaggcatatcatctgaaactggctgaaagagctgtcttacttaggaagaaaaatctctcctttggaaagagctggaacttttagtaaaactgaacagtgaggtggcggaagtttttatttttagtagagatgatgtcttgccacattgcccaggctggtctcaaactccaggcctaaagggatcttctgactttggcctcccaaagtgctgagattataggatcgaggctatcaagctacagatgatcttacaaatggaaccccaaatgagctcaactaacaactaccaaggacccctggaccaacccgctggccctttcaatggcctaaagagttcccctctggaggacactacaactgcagggtcctttctttgcccctatccagcaggaagtagctagagtggtcatcacccaattcccaacagcagttggggtgtcttgttaagtgggggagattgagaggtgaagccagctgggcttctgggttgggtggggacttggagaacttttctgtctagctagaggattgtaaacacaccaatcagtgctatgtgtctagctagaggttgtaaatgcaccaatcagcactctgtaaaaacggaccaatcagcactctgtaaaatggaccaatcagtaggatgcgggcagggccaaataagggaataaaagctggccacctga

SEQ ID NO: 460462 - DNA, 1266 bp, Homo sapiens
cgtcgacgcgagaagacgacagaaggggacagacaggctgccagccctcagcatggacccggcacatggaatctgtgatcttaaaagagtcaagtgactacctttggcaaccaaaagagacactgccttttagaaggcatatcatctgaaactggctgaaagagctgtcttacttaggaagaaaaatctctcctttggaaagagctggaacttttagtaaaactgaacagtgaggtggcggaagataaatatgctgaggcatgttttcaaggaggggagagagattccttttcctcagccgggcacagagccaacctgaagtgtagcactgtggtgacctggcgggatctgctctccagtcactcccgagggcccttctggggacaaggagacttttctgtgcggcctgttgatttgactcagaagattacacactaaccagtccactttattaaaccgggaatggtgcaaaccatttatcaaccaacaggacacaagttggtgaattctcctgctaaattggtttgtgcggttcgcaacacatcaattcctagaactactggatggggcattggggctgcccatgctgcaggggcagaacgctgggcacttggttcaaaaccctggtcacccctccattgctttggacagcgactcaccttattattgcagcaagctagacatgcgcaaccactcgtatttgaacgtgacgacatgtgcccttgctcgcatcctggccatattggggacgttaaccacgaacatgaattcacccgggcttgcgggtattgggccaaaaatactgggttatggacaacaagtcttattcgtgaccagtatggaactgggtcagaattgccatgataaacacagtgtgttgatatgccaaaatacaagtccaattgtgatggtggtgaagagaacctccggtgaaagagtgacacgaattacgggaaatatgtgtctaatgtgggcaatgttgtgaacgcccagttttggtgacattgaatgctggcaatgattgtagcaagaggggtcgttttcaactggagaaacccagtgtgtgatagtgtgagtataagaatttaggagacttagaatgttactcagactgataaaagagaccctatggacgataaatgtagtggagaattgtggcgtgctatgagaaaaagagtagcagataagaattgagcggagatagtgtacaaagagtgatcatgacatgttgaaagaagtgtattgtgtaagaaaagcgattgaatt

SEQ ID NO: 460463 - DNA, 881 bp, Homo sapiens
cgtcgacgcgagaagacgacagaaggggacagacaggctgccagccctcagcatggacccggcacatggaatctgtgatcttaaaagagtcaagtgactacctttggcaaccaaaagagacactgccttttagaaggcatatcatctgaaactggctgaaagagctgtcttacttaggaagaaaaatctctcctttggaaagagctggaacttttagtaaaactgaacagtgaggtggcggaagataaatatgctgaggcatgttttcaaggaggggagagagattccttttcctcagccgggcacagagccaacctgaagtgtagcactgtggtgacctggcgggatctgctctccagtcactcccgagggcccttctggggacaaggagacttttctgtgcggcctgttgatttgagatcgaggctatcaagctacagatgatcttacaaatggaaccccaaatgagctcaactaacaactaccaaggacccctggaccaacccgctggccctttcaatggcctaaagagttcccctctggaggacactacaactgcagggtcctttctttgcccctatccagcaggaagtagctagagtggtcatcacccaattcccaacagcagttggggtgtcttgttaagtgggggagattgagaggtgaagccagctgggcttctgggttgggtggggacttggagaacttttctgtctagctagaggattgtaaacacaccaatcagtgctatgtgtctagctagaggttgtaaatgcaccaatcagcactctgtaaaaacggaccaatcagcactctgtaaaatggaccaatcagtaggatgcgggcagggccaaataagggaataaaagctggccacctga

SEQ ID NO: 460464 - DNA, 1677 bp, Homo sapiens
ctgccagcacgctgtcacctctcaacatgatggcaccactgcactccagcctgggcaacagaacaggggtcgccaacccctggactatgaacctgtccatagcctcatctcagcaggaggtgagaggtgggcaagagagtgaggcttcatctgtatttacagccactccccatcgcttgcattactgccggagctcttcctcctgtcagatcagtgtggcattagattctcagagaagcgcgaaccctactgtgagctgtgcatatccttcttggcattcctgtggagcaacccttcttcctggatacaggacagtcaaggcaggccactgtgcaagcacaaacttccaggaaaagcataaagataagacaatgaaggttgcggagatgacagtggaggatgatggtgggccagcactggtggaggctgtggctgctgctaaggagacggaagtggagaagatggcactcgagacaatgactaaggagatgacggcagatatgatcacaatagacccaatggctgctgaggcagaggtccgtgagcataggccagggggtggagctctagccgaggacctgcccttctccacccaaaacttccctgacccccctcccgtttcaaatccaatggccacagcaggtgaggtggctgcagcccaaggacaacaggccttattattgttggggaggcagcagctgctggtgcggaggagatgataaagttgatgtggccataataactggaggggggaggagggataagagtacaatagagggttgtgtgacacagacaggctgccagccctcagcatggacccggcacatggaatctgtgatcttaaaagagtcaagtgactacctttggcaaccaaaagagacactgccttttagaaggcatatcatctgaaactggctgaaagagctgtcttacttaggaagaaaaatctctcctttggaaagagctggaacttttagtaaaactgaacagtgaggtggcggaagataaatatgctgaggcatgttttcaaggaggggagagagattccttttcctcagccgggcacagagccaacctgaagtgtagcactgtggtgacctggcgggatctgctctccagtcactcccgagggcccttctggggacaaggagacttttctgtgcggcctgttgatttgagtaggtatagcctttctgctagccaccagacacagctctataagaatttactctcaactatcccatgaataagaaaacacttagggaggcttttacctatccatgaatagttacttctgttcaacagtcctacaaatgttttcgaatgcctgaagtgtgccagacatgtactaggcaacagggttagaaaagtgtgggaagcttggtccctggcctggagaactttagttcagtggggagcttacagatattccccccatacctttcagagcatggatgtttacaaagttgtcaaagagtattttggtgtgctttggcaatggtggatctagtgttgtgggccttctaaaaatatgaaatgatgaattcacaattagttataaggttttgaaagggattaatacaaatgggtggggtggggtggatgggaggaaggtcctgaaatagttttattaacttggtagtaaataatttctggatttgaggagtattaaaagga

SEQ ID NO: 460465 - DNA, 699 bp, Homo sapiens
cagcttgtgaaaatgtgtgttataatgctgttaaatcaatggcataacattgtctaccctttagaaaactctttgtatcatgtatcttttataaaatttaagtgtattgcttttaagatagcaaaagcagaaatagtcctcaactgtttttccgagtgttgccacttctacagcatctacactcatctgattcacttgggttgtagatttcatttttatgcatctctgcaaccttttctcttcttcaacacctgtaaaaaaaataataaaaacgtgcatatctattatcttaatatttatttggcttctagtaaaaatagtttttcctgtatcccaatatttgtgatttgttatacaaacaaaagtaggtcaagtgagaaaagggctcagaattctcctgaagaacttctacaacttcctcatgaacctattgattatgtttcagaagaacactattgcaaacaaataaaagaagatctctgggaggtatgatgccattggacagcattttacacacagtggaacttctttccaaatcggaatcaatcctctgaaagcctgccattgctttatgaagtaaacttatggaatattctaaatcttttgtcatttcaacaatattcacgacatcttcaccaggagtagattccatttcagagacccctttcttcgcttattgtaagaagcaactccttatcc

SEQ ID NO: 460466 - DNA, 907 bp, Homo sapiens
ttctatttgcagctgcacctgacccttgaaaactgggaaagtgtcggttttgcctattctgatttcattccttgggagatgatgtttaaattccgggcaaacatccttcgcgattgcaggaggaggtaaaaaactgaggctcagtgaagttaagcaacttactcaaggtcaggcagtcatgaagctgggattccatcattcatctattaattcaaaacacttttgctgagaacctatgtatcgtgccctatgttaggtgttgggaaaacagcaattaagacagtgtccttggcctcataagccttacaatcaagtgggagaaagtaaacaagtcatcaaacaagataaccgctagttataatcactactgttaagtaaataaagagttatgtgatcaagagtaactggcatgggatagggagagcttctctgaggaggtggggaaagattcacctgaggagacgagtcaagaacaagctctctgattctagagttcttgaccactatgttgtattggcctataaaaattgtaccatctccaaaatctgcccttaggggagaatggattagagggggaaacctgaggcagggcgtcagaaagactgactctagcaacgtggtaattcaggagccgaggatggtggccaaaggaaagatgtgcccacatcccccactcccctggaaggcaagtcccagccatggcagaagtggagtagagaaggagccatctgattttccctggatatctctagtcacagagtactcaccatcgaatgaggctggcagccccattccaggttcaatttgcctccttgaaactttcactcttcattccaaatgctctcctctgtaactccaaaggcaaagtctgctcactcttctacatgacagcccttcaaattcttgt

SEQ ID NO: 460467 - DNA, 1991 bp, Homo sapiens
agcagcagtggatggttcaggttgggaagaagagcagtgggattgccagttaaggttgtggaatcaaagagcaaaggctgttgtgaagtggaatatcaggctcaaatggaggtccctcccgaatgagcactgacacctgtgtgcccggacatccacgagggccccaacacctgtgctcctgacagctccatgcactaagcagggcacagtctggatccagggactgactgtctctggcattgagcggttggtaatcaataccccaccctccctgttctcagtcacttggggacaaaaaagaaagcctgcagaacacgactgctggcccacctgccagagtagccaaggaaacaggatgcccgctaaagcatgttaaggaaggtgtggagcagctgctgggaactgtcttgatttaaaggaagacatggaggactgctgtatgctaccgtattacacggcccaaagcagccccgcaatgggcatgtttaacacctccatggggaagctgcagcggcaactgtacaaaggcgagtatactatattcaggtatgcacccatgtttgagagcgactttatccagatcagcaaaagaggagaagtgattgacgtgcacaaccgtgcccgaatggtaacaatgggcatcgttcgcaccagcccctgcctcacactacctgatgtcatgctgctggcccgaccagctgctgtctgtgacaatgccaggtgtggtcctgccacccagaaaagagaaagtccgcctgcagagatcttagaactaaccaggctgcttcccttgatgtttgtgaaaataaccatccacaacagcgtaaaaaaacagctccacctgaagcttgccacgggccgctctttttatcttcagctgtgtcctccatcggatgcaagtgaagacctttttgttcactgggaaaaccttgtttacatcctgagaccaccagtggaggcttacagtgataccagggctatcctagctgggaacacattggactcatctgtgttggaggaagtgcagaggagcccagtgggatatgccatgaagttttgtgaagagaaggagcaattcagaatcagtagacttcacatgaatgctgaaatgtttgggtccacctattgtgattatacaatagagatatgaatccaacatacctcccacatatactacgttcaagagttcacacacccctgcagtcataaaacctatagtgcctgatgaaggggcagggtagcaacagcagtagtgatgacagtttgaatcacagcattgccacacattaactgtgagtttcagtagattgtttctttaaatggtcaccttgagaccatacatgtataatatctggaacatagtaggcactgtgtaaatggtagtgttgagaaacaaattctgagtttaatcatactttccagaaagggcttaattttcccagtctcttcattcttgatttcctttcttaaatcttaattaactgctttgcaattgtcccataaaagctctatttacagtaaatcttctcagtatcttccaagaattttaatcccctgacgctatttagaattctaaattttcatgaatttgtagaaatttcaatctagttacaatggaaagataattgcaaagcactcatcttttacctggttctctccaattttagtattcttggagatagaaaaataaaatgtaatataggatcaattcataatctggacaaaaactggaaattagatcattttagaattgtaagatccacatccatgggattagccaatattctaattttgcaagtaaaaagtctgctcgagtctaaagtaatacatcacatggtttgagaaccagaatgtataggtaacctggcccccaattatgtctgtattgtttccataacactcatgattctgacaagcactgtgctttgaatataaaagatatttgatacatgtttgctggatccaattaagggctataaatgtgaaatata

SEQ ID NO: 460468 - DNA, 984 bp, Homo sapiens
gattctgcgattcgagagacagtcccgcacaataaaggattaccccgcggccctacaatcttggagagtcttcctatacattcctgaatgcaactacatgtaaatcaaggcttgattgcacttcggtttggaggtttaccaagaattgttcaccatttgggaaaaccacgcgcttcactggccacgctgctcctggtcccggagacccaacaatctgcatttgctgccgtcacgttcaggcgactccccaggcgcggctactggctacttctctacattttccaagggtagtagtgccaagcattttcagattgaaatatgtactttcttacttattgctttccttctatttcctctttatgctacaggtgggaagtcggtactgggttgcagggggctgggaaccagctccgcagccaggagaggctgcagacaccggaggatcgggttctgagagagacgcatacggacttggggccgggggtgactcgccgggaactgagggcccgcgaccctcccgcccaaggccgcccctggaagcggccgcgggtgagtggcaagacgcttacccgtacccgacctccgcgtgtggagcgttgccatagagaccgacgcgccctggacgctacacccacacagcccaggacgctaggccttttctgggccgcccccgccgccccaggccgaaactccatccctttcccccaccctgccgagctcccgaagccctgtggcggctccgggcaagaactaagggcggcccctgcaagcgtacctgctccgccggctccgcggggccaacgaagctagcgctccccgctcttgcttaaggtgcaccagacgcttcgcaaacgttctctcttttctttacaacccgtcaaggcagtagtctcccagttttacaaatgagctaaactgatacaggaagagtgtttcttgtacaaggtctcaaatattgccaaaaggtggacgtgagactggaac

SEQ ID NO: 460469 - DNA, 3488 bp, Homo sapiens
tttaggggagcaggttatgcaggaagttgtccagagggcagtactagcggcagtgcccgcggggatggaggcagggaggggggacgatggcgggacgggtggcgccggggttccagccctgcgcctgctccggagcaccgggcccctctcgctgaccccctcgtcccaggaccccgcaggcccgagtgcctgggctcgtcctctttcgcgcccgctgccaggtgccagggccgcgcaggcgggcggaggtgggcaggaagcgccacgccgaggagccgggactctgggagctagcgggagacgcaggtttcgtcccaagccgacccctctgggccgcggctgacggctcccggaactgggcatccgcgggtaaaggcctagcgggcttgataacccttgcgccatggctgggaggccgcgctgagcggggggcagggcgggccgggggaggaggctgtgcaagggccgcggggagatcccggccgagaacgagagggacggagctgggcgctgaatggcgggcgttctggcaagtctccccctgcgttcccgaggccacccgaaagtaggagagctgtttgggacccagtttggtggaggagctctggacctgtaggaacaccgcccctgacagaagtcggtcctaggccccccaggctctgaccttctttcccaggatgaggtggggccaccatttgcccagggcctcttggggctctggttttagaagagcactccagcgaccagggcctttatacgccaccaccgaagctcggtagatagcgctccccaacccgggggggatggacgctgtttccccagcgcttatgcaattgtaaagggactgagtgggacctggtcacggggtgtggtgggcaaacgggctggaaggagaagcaggaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccggaggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggcattcgagctgctcatccccttctcctgtgaggacgtgtcatccgtgggccgtgccccagcctccatgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcacgtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtccggatgccctgaggttttccctggccccatgtgaatacctcgctgccctctacattgtgctgggtttgcgcaagacgaccctgcaaaaggtgggcaaggaagtggctgagctcgtgggccttgttggggaggacgtcagcctggtactgggcatcatggccaagctgctgccactgccggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacagggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctaccaattgtggcctcttctttactgcctggtgcttccaagaaagggcactgttcttggtctttctggtt

SEQ ID NO: 460470 - DNA, 722 bp, Homo sapiens
tgcctccatccccgcgggcactcgggaggggggacgatggcgggacgggtggcgccggggttccagccctgcgcctgctccggagcaccgggcccctctcgctgaccccctcgtcccaggaccccgcaggcccgagtgcctgggctcgtcctctttcgcgcccgctgccaggtgccagggccgcgcaggcgggcggaggtgggcaggaagcgccacgccgaggagccgggactctgggagctagcgggagacgcaggtttcgtcccaagccgacccctctgggccgcggctgacggctcccggaactgggcatccgcgggtaaaggcctagcgggcttgataacccttgcgccatggctgggaggccgcgctgagcggggggcagggcgggccgggggaggaggctgtgcaagggccgcggggagatcccggccgagaacgagagggacggagctgggcgctgaatggcgggcgttctggcaagtctccccctgcgttcccgaggccacccgaaagtaggagagctgtttgggacccagtttggtggaggagctctggacctgtaggaacaccgcccctgacagaagtcggtcctaggccccccaggctctgaccttctttcccaggatgaggtggggccaccatttgcccagggcctcttggggctctggttttagaagagcactccagcgaccagatgatcgtatccccttccttgatca

SEQ ID NO: 460471 - DNA, 741 bp, Homo sapiens
ggcaaggcccgacctgaagcactggctccagccttagggaaggttttggccgtgggttttgttggcacgtaccattttgctgaaagacagagcaccttgaggacgttatccctaaaatgagagaggactgggattgaaaggctgactacagaaatggctgctgcccagacgccctcaaaagccaaggatcctcagagttggttataaaatatttaagggcgagaaaaggatcgcaggagccaggccctgagatgagcttggagtccctgtttcagcacatcatcttcaccgagcatcaggcggaggagagtcgccgtttgatgcgagaagtaaggtcggaaataaccagatgtcgtgaaaaaattaagaaagcaacggaggagctgaatgaagagaaaatcaagctggaatctaagcttttgaaagctcatgaaaatgctttagaaaaacagtacagtgaaattacaaaccataggaatatgcttcttcaaacctttgaggctataaagaaacaaatgatagaggaggaagacaaatttattaaggaaattacagactttaataatgattatgaaataacaaagaaaagagagcttttgatgaaagaaaatgtcaagattgaaatatctgacttagaaaaccaagcaaacatgttgaaaagtggtatgaataaatatcacctcatttgtcttgcattaatgaaaataacttattttgaatgaatgaattttccaaaaattt

SEQ ID NO: 460472 - DNA, 1645 bp, Homo sapiens
ggcaaggcccgacctgaagcactggctccagccttagggaaggttttggccgtgggttttgttggcacgtaccattttgctgaaagacagagcaccttgaggacgttatccctaaaatgagagaggactgggattgaaaggctgactacagaaatggctgctgcccagacgccctcaaaagccaaggatcctcagagttggttataaaatatttaagggcgagaaaaggatcgcaggagccaggccctgagatgagcttggagtccctgtttcagcacatcatcttcaccgagcatcaggcggaggagagtcgccgtttgatgcgagaagtaaggtcggaaataaccagatgtcgtgaaaaaattaagaaagcaacggaggagctgaatgaagagaaaatcaagctggaatctaaggttcaacagttttttgaaaaatccttcttcttacagcttttgaaagctcatgaaaatgctttagaaaaacagtacagtgaaattacaaaccataggaatatgcttcttcaaacctttgaggctataaagaaacaaatgatagaggaggaagacaaatttattaaggaaattacagactttaataatgattatgaaataacaaagaaaagagagcttttgatgaaagaaaatgtcaagattgaaatatctgacttagaaaaccaagcaaacatgttgaaaagtgaaatgaagtcaatggaacatgatagtagccagttaaatgaacttcaaaaacaaaagagtgaattgatacaagaattatttactctccaaagaaaacttaaagtttttgaagatgaagagaatgaatccatttgtactaccaaatatctagaggcagaaaaaataaaaatcagtgaaaagcctcaaaatgatacagaatgcttaagttttatcattgctggactccacaagagaaagcctgtggggtccactgctacctttaatgaagaggaagaagaaggaggaagaggagaaggaggaggaggaggaagtggaggagaaggaggaggaagaaggaagaaggggagaagaagaaggaggagagaagaaggaggagaaaagaaggaggaggagaaggagaaggagaagaagaagaaggaaggagaaaaggaggaggaaagaagttgtccaaatctgtgtaaagcttacattgtattatgaaatcctcttgagttttgcattcaaagttaacatatctatttgccgttacttcaccttattcaaaatggtcatatggtggctttcgaatgaggcagacgtacagttctattctggcccggcctttcctgtgtggccttgggctggttacttaactcttatggatttcagttttctaattggtaacaaaataaataaaatgacacccattttgttgggctgtaacagctgcagcataattctgaagatatctacatgctcagtgaatcctgatcattttaattattgttgggcaaagacagtatggaatagataaagtaccttagcatagtattagttttttagtgttgctctttatatacaaaatgaacttattagttcatatactttgatctcgtgctttgaatcaccagaatttcatatgtgtggcttatttcctagacccatgatatacttggctgtggtggagg

SEQ ID NO: 460473 - DNA, 777 bp, Homo sapiens
ggcaaggcccgacctgaagcactggctccagccttagggaaggttttggccgtgggttttgttggcacgtaccattttgctgaaagacagagcaccttgaggacgttatccctaaaatgagagaggactgggattgaaaggctgactacagaaatggctgctgcccagacgccctcaaaagccaaggatcctcagagttggttataaaatatttaagggcgagaaaaggatcgcaggagccaggccctgagatgagcttggagtccctgtttcagcacatcatcttcaccgagcatcaggcggaggagagtcgccgtttgatgcgagaagtaaggtcggaaataaccagatgtcgtgaaaaaattaagaaagcaacggaggagctgaatgaagagaaaatcaagctggaatctaaggttcaacagttttttgaaaaatccttcttcttacagcttttgaaagctcatgaaaatgctttagaaaaacagtacagtgaaattacaaaccataggaatatgcttcttcaaacctttgaggctataaagaaacaaatgatagaggaggaagacaaatttattaaggaaattacagactttaataatgattatgaaataacaaagaaaagagagcttttgatgaaagaaaatgtcaagattgaaatatctgacttagaaaaccaagcaaacatgttgaaaagtggtatgaataaatatcacctcatttgtcttgcattaatgaaaataacttattttgaatgaatgaattttccaaaaattt

SEQ ID NO: 460474 - DNA, 1760 bp, Homo sapiens
tagtgtctgacggcagagtaaaggatgggtgtgatgagcctggagagactgacacggaggttcattagaaacatcttccgtgacagctctgacgcggcaccgatttctgagtggagcaaaccaaggcgctcggggcggcgagaaccgcgacacagcgcttcgcctggactggtaaacaaaccgccgcgcaggcgcaatggcaacaggacggtaacctgggtagccgccaatgggctttttcgtagagtgaaaagcggaaaagccaaacaaaacgctggttccaaggtgataaactggctgacttcctctatttttacttttttaaaaaattttgtttctgaagaagtagttgtgcggccttctgggcctcgcagagatcttcttcgtggaattcctcggccccagagaaatgccgctagcctcgcgcaaaagtttcaaaactttccgcctagtgagaggcggtccgatttggcccttggggagtgtccgtcgcgttgatctgatggattcacgtacacaacaccacattctatgagattttgcaggcaaaagtccacaagctcgatatatgggacacctgcaccggcattggatttggccccgcaacatcttaaaggaacaacctaatacataccccttgtctgcctgatccctggggaacatgctgtcctgtgatgctgaagcctgcagctggtgaactcatggtgaactcgtggcccacctttggattcagacaaatctcccagggagtattggccacctcccctggcagactcagtacccctggcccctgctgtggggttaccttgtcttggttgtggcaggcctactggctgttagttcagcatcatccttcaagagaacagaaaggcttagaataattgattgtcatatctgtgtctgaccatgctattgtggacttggcctgaacagccatagaaatgcaaggaatgaggtttgagggacttgggcagttgtctcaaaaagggagtcaaggcagaaatcccttaccctgagcactgctctcaacatggaggaagcaggctgtgagccaaggggaaggcagaggacagaaatgaatgtgtttccaggctttcctggtggtttatggcattctccaaactcctatgcaagggctattcctgaccaagaagatctaaagagaacgtctctgaaatcaagtccggatgaagatctctgtagtaaaacgctatgttactatggtgaccaattgatgtctcaagaaaaaagaaatctagaattatatcatgggttttttaaaaaatcgaacgtagaaacactcttccatcctagaacctagcaaggccagcctaagcatattttctttaaaagcacctacctagttctcaaaataaaatagattaaaaacttctaaaactatgtatataaattataatatcaaactgactggatttattttttaaaatgatattatacctaaaataagggaataggtatcttttgcaaattattttaggtttttaagggtaaaagaggagatttgctaataactttttttaactgctagaaatttctgaggtataaagatttcctttttttgatctgtgtagatttccttctggcctttgataataaaagatgactgatctgattcctataagctatggaaaaactaagaaaagttaccagttcccttcagggtttcattgcgcagtactttaagacgtaattgtgtcccctacaatattgaactttagtcttttagcttaagcatttga

SEQ ID NO: 460475 - DNA, 5044 bp, Homo sapiens
atcaaactagttgctatctgatgactgcctgtcacctgctgaaaagaaattgtcccacctagtgtgtctgtaatgagaggtggagcctttaagaagtgattgctttatgagagctatgcctcctgaatggattaatccacggattaatgagtactcacagaaggggaactggtggctttataagcagagaaagaaagacctgagccagcatattagcaagctcaactcccttgccatgcaaatatctgcactgactcagggctctgctgagagcctcaccaacaacaagaccctccccagatgcgacccctggaccatggtcttctcaaacatgcggtctctggaccttggacttagcccccataactgcgtagagagtagtaaagagaactgcaaagaacataagagcacagagagaaagtacagccactactttctggactgggctggaacatgcgaggcaaacttgctccttctccaggacttagacccagcctttgtagaggaggacatggccatggctactgaatatcacaaaggtgtctgtagttctctgatggcagaactggcaggaaatctgctctccagggtgccagaaaaagctactcatgggagcatatctcactggtggcactttactccaaaccactttactccaaaactacccaagaaagagtgccagaggaatctgctggcctctgagttctgtcctggagaaattgcctgttctgcaagaacacaagaaagccacatatgctgccagtgtggagcactggacaaggcatgcatttcactgaaggcaccagaaaacccccctggtgccaaggggagcacactagaacctggagagaaggtccagcaggctccaacggtcaggaacctaggtcaggacaggcacacctgctttcccgcccaaacttcgcattttccaagaccaccctggctctccatgcccccattctgggcctataaaaacccaagacccttgcaggcagatacacaagtggctggacgtcctaatgaacaacacatcaggggaagaagacacaagcgctggtcatccataggagcaccccagcagaaggacacgctgacaggcacccggaagccaccccgcgagggggaggagggagcctttgccttttcaactggagacatcgaccgggatcctggaaggtgagtgtgtatgaattgcgaaactgtctggtcttcctctcttctgaaactctgccacctctctctctttcctgtgagtaagagactctgtttcccttcagggagttttaaactgccctaaccggccgtcaaaacccccagactttaattataaaataagtaatgaacaattcttaatcagttataataacaatgataaattatgttatttatatattaagttacaaatataggctacaaacaatgagtgcatatttctgtaagcaaatatgctataggattttaaaataaattacctaatttaattattggataagttttattaactattattataactattccttaggtgaaggcatagaggctctgaaagttcaaattatttgctctactaaccaatatacattttcaattatgaattggaaaatgtatgtctaaggaactcagtactaaattttttttcatgtatcaagtgcatttttagtatataaggagaatatgcattatatgttggcaagaagatgttgggataaatcaggaattattttttatcgatcctggtctagatatactttatatgtattgttactttttttatcctgacaatgaagcctgtgaataagaaaaccattaaccgtcagagaaaaaagccattcacaggtatatagtcatctattttaattaagcatattatatttaattaaatatagctaatagaattttctaaattttaccttttgttttcagtttagagaccaccaagaaaacaatgaaataaaatttacagatttatgccaattatttgttagaaatgccacattggaaatgaaagccacaaatatcagtactaacatttatgcatgtcaatatctaagaagcatctgaactctcttttttatattttgcttgaagtgtcagagaataccttcaacaaagttgatggaaaaagttctctcgcgtattgattagacgtacataaataggaatctcatgattggagaatagaggatactaatgcgtaggctatctcccatcttcccactcaagttaatcacaacttttttctttagttaactcctcctttgtattcagaagtgagtttagtcgtctcctaaatcttttctcttgcctccttgatttgttcaaatacctttatgccatcataagaatattcacttcttcttcaaagctttttcttagttataatattacatgcatttttcctaatcaacctgaagatgacgaggatgaaaacctttctgatgatccacttccatttaatgaatagttcaaagtgttgcaatgtgtacaaaataagaggagtgtctgtgcctttgaaaggtgaatgtttgtagaatctcaaagtttagaacaaatattacctatgcaacaaaaatgacatctgctaagtaagcctacaaaatactactaaacaacaccaaacacatttcttcataataaaatgaaatttgactagaattgtaagtggtgttttgcttaataaaatctcaatgtcagaagttattacaaattctgtcttttgtgtttttcacttggaattatataggacatatttgagtcaccctgatattttccttgaattgtcttattttttatccaagtactaaaataaaaagaaatagagatttcatattaaatgttattatatggctgtttttagattgggatagatggaatttattcatattaaaagcaaatcatgtgtaattattttatgttagggaaaatgagtaagatctttgaaaaataaagctcacaaggcttaatttgctgcttctttttacatcctttctgtttaccaaagtgtcttcaatatatgagtgtttctgatgaaaatagacatatagatttaaaatcatttttaaagatcctaaaatataggttatataacttctaaaatactgtttgtgcttcctgaaaaaaattagattaatgtacctttaactctgagaatacaaatattaacagagcatttcagcatactatatctggtctacataaggagcaaaatgattttcactgacatccaactggttattcaacacatacaaatctgctgcctctagactctggtaaagtttccgttctataaatggtcattagggtgttatgtgaataaaggctttttaaaaaatggtggcctgaaattgtttttgtaaataaagattatttctcaacagagaaatccactatagttgaaataggtactctctctcttattggtgaaatttgtcaggtattttaatgtgaaaagaaaaataaaataatagaatactaattttatttgttcatgtaatagtacctgcttttggaatctggtcaacaagataagaatgccctaatcataaacaattgtacagagaagctgatatgcatttgtaagattgctgcttctattcactggcattttaaaaattgtgagaaaatattggtggtaatatgttataatcaagactttgagcaattatgtatgtaacttgaatatccaagacaatgtccccataattttgtaataagtgtgcatgcacaatatcaaacatatagttatgcatgtatatggatatgcatatacttttaaattttaactttgtaagtttaacgttagtactaaacctatcatttatatggcttttctaccagttggaaaatgagcttctcaaagacagattgtgttttatttacctttatgtttactggacctaccttctctttcatatagcagttactcaatgagtaatttttaggaaactgcatattcacaaaacggtaatatttattttttaaatattttaggacacagatttaaatgaacattgttcacaatttacctggcaaacattgaagtctgtccttcagttgccttttaaaacattaattttcatcttatgaataagtctttaatgtacttcacaattaattctgatctttactactacataactttaaatttatttcactaaataaatctttcatatattttaattccaaattatgggcttaagtatactgttgcttccttacattccacaacattcccatttaaatcccacattattaatcaagacatcaatttccttacaagttcttaaaaaaatggttttctaacaagtgagaacgtctacagtggttattgtctacatggtgaattgcaggagaagaagtttttaaagtgtggggactttacagaaacacttacatacttgggttgaacgctcacttacactatgaacagtgcagcaaaggctctgggtgttaatatatgacagtgcagcagcatcatttggggaaaagcagaaatgttattcttaaaggagaagtttatttggcctggcttaaggcaagatgatgatgtatactaatgagaatgaccaatcttgtgatcttttaataccactctatctgtatcctggagcaagttacaaaacatctcagaacattctgaacattatattcctgatctttagaaaagaaataatactacctgatattaataatacttatcttgtagtttgctgttagccttagaatcaaaacatgaagtcatttgtactttacaaaagccaaatctaaaaatagcattaatttctaatgtaatcattatcattattcattttggatttgtgtagtcttgtatatttcataaattatatcattaacttctgtcactttccacatggcaaatataaaatgtttcctcattttcaaaaagtcatgttttagttgtgtcttttttctatttcattttcttttaaagaaaaaagtaatgttacactgattcattttaattctctgtgaaacattatctgaaattgccttttcagggaaggttcagtctgtactttttttt

SEQ ID NO: 460476 - DNA, 2684 bp, Homo sapiens
tctaggaatctgataaccaaaagttctattcacctcaacctaatcaacctgaagatgacgaggatgaaaacctttctgatgatccacttccatttaatgaatagttcaaagtgttgcaatgtgtacaaaataagaggagtgtctgtgcctttgaaaggtgaatgtttgtagaatctcaaagtttagaacaaatattacctatgcaacaaaaatgacatctgctaagtaagcctacaaaatactactaaacaacaccaaacacatttcttcataataaaatgaaatttgactagaattgtaagtggtgttttgcttaataaaatctcaatgtcagaagttattacaaattctgtcttttgtgtttttcacttggaattatataggacatatttgagtcaccctgatattttccttgaattgtcttattttttatccaagtactaaaataaaaagaaatagagatttcatattaaatgttattatatggctgtttttagattgggatagatggaatttattcatattaaaagcaaatcatgtgtaattattttatgttagggaaaatgagtaagatctttgaaaaataaagctcacaaggcttaatttgctgcttctttttacatcctttctgtttaccaaagtgtcttcaatatatgagtgtttctgatgaaaatagacatatagatttaaaatcatttttaaagatcctaaaatataggttatataacttctaaaatactgtttgtgcttcctgaaaaaaattagattaatgtacctttaactctgagaatacaaatattaacagagcatttcagcatactatatctggtctacataaggagcaaaatgattttcactgacatccaactggttattcaacacatacaaatctgctgcctctagactctggtaaagtttccgttctataaatggtcattagggtgttatgtgaataaaggctttttaaaaaatggtggcctgaaattgtttttgtaaataaagattatttctcaacagagaaatccactatagttgaaataggtactctctctcttattggtgaaatttgtcaggtattttaatgtgaaaagaaaaataaaataatagaatactaattttatttgttcatgtaatagtacctgcttttggaatctggtcaacaagataagaatgccctaatcataaacaattgtacagagaagctgatatgcatttgtaagattgctgcttctattcactggcattttaaaaattgtgagaaaatattggtggtaatatgttataatcaagactttgagcaattatgtatgtaacttgaatatccaagacaatgtccccataattttgtaataagtgtgcatgcacaatatcaaacatatagttatgcatgtatatggatatgcatatacttttaaattttaactttgtaagtttaacgttagtactaaacctatcatttatatggcttttctaccagttggaaaatgagcttctcaaagacagattgtgttttatttacctttatgtttactggacctaccttctctttcatatagcagttactcaatgagtaatttttaggaaactgcatattcacaaaacggtaatatttattttttaaatattttaggacacagatttaaatgaacattgttcacaatttacctggcaaacattgaagtctgtccttcagttgccttttaaaacattaattttcatcttatgaataagtctttaatgtacttcacaattaattctgatctttactactacataactttaaatttatttcactaaataaatctttcatatattttaattccaaattatgggcttaagtatactgttgcttccttacattccacaacattcccatttaaatcccacattattaatcaagacatcaatttccttacaagttcttaaaaaaatggttttctaacaagtgagaacgtctacagtggttattgtctacatggtgaattgcaggagaagaagtttttaaagtgtggggactttacagaaacacttacatacttgggttgaacgctcacttacactatgaacagtgcagcaaaggctctgggtgttaatatatgacagtgcagcagcatcatttggggaaaagcagaaatgttattcttaaaggagaagtttatttggcctggcttaaggcaagatgatgatgtatactaatgagaatgaccaatcttgtgatcttttaataccactctatctgtatcctggagcaagttacaaaacatctcagaacattctgaacattatattcctgatctttagaaaagaaataatactacctgatattaataatacttatcttgtagtttgctgttagccttagaatcaaaacatgaagtcatttgtactttacaaaagccaaatctaaaaatagcattaatttctaatgtaatcattatcattattcattttggatttgtgtagtcttgtatatttcataaattatatcattaacttctgtcactttccacatggcaaatataaaatgtttcctcattttcaaaaagtcatgttttagttgtgtcttttttctatttcattttcttttaaagaaaaaagtaatgttacactgattcattttaattctctgtgaaacattatctgaaattgccttttcagggaaggttcagtctgtactttttttt

SEQ ID NO: 460477 - DNA, 6541 bp, Homo sapiens
  misc_feature (2)..(2): n is a, c, g, or t
  misc_feature (4)..(4): n is a, c, g, or t
  misc_feature (6)..(6): n is a, c, g, or t
  misc_feature (8)..(8): n is a, c, g, or t
  misc_feature (12)..(12): n is a, c, g, or t
  misc_feature (2009)..(2009): n is a, c, g, or t
gncntntnattnagtttcttaaatgacgaagaggccaggaagatccttcaggtgctggaaaggaatgaggagttacagagggccgagaaggacaggatcagcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccancagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaaaacaagaaggaaagaggcaaaaagttgcaaagtgaaaccctgcatacttcattgatgcttcagagaaaaaatgtatccgaagaaaaatctgaaaattgtcaacaatccattaattcaagtaacagtggtccctctagtcttccagctctttcagaagttaatattggaaattcccaaactagaagaagttcttgggagtgtacagggagtggtagagccattccatttactggaagtggcaagtgtccccagaaagatcacacatccacagctgtaggtgatggctccagtggatcacagcctagggaaggcagaggggacattggaaccaactgccaaaaaatgactaataaaacactttctcactcagagagtcaagtctttgcccttactccagcattgcataaactacagcttggtgaggagactcagtcagatgaaccaaacttagagagtctgcagtctgaaccaagagaattacctcaaagaagtcaggaggcaaatatgacagagagcaggaaggctgaagatgaaatgcagaagtcagcttgggatcaaccttcacttcctgaaggaaacaaaaataaaaccaacttggatgacctagtaaagggggaaaatagatcttcagttaaacacagattggcagccatgtctaaagccagcagaaaattcccagctaaagatgtaagccccagaagacatgtagctactatcttcccccaaagtggaagcagatctggctttgaccatttatctcttggcacagtggagtgcaacccactgttccctgagcctactccaaaatctgcagagtccattggcgaaagcaggttgagtgagaacagaaagcatgtgaagaaatccgagaaccttctccccattactgtactacccaacagagaaccttctacacacgtcagcaaccagaagtctaacagcatttcacaacgacatcagaatgagtttaaaaacgtctcagaatcaccatcaaagcatgagaattctaaagacgtcacagcagctcagaatttagtaagagaatcaggagccccatcacccatcacattcaccagcctcagggaagcagaattctctgacaatcagaggaggctgagccctccttttccactggagcctgcacagaaatctagagtaagcagtccactggccagttttctgcagcaacaaaggagtgcttcatctctggagtgggaacctgagccacacctctatcgttcaaagagtttaaaaagcattaatgttcatggcgatctactacgaaaaagccatcctccaaaagtcagggagcgccatttttctgaaagcacttctattgacaatgccctgagtcgactgacccttgggaatgaattctctgtcaacaatgggtacagtcgaagattcagatctttttctgaactcccctcctgtgatggaaatgaaagttgggcttatcgcagcgggacaaaaacaggtcccaggtctgcaatatctatatacagacctatcgactatgggatctttgggaaagaacaacagttagctttcttagaaaatgtaaagaggtcacttacacaaggaagattatggaaaccaagttttcttaagaaccctggcttcctaaaagatgatttgaggaaccctcccaacccctcagagtcattaagctcaaattctcccagtagtcaggtgccagaagatggcttatctccaagtgaaccgcttaatatctatgaggatgacccagtggactcagattgtgacacagacacaaccacagatgatgaatactacctggatgaaaatgacaaagagtcagaactgtgaggctttttcaataaaatgctttacttttttcaccaaaagcttataatggaactaaggtgtacatgtgcatgtgcatggaaggataaaagatctagtctgggcagtgtctgctctgaaatgtcccacatctccttttttttcctccacaccctatatagacacttcctgaatgctagaacaatgaattcttgttttgagagagtctctgctattttctatctctgtaaatgttcttagcctgcctttccaccactcccacttaatccctgattcactgtctgatttgggctttctgctttacttccctcctaacatttttcatctttaattgtgatttacaaccctaatatcccaggcacatacaaaacttatgaattacccagcacaactgtgaaactctgtattgcttcttccggtccacaccctatactcatgacattaaataaaaggtagggatgataacagtggggtaaatattatcatcctgtttgactcatgaacatttaggaagtttaaggtggtgatcttctctttcaaacaaagataaaggaatttattttttaacctgagaaactgattgcaaaaagga

SEQ ID NO: 460478 - DNA, 4389 bp, Homo sapiens
  misc_feature (1952)..(1952): n is a, c, g, or t
  misc_feature (4371)..(4371): n is a, c, g, or t
aagcaattcttccacctcagcctctctagtagctgggactacagcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccancagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaaaacaagaaggaaagaggcaaaaagttgcaaagtgaaaccctgcatacttcattgatgcttcagagaaaaaatgtatccgaagaaaaatctgaaaattgtcaacaatccattaattcaagtaacagtggtccctctagtcttccagctctttcagaagttaatattggaaattcccaaactagaagaagttcttgggagtgtacagggagtggtagagccattccatttactggaagtggcaagtgtccccagaaagatcacacatccacagctgtaggtgatggctccagtggatcaccaccagantcttccggatcctcgaca

SEQ ID NO: 460479 - DNA, 326 bp, Homo sapiens
tagcttgggtgagaggaggaacactctaggaactctgattcacagtacacatggaaagattccctactaatttgagttttctctatgcagcagaaccatcagaggcgcaggagagaggttgctctgactgccttaatccctgaggtcttcatgtgaggttgcctgccctgtttctagtctgcataagagggagaaagtgacacaagagcaaaggcttcattctttcaagtatatttacttggaagtaattgatgcaaaatttttacaatttttttttctagatccgatagaattacctacatcaagatctaaaaatgtaactaatc

SEQ ID NO: 460480 - DNA, 6047 bp, Homo sapiens
  misc_feature (1952)..(1952): n is a, c, g, or t
aagcaattcttccacctcagcctctctagtagctgggactacagcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccancagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaaaacaagaaggaaagaggcaaaaagttgcaaagtgaaaccctgcatacttcattgatgcttcagagaaaaaatgtatccgaagaaaaatctgaaaattgtcaacaatccattaattcaagtaacagtggtccctctagtcttccagctctttcagaagttaatattggaaattcccaaactagaagaagttcttgggagtgtacagggagtggtagagccattccatttactggaagtggcaagtgtccccagaaagatcacacatccacagctgtaggtgatggctccagtggatcacagcctagggaaggcagaggggacattggaaccaactgccaaaaaatgactaataaaacactttctcactcagagagtcaagtctttgcccttactccagcattgcataaactacagcttggtgaggagactcagtcagatgaaccaaacttagagagtctgcagtctgaaccaagagaattacctcaaagaagtcaggaggcaaatatgacagagagcaggaaggctgaagatgaaatgcagaagtcagcttgggatcaaccttcacttcctgaaggaaacaaaaataaaaccaacttggatgacctagtaaagggggaaaatagatcttcagttaaacacagattggcagccatgtctaaagccagcagaaaattcccagctaaagatgtaagccccagaagacatgtagctactatcttcccccaaagtggaagcagatctggctttgaccatttatctcttggcacagtggagtgcaacccactgttccctgagcctactccaaaatctgcagagtccattggcgaaagcaggttgagtgagaacagaaagcatgtgaagaaatccgagaaccttctccccattactgtactacccaacagagaaccttctacacacgtcagcaaccagaagtctaacagcatttcacaacgacatcagaatgagtttaaaaacgtctcagaatcaccatcaaagcatgagaattctaaagacgtcacagcagctcagaatttagtaagagaatcaggagccccatcacccatcacattcaccagcctcagggaagcagaattctctgacaatcagaggaggctgagccctccttttccactggagcctgcacagaaatctagagtaagcagtccactggccagttttctgcagcaacaaaggagtgcttcatctctggagtgggaacctgagccacacctctatcgttcaaagagtttaaaaagcattaatgttcatggcgatctactacgaaaaagccatcctccaaaagtcagggagcgccatttttctgaaagcacttctattgacaatgccctgagtcgactgacccttgggaatgaattctctgtcaacaatgggtacagtcgaagattcagatctttttctgaactcccctcctgtgatggaaatgaaagttgggcttatcgcagcgggacaaaaacaggtcccaggtgccagaagatggcttatctccaagtgaaccgcttaatatctatgaggatgacccagtggactcagattgtgacacagacacaaccacagatgatgaatactacctggatgaaaatgacaaagagtcagaactctgaaattccaggaccaattctaaaaaccatgccacagaattggacctgccaagggggctgctgtctctgttatgaccaggaagatgctgaatcaagacatcaagtgggccgatatcctgaatcactaccttcatttggtccagaaattgctcctatagaaataaaaacactaaaattgtctaattttcaatgtcactaagttgacttagaagaatttccatgaggtactgttgagggagaaatgtaaaattccatttttgtaaagcattcaccaagaaacctgcatatgcatgtgtacacatggagggacacattggttattaatgttggttgttttgtagacaggtgttgggggagaggatg

SEQ ID NO: 460481 - DNA, 1719 bp, Homo sapiens
gagggtgaaaacaggtgatcctttcattcagctctaggaatccaagatggccttgcacacgcatacagaatgcaaatcggtcacacagcctgagaatgtctaccctccaatgtcaacccgcattgcaccaaggaagggacaaaagacaaactcacatggccatccccaaggaacccagagccctaggcctccacgaccactcttaaaagcttacctacagatacggcaacaagctgttatttatctttactttgggcgtcataagaaaaagtgtttagcttgggatgtaaatcacacaagctacgcaacgaaagatatgttctgctggtgcctcaggaatttaccaaatgttcagaacagtatattcataagagcccaaaagtgggaaaaatgcaaatgtctatcaaatggtgaatggatacaaaatatggtataccatacaatggaatgtcgttcaataataaagagtagcaaagtacaggaatacattaccatgcaaacgagtcgctaaaacactatgctaaatggaagaagccagatgcaatcctggatatgttgtattgtttcttttatgtgaaatgtccagagtagcagagtctacaaagaaggagaacaataaagttgtagagctcatcaacggaaggtatcggtgtaaagataaaaataaggatcaaagggaaaaatagaattgagaactagacacacatatggaccttcaattgctgtcttacgaaagtgtcaaggccacagtatagtgtaaaaaaataagttttgtatgtactcgtaaaatcaaaaaaattgtgttactaacttctttgcaatatttattataatgacctagaaacgaacctgcaatatctccaagatgtgcctgcaagcaaattgtttcttaaggctttttctacatagaagtgaaatccataagtaaagcaattaaacagattattaaagcaaaaaatgagctcaaaatcatcagatttttgagtcaaaggcatattttttaagcttgactatgcaggacagcaccgagacattcatgagggatctgaccccatgacctaaacacctcccaccaggccccacactggggatggcatttcaacgtgagatttgaaggggacaaacatagaagccacgattggcactacaattacctttattttatgaaagagaaactgagtcttagagatgaagaactttcaaggaccagccacgtagaagactgtggcacagggaaagaaagcagaaacttccattctaccacccatgcttgctgcaattttcttgtcaccatcattggctgcatccttccaatgagtgatattcaaatgacatttagcaggcagaaggaaaagccatgttttctgttgtgtttttgaatgctgacccggggttggcctccaggtgcagtgttgaggaaaccatgtactggtacatggcagctgaagttatgcatttttgcttctttgcaatttctgcatttccaggcaagagacaatgctgatgctacagcactggagcttagaattcacacttcattgataacatgcataactttttgaaatatcttctaagtaaacactttttaaaatattggggtagaaaactatatgcagctaggcatggtggctcacacctgtaacctaaacactttgagaggccaaggcgggaggattgcttgagactaggagttcaagaccagcttggggcaacatggtg

SEQ ID NO: 460482 - DNA, 1326 bp, Homo sapiens
aagccagacgacaaggagcaaagcaaagagatgaacaataaactggctgaggcgaaagagagcctggctcaacccgtcagtgattcaagtaagactcaaggtcctgtagccacagagccagacaaggatcaaggttctgtggtcccaggccttctgaaaggtcaaggtcctatggtgcaagagcctctgaagaagcaaggttctgtggtcccagggcctccaaaggatctaggtcccatgatcccattaccagtcaaggatcaagatcacacggtccctgagcctttaaagaatgaaagccctgttatctcagcaccagtcaaggaccaaggtccctcggtcccagttcctccaaagaatcaaagtcctatggttccagcaaaagttaaggatcaaggctctgtggtaccagagtctctaaaggatcaaggtcctaggattcctgagcctgtgaagaatcaagctcctatggtcccagcacctgtcaaggatgaaggtcccatggtctcagcatctgtcaaggatcaaggtcccatggtctcagcacctgtcaaggatcaaggtcccatagtcccagcacctgtcaagggtgaaggtcccatagtcccagcacctgtcaaggatgaaggtcccatggtctcagcacctatcaaggatcaagatcccatggtcccagagcatccgaaggatgaaagtgccatggccacagcacccataaagaatcaaggttccatggtctctgagcctgtaaagaatcaaggtttagtggtctcagggccagtcaaggatcaagatgttgtagtcccagagcatgcaaaggttcacgattctgcagttgtggcacctgtaaagaatcaaggtcctgtggtccccgagtccgtgaagaatcaagaccccattctcccagtactagttaaggatcaaggccccacagtcctacagcctccaaagaatcaaggtcgtatagtccctgaacctctgaagaatcaagttcctatagtcccagtgcctctgaaggatcaagatcctctggtgccagtaccagcaaaggaccaaggtcctgcagtccctgaacctctgaagactcaaggtcccagggaccctcagctacctactgtctcacctctaccccgagtcatgatcccaactgccccccatacggaatacattgagagctccccttgacactcaccccttgacacaccaatgaaggagctgacagtgagagtgctcccctcccaggggcagtgaagacacatatttaatctgcatgaaacatgtacagtagtcttgctggaatctaataaaaatggtccctctggctca

SEQ ID NO: 460483 - DNA, 1605 bp, Homo sapiens
aagccagacgacaaggagcaaagcaaagagatgaacaataaactggctgaggcgaaagagagcctggctcaacccgtcagtgattcaagtaagactcaaggtcctgtagccacagagccagacaaggatcaaggttctgtggtcccaggccttctgaaaggtcaaggtcctatggtgcaagagcctctgaagaagcaaggttctgtggtcccagggcctccaaaggatctaggtcccatgatcccattaccagtcaaggatcaagatcacacggtccctgagcctttaaagaatgaaagccctgttatctcagcaccagtcaaggaccaaggtccctcggtcccagttcctccaaagaatcaaagtcctatggttccagcaaaagttaaggatcaaggctctgtggtaccagagtctctaaaggatcaaggtcctaggattcctgagcctgtgaagaatcaagctcctatggtcccagcacctgtcaaggatgaaggtcccatggtctcagcatctgtcaaggatcaaggtcccatggtctcagcacctgtcaaggatcaaggtcccatagtcccagcacctgtcaagggtgaaggtcccatagtcccagcacctgtcaaggatgaaggtcccatggtctcagcacctatcaaggatcaagatcccatggtcccagagcatccgaaggatgaaagtgccatggccacagcacccataaagaatcaaggttccatggtctctgagcctgtaaagaatcaaggtttagtggtctcagggccagtcaaggatcaagatgttgtagtcccagagcatgcaaaggttcacgattctgcagttgtggcacctgtaaagaatcaaggtcctgtggtccccgagtccgtgaagaatcaagaccccattctcccagtactagttaaggatcaaggccccacagtcctacagcctccaaagaatcaaggtcgtatagtccctgaacctctgaagaatcaagttcctatagtcccagtgcctctgaaggatcaagatcctctggtgccagtaccagcaaaggaccaaggtcctgcagtccctgaacctctgaagactcaaggtcccagggaccctcagctacctactgtctcacctctaccccgagtcatgatcccaactgccccccatacggaatacattgagagctccccttgacactcaccccttgacacaccaatgaaggagctgacagtgagagtgctcccctcccaggggcagtgaagacacatatttaatctgcatgaaacatgtacagtagtcttgctggaatctaataaaaatggtccctctggctcaaaaaaaacaaaaacgaaacaagaaaaaacatagacgaatgaaaaaaaaaaaaaaagaggggggggaaaaatacccggggggagccaatttatcacaccccgttgtgttaacagggcctcatgggggggcgtatataaccagacggcgcgttaaaacggagggcggaaacctagcgcggagttggagaagccactgtgggggagacgtggcacaccacagatatcccggaataacattggtttatgtgtacccactattcgccggaaggtcgcgtttgat

SEQ ID NO: 460484 - DNA, 1482 bp, Homo sapiens
gtcaccccgtgctttaaaccatccgtgggctcctcgtggtgcagaagcttcttgttccctcggtgcaccatgctgcttctcacctccatgcctttacccttgctgtccacctgcctggaatgcccttctcctgcttctccacctggctaactcatccttcaagactctgctcaggggacagctccaggaagcctttcccgcacctcccaagctgggagcctggctcaacccgtcagtgattcaagtaagactcaaggtcctgtagccacagagccagacaaggatcaaggttctgtggtcccaggccttctgaaaggtcaaggtcctatggtgcaagagcctctgaagaagcaaggttctgtggtcccagggcctccaaaggatctaggtcccatgatcccattaccagtcaaggatcaagatcacacggtccctgagcctttaaagaatgaaagccctgttatctcagcaccagtcaaggaccaaggtccctcggtcccagttcctccaaagaatcaaagtcctatggttccagcaaaagttaaggatcaaggctctgtggtaccagagtctctaaaggatcaaggtcctaggattcctgagcctgtgaagaatcaagctcctatggtcccagcacctgtcaaggatgaaggtcccatggtctcagcatctgtcaaggatcaaggtcccatggtctcagcacctgtcaaggatcaaggtcccatagtcccagcacctgtcaagggtgaaggtcccatagtcccagcacctgtcaaggatgaaggtcccatggtctcagcacctatcaaggatcaagatcccatggtcccagagcatccgaaggatgaaagtgccatggccacagcacccataaagaatcaaggttccatggtctctgagcctgtaaagaatcaaggtttagtggtctcagggccagtcaaggatcaagatgttgtagtcccagagcatgcaaaggttcacgattctgcagttgtggcacctgtaaagaatcaaggtcctgtggtccccgagtccgtgaagaatcaagaccccattctcccagtactagttaaggatcaaggccccacagtcctacagcctccaaagaatcaaggtcgtatagtccctgaacctctgaagaatcaagttcctatagtcccagtgcctctgaaggatcaagatcctctggtgccagtaccagcaaaggaccaaggtcctgcagtccctgaacctctgaagactcaaggtcccagggaccctcagctacctactgtctcacctctaccccgagtcatgatcccaactgccccccatacggaatacattgagagctccccttgacactcaccccttgacacaccaatgaaggagctgacagtgagagtgctcccctcccaggggcagtgaagacacatatttaatctgcatgaaacatgtacagtagtcttgctggaatctaataaaaatggtccctctggctca

SEQ ID NO: 460485 - DNA, 1169 bp, Homo sapiens
aagccagacgacaaggagcaaagcaaagagatgaacaataaactggctgaggcgaaagagagcctggctcaacccgtcagtgattcaagtaagactcaaggtcctgtagccacagagccagacaaggatcaaggttctgtggtcccaggccttctgaaaggtcaaggtcctatggtgcaagagcctctgaagaagcaaggttctgtggtcccagggcctccaaaggatctaggtcccatgatcccattaccagtcaaggatcaagatcacacggtccctgagcctttaaagaatgaaagccctgttatctcagcaccagtcaaggaccaaggtccctcggtcccagttcctccaaagaatcaaagtcctatggttccagcaaaagttaaggatcaaggctctgtggtaccagagtctctaaaggatcaaggtcctaggattcctgagcctgtgaagaatcaagctcctatggtcccagcacctgtcaaggatgaaggtcccatggtctcagcatctgtcaaggatcaaggtcccatggtctcagcacctgtcaaggatcaaggtcccatagtcccagcacctgtcaagggtgaaggtcccatagtcccagcacctgtcaaggatgaaggtcccatggtctcagcacctatcaaggatcaagatcccatggtcccagagcatccgaaggatgaaagtgccatggccacagcacccataaagaatcaaggttccatggtctctgagcctgtaaagaatcaaggtttagtggtctcagggccagtcaaggatcaagatgttgtagtcccagagcatgcaaaggttcacgattctgcagttgtggcacctgtaaagaatcaaggtcctgtggtccccgagtccgtgaagaatcaagaccccattctcccagtactagttaaggatcaaggccccacagtcctacagcctccaaagaatcaaggtcgtatagtccctgaacctctgaagaatcaagttcctatagtcccagtgcctctgaaggatcaagatcctctggtgccagtaccagcaaaggaccaaggtcctgcagtccctgaacctctgaagactcaaggtcccagggaccctcagctacctactgtctcacctctaccccgagtcgtgggcagaaagggatccttagagtcgcctcg

SEQ ID NO: 460486 - DNA, 2075 bp, Homo sapiens
cctgcagcccgccatgcctgagcctcccacccactccatgggctcctgtgcagcccgagcctccccgacgagcactaccccctgctccacggcacccagtcccaacgaccacccaagggctgaggaatgcgagcgcacggcgcaggactggcaggcagctccacctgcagcctcggtgtgggatccactaggtgaagccagctgggctcctgagtctggtggggacctcaagatttgtaaacacaccaatcagcaccctgtgtttagctcaaggtttgtgaatgcaccaatcgacactctatctagctgctctggtgaggccttggagaacctgtgtgtggaaactctgtatctaactaatctgatggggacgtggagaacctttgcatctagctcagggattgtaaacgcaccaatcagtgccctgacaaaaacaggccactgggctctgccaatcagcaggatgtgggtggggccagataagagaataaaagcaggctgcccgagccagcattggcaacccactcgggtctccttcaacgctatggaagctttgctcttttgctctttgcaataaatcttgctactgttcactctttgggtccatgctgcttttatgagctgtaacactcacagggaaaatctgcagcttcactcccgaaccgagcgagaccacgagcccaccgggaggaaagaacaactccagacatgctgccttaagagctgtaacactcaccgcgaaggtctgccgtttcactcctgagccagtgagaccacgaacccaccagaagaaagaaactctgaacacatctgaacatcagaaggaacagactccagacgcgccaccttaagagctgtaacactcaccgcgagggtccgcggcttcattcttgaagtcagtgagaccaagaacccaccaattccggacacagaatttcatggagcctggagcccaggaaaagggtgaatccaatgcaggctgatttctggcttacatcacagtccagtctgattttctgcagattactttctacaagacgatttgggacctcagtttaccacctcccagcggaccgacgggtgcgtttgcaatagtttcaaagtaaccccttccacagacacaaattgttcattagttataaatagaacaacagtaactttacagtggaaaaagctggcggacatcattttagccacataatcaaagttaacgtcaacagtaaggagaaaatcaacaccacgtgtcttctgacaacaacgcgctgatgggagcccaacatcatttacaccataaatcaaatgtttatccgttggcgattccagccaaaaatagataacctgatccaatcatgagggaacttcagacaaacccaaactgaaggacattctacagaataactggtctgtactcataacaaagaatcaatgtcatgagggaccatgaaaggctgaggatgtcccacaggttgaaagtgacgaaaacaaacaaaaaacaaccagcaaccaactacgatgcacaaccttggattggagccttctcaaaattgctgaaaataacagtggaacaagtggtgaaatttgaatatgggctatatgttaggtattcattttatgtcaatgttaaattttccgacattgatatttgtaccaggaaatgtaaaagaaggcccaaatttagcgataaattatgcctgccactcactctctccaatgattcagaagatagtacggatgatgaacagatgacagagacatggtaggtagatcaatagatggatggatagatagaaaatatgaaataagaaactcctggacacgaaccgtacagaccaagttcatcactcctgtgagggagaaccttgaattcccataagaaaaactgaatgtgcaggaagcgtatctcattcagttcacaaaccatgatgggttctgtgttcaccctggctaactatctacttctacctctcctctcctcctctcctctcctctcctctcctctcctctcctctcctctcctctcctctcctctcctctcctctcccctcgtctccccttccttgtctgctctctttttc

SEQ ID NO: 460487 - DNA, 1445 bp, Homo sapiens
gaggttaaaggtctaaaatagatgtctaatactctccacgttcagaaagaagagtcctacaaattattgctgatgtgcactaatgaaagtcaatcttgtagtgattataactgcaggtcagaactaggatttcatggggataatgtaacgttaactgtacggcataagcatgtaactcacattccaatggaagcagaagaggttgagcccacaatcaaactgtcactgaattctaaaccaaaactgaagtatggacttcttctcattagggtcacgttgccaggactatacaatgaaatgcctggccgtgagagtccagcaattttctttgctctcagagttcctgtttggaaaagaaatctgagaacttcatggtggtgtcccattgggtgggatggagtgggcatcaggatgagtctctccggaggggatgggaatctcaaatgccagccgctgaatgatgagtgggtgctcaaaccggaatctggatttgtgaaggtggatcgtaggctgggaaaaaaggtcatattttctcactccaactctgataagctgataggtttagcacaggtgtttgggaagacaacaacccagggctgttctgtttctgactcaagatattggagcaagctatgcctctccatggagatgaggaagcctgcagcccccgaaggtcacggatgctgttggagccacgaggaagagccatcagcccagggagaccctgagggtcagggcatctccatggatgaactccgtgtactgctggactcatccaacccttcgtggacatcactttgtagtgaaaatcccttttgttgttgaagaaagcctgagttgggtgatttattactcataaagtatgttaataccttgatgctaatattctcatgagagaattatactctagtcttatgatagcactaaaagtaacttaaaggccccacgcttctccagataaaaccaacacttgtgaaacccttgctttgccgtttactatctatgttcctggacaaactattaaatgtgccgagtctacacctccacctcagtttaggatcaataatctatatcttttctttttcagtttcaatacataaaaataagtgccatgagtagttcttgtaactgaataggcacttaaaagtgaaattaggctcttcatttctcctgctttcttatcgtacatctttatgatactttaatttgagctacaacccctgagatcttcttgagagttaatcactgctgagagacaatacagagacaggacaatagacagatcgcatgtgacgacagagttctgacccacaacctctgcagcaattgctccccaacaatggggacttagtgaataactgctacctgccctatttatgcccccaactcaggaacagcaggtcaatccaatatgcttctctaatacccacatagttctcattctt

SEQ ID NO: 460488 - DNA, 1387 bp, Homo sapiens
agcagtaataggatgctggtgaatgctgagatttcacttgaatccttcagtcataaatttaaagtaagatcagtaaacaaagttatgcacttctcttcagctctgtgtcgctgcttcagtatagacataaagatctcaaaaagccagttttcatcagagttaggattttctagcccaggtgaatccagtgatgccatccaggagccaaggactagagccaaaaaccttaaaaattacttggtatcctattgtgctgctgctgagctggcactcacactacaagatgcagttattgccactcttctctctcctttccacaggcagaggaggctcaccgcatgtctaccaccgcacaggcccatggaaagtattgacgggctttcgtcagtgttcacttaagccccaagagctcttcagttagcttgtgcatacagactctctttccacgcggccactgccaggggatgaggaagagatggtgtcaacaattcaagactgtctctcttgctctcttcagtgtatctttcagtaacatgaagttataatcagcctaagcttacgcaggtccaggattattaatgtcactgtcttccatctccacatcttgtcccactggaaggtcttcaggagcaagaacacgcatggagctgtcatcccctatgataacaatgccttctgctggaatagctcctgaaagacctgcatgaggctgtttcacaattacttttttttataagtagaaggagtcagtacactccaaaataataataaaatatagtattgtgtatatcaaaacctgtaatgtagttgtttataattgttatcaagtattatgtactgagtgttattgacttttatctttattgaaattaataacttttaaagtcaactacttctaagcattctattcaaatataaagcttgtttaacagatatagtaccaaataattaattttcaaataactaatttgcttttatgaaagtgatggcttacattattaatgtaatttatgtgtataaataatttaatgccaaattatgttttatagtatgtgtagattacattttcaagtaccttacattacttgcaaaatatagaatattgtgaaatcacaaaatttgcaaataaacatactgaaagtaatagtaaatggtagcaataggcatatattatgtagtgttatagtgagaaggttagagggaagtatttagaaagatttattcttcactagtaagtctacagaaatgtttagcaacagtgtaaaatatatggataataattgttattgaaacaaatatggaattgcaataacattttcaaaatgcatttgtcatgacattagttaatagtatttattgtacctgtaagataactaggttcagggag

SEQ ID NO: 460489 - DNA, 858 bp, Homo sapiens
gatccctaatgggagttaaggatggcaagcgcctggccctgcaaagcctcaactctctacttggctccgctagacccatcaatcttctctccatggcctgggacccctccaaccctggacgtcgagagagactcggcagctgtgagaaccttctttctcaagtaaggtttttttccaaaattatatcaggtttccttctaccccagcttgtcagtgggggactcttttgcctaacatggttgaggaatgtcttagaaactggacagaaatcagtctgcaaatcaccctgtgtcacagccctggaaagcaggactgagaaccagaaaacttcagtggaagtcattggtcccagtggccaaagcaccaaactgaagaagaaagtgaagagtccaaggacagataaagctctggccaaggccttattcttggtaggtgtccacatgaactctgaaggaggaagccacgatgtcagctgtctgttccctttgtcatcactgctagacagtgggtgtctgcgctgggctatttgctgatttatttgttcaatgctggtctcccacactagaccatgagcaggaaggagaggcagcatgcaactgtgctcgttgtctacacagggcctagcactgggcctgggccagggcaggcacctgggagattgctgcaagagagaaggtcacctatctccccaggtagcctctctcaccctgacaatgtatcttcacaggtaagggacaaagacaagactagaaatcatccctctgcccacctcaagacaaatgcagatctgacttcttcttcctctactctatgtttactttatcttatgtaaaatacaagatttactgagcaggagcc

SEQ ID NO: 460490 - DNA, 1946 bp, Homo sapiens
agcctacatctttctcccgtgctatgctttctgccctcgaacatcggactccaagttcttcagttttgggactcggactggctctcctttctcctctgcttgcagacatcctgttgtgggaacttgtgatcatggtgtccaagcccttacataaccgtaggtgggaccgagccactactacctgggacagcaagaaggtggaaagactgaggatgggaattctcttagaggatgcaacctcaggacttcccgtttctatatatgtgaatgagaatttcttccgccacagaatattcaagacacaaggaattggagcaaataccgattcaggaattggacagctgtggtttgcaggctttttggagggaatgcaaggagaaggcttttatagggtgaaaaagggaatcaagggtgtggataagacagtggtaggagatgaagttgtaaaaacggcatatggaacacgtgagattgaaagaattgtgtgcaatagtcttggtgagaatgatgaagatctgaagcagtactttagcagtgaggatggacagaaggtatttcaaaacctgcttttgtttttcccgacccagcccatctgccaagcagcctatcagaatgactttggacaagtgtggcggtgggtgaaagaagacagcagctatgccaacgttcaagatggctttaatggagacacgcccctgatctgtgcttgcaggcgagggcatgtgagaatcgtttccttccttttaagaagaaatgctaatgtcaacctcaaaaaccaggtatcaaagacaaagcagaatgaggctcttgtacgaatgctacttgatgctggcgtcgaagttaatgctacagattgtggaatgggatccagagctaaacctgtcttgatagccaaagtactagaaatagttgtctatcaatggtttgcagactatttttctgcttagttgtatactacaaagtgtgaaaaggatttgccaatgaagccacatgctatggtctgtggagggcccgacttatgagctgaagttttggccctttgtgtttcagtatggctgtaccgcattacattatgcctgtgaaatgaaaaaccagtctcttatccctctgctcttggaagcccgtgcagaccccacaataaagaataagcatggtgagagctcactggatattgcacggagattaaaattttcccagattgaattaatgctaaggaaagcattgtaatccttgtgaccacaccgatggagatacagaaaaagttaacgactggattctatcttcattttagacttttggtctgtgggccatttaacctggatgccaccattttatggggataatgatgcttaccatggttaatgttttggaagagctttttatttatagcattgtttactcagtcaagttcaccatggccgtaatccttctaagggaaacactaaagttgttgtagtctccacttcagtcagaaactgatgtttcagctaggcacagtggtacatgcctgtaatcccagctacttgggaggctgaggtgggaggatcacttgaactcaggagtttgagagcagccagggcaacacagcgagaccctgtctcaaaaaaaaaaaaaaaaaaaaaaagccctggtgttccaaactcagtctttcctgaagaagaggatctgagttatcttctgaaacagcgttctcccttcccagttgtatcactcttataaaaagactgtccagtctatgtcatgccctaggagacaaactgttcctcccagccccctttgagtattgagcagaagaatcaaattattaaatacgtatgtttgtacagaatggtatttgtgtatgtgtgtgggcttagagattcacaagtaaatattcctttggtgaaggaatttcaataaaaacatctatcaagtgtcagcggtgagtgtgtttacaccacagaaat

SEQ ID NO: 460491 - DNA, 369 bp, Homo sapiens
aaaaaaaaaaaaaaaaaaaaaaaaaaaaaaaaaaaaaaaaaaaaaaagccctggtgttccaaactcagtctttcctgaagaagaggatctgagttatcttctgaaacagcgttctcccttcccagttgtatcactcttataaaaagactgtccagtctatgtcatgccctaggagacaaactgttcctcccagccccctttgagtattgagcagaagaatcaaattattaaatacgtatgtttgtacagaatggtatttgtgtatgtgtgtgggcttagagattcacaagtaaatattcctttggtgaaggaatttcaataaaaacatctatcaagtgtcagcggtgagtgtgtttacaccacagaaat

SEQ ID NO: 460492 - DNA, 1379 bp, Homo sapiens
tgctgcctgagctgctggaaaagcactgacaggtgtttgctagaaaagcactcctggagcttgccaccagcttggacttctagggactttcctctcagccaggaaggattttgatattcatcagaaatacctccagaagattcaaggagctgtagaggtgaagtaagcctgtgaaggaccagcatgggaatcctatactctgagcccatctgccaagcagcctatcagaatgactttggacaagtgtggcggtgggtgaaagaagacagcagctatgccaacgttcaagatggctttaatggagacacgcccctgatctgtgcttgcaggcgagggcatgtgagaatcgtttccttccttttaagaagaaatgctaatgtcaacctcaaaaaccagaaagagagaacctgcttgcattatgctgtgaagaaaaaatttaccttcattgattatctactaattatcctcttaatgcctgttctgcttattgggtatttcctcatggtatcaaagacaaagcagaatgaggctcttgtacgaatgctacttgatgctggcgtcgaagttaatgctacagattgtcatggtgagagctcactggatattgcacggagattaaaattttcccagattgaattaatgctaaggaaagcattgtaatccttgtgaccacaccgatggagatacagaaaaagttaacgactggattctatcttcattttagacttttggtctgtgggccatttaacctggatgccaccattttatggggataatgatgcttaccatggttaatgttttggaagagctttttatttatagcattgtttactcagtcaagttcaccatggccgtaatccttctaagggaaacactaaagttgttgtagtctccacttcagtcagaaactgatgtttcagctaggcacagtggtacatgcctgtaatcccagctacttgggaggctgaggtgggaggatcacttgaactcaggagtttgagagcagccagggcaacacagcgagaccctgtctcaaaaaaaaaaaaaaaaaaaaaaagccctggtgttccaaactcagtctttcctgaagaagaggatctgagttatcttctgaaacagcgttctcccttcccagttgtatcactcttataaaaagactgtccagtctatgtcatgccctaggagacaaactgttcctcccagccccctttgagtattgagcagaagaatcaaattattaaatacgtatgtttgtacagaatggtatttgtgtatgtgtgtgggcttagagattcacaagtaaatattcctttggtgaaggaatttcaataaaaacatctatcaagtgtcagcggtgagtgtgtttacaccacagaaat

SEQ ID NO: 460493 - DNA, 1478 bp, Homo sapiens
tgctgcctgagctgctggaaaagcactgacaggtgtttgctagaaaagcactcctggagcttgccaccagcttggacttctagggactttcctctcagccaggaaggattttgatattcatcagaaatacctccagaagattcaaggagctgtagaggtgaagtaagcctgtgaaggaccagcatgggaatcctatactctgagcccatctgccaagcagcctatcagaatgactttggacaagtgtggcggtgggtgaaagaagacagcagctatgccaacgttcaagatggctttaatggagacacgcccctgatctgtgcttgcaggcgagggcatgtgagaatcgtttccttccttttaagaagaaatgctaatgtcaacctcaaaaaccagaaagagagaacctgcttgcattatgctgtgaagaaaaaatttaccttcattgattatctactaattatcctcttaatgcctgttctgcttattgggtatttcctcatggtatcaaagacaaagcagaatgaggctcttgtacgaatgctacttgatgctggcgtcgaagttaatgctacagattgttatggctgtaccgcattacattatgcctgtgaaatgaaaaaccagtctcttatccctctgctcttggaagcccgtgcagaccccacaataaagaataagcatggtgagagctcactggatattgcacggagattaaaattttcccagattgaattaatgctaaggaaagcattgtaatccttgtgaccacaccgatggagatacagaaaaagttaacgactggattctatcttcattttagacttttggtctgtgggccatttaacctggatgccaccattttatggggataatgatgcttaccatggttaatgttttggaagagctttttatttatagcattgtttactcagtcaagttcaccatggccgtaatccttctaagggaaacactaaagttgttgtagtctccacttcagtcagaaactgatgtttcagctaggcacagtggtacatgcctgtaatcccagctacttgggaggctgaggtgggaggatcacttgaactcaggagtttgagagcagccagggcaacacagcgagaccctgtctcaaaaaaaaaaaaaaaaaaaaaaagccctggtgttccaaactcagtctttcctgaagaagaggatctgagttatcttctgaaacagcgttctcccttcccagttgtatcactcttataaaaagactgtccagtctatgtcatgccctaggagacaaactgttcctcccagccccctttgagtattgagcagaagaatcaaattattaaatacgtatgtttgtacagaatggtatttgtgtatgtgtgtgggcttagagattcacaagtaaatattcctttggtgaaggaatttcaataaaaacatctatcaagtgtcagcggtgagtgtgtttacaccacagaaat

SEQ ID NO: 460494 - DNA, 3639 bp, Homo sapiens
caaacaacaggacacagcgaaggtaaaacggatgtctaggggagtggctaaaccatcactgtacactcaagagtctagcacagtgcctggcacacagtaaacagcaagtgaatgacaagcagttggcagtggccggagctccgtcgctggggcgtggagagggccgccccggcccgcagttcccgccctgacactgggataacttcccccgcggctgcccagcgccgccctgaccagaccctctgtaccccgacttctgtccggccagaagccacagccgcacgcagcgcctcgccccgtgacgtcactcggggcgggacttccggccgccgaagtttaacagtccaggcgggagccggaagcccagcgcggagccggccgcggcccctgttgtgttgctgcggagagtgaggttccggaggccctgaggtcagcgggcccccgcccgccgcgtccgcgcaccctcccgatcctaagacccgctccgtccccctcagagggcggggcggcggtccttgggctttgcgcgcccggagcggttgctgggcgggggcgcggcggcgcgctgggctgggaagtgtccggggaggcgcgggccggggtcgcgcacctcccggagccttgtggggtgtgctgcctccgaaaagtttgcctcgtctccacaagtctgtctccttttttgtcaacctcaagtacttttcttttggcaggtacttggatgcattttacaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtcaatagtcagagtccataccataactttgacagtgtacacaaagctccagcgtcaggcatctgtttttctcctgtcaatgaattgctctttgtaaccataggcttggataaaagaatcatcctctatgacacttcaagtaagaaagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagcagacccagggatctgagtgctggagcaactctgaaatcgctgtgcatttctgccctgctgccagctttcggggtggctggagcttgtttttcactatctaacctgttcctggctttctgtgcctcaggagaagtgtgtctgtcccactttcagccctgcagagctgctgcagcacgtttggtgaagacgtacagtcagtgcctcttggttttgctgccctgtgctgcatgtctgcacctaggagtggcctcctctcttcaagaccttggctcttacagccttggctaccttggtaggcccaaactcttaatactcccccacccagcgagactatctcaacctccaggccactgcttcagctcggtttcttctccacactgtggaatcagcacatactctagaaggaaaaacagagaaaaagatatgaaaaagcatttcaaggaagaggaatggtatatgaacacaggaaagatattcaacttcacaattaatcagagaactaaaaatgcaatgagataccgtgtcacaccgagtaaatgggaaaatataaaaaatctggtaatactaagtcttgatgatatagagcaagaagaactctgttatactggtgacatccattgataactacctttggaaaacaatttgcatgattttgtaaaagtatacacttgagttacagttggttatatcatcaatggacattggcacatgtgggtttggagataatacatgattgtttataacaacgttggaatagtaaaaacttgaaaacagtcaaaatattaacaggaaaatagatacaccagtacaaactaatgatatacagatatataaaacatgaatcttcaaaacaatattgaattatttcttaaatataagctatatggtacccttttttgtaatgctcaaaaacatgcacaatgaaaacattgactacagattatatgttatacaaatgtattaaaaaagcaaaagcatttctttgtccaacaaaattcaggagagtaatgacttctttcttgggctttttcccaagagttaagtgatagaatcagacaggaacacacaggaagcttctattatttggtaatgttctagttcataagttgtgtggtgggtgactgagtgtttcttttgttattatacttaataatttttacatattcttttgtaggcatgaattaattgtattttattgagtaagccatgctatatccacccaaattgccactttatactgaaagtacattttttcaatagctaaactgataataataaaatgatctttctaacctagtgaattttctgtatttcattgtaagataagtttgtgtcttaatgacaatttctatataaaggaatatagtatcggagagttcaggggttaaacagcctgggtttacatcctagctccatcatttactggttgtgtgactttgaacaagttatatctactctggttaagttatttcttttgtaaaatggacctgtaataattgcatctacttgtgaagatattttaaacgagttcttacatttaaagtaaaggaaacagtgcctagcacatagtgaataaatgctcagtgcattggtatttttattattatagtaattattaacattcagtaatttggcaaatgaaaaagttt

SEQ ID NO: 460495 - DNA, 1202 bp, Homo sapiens
caaacaacaggacacagcgaaggtaaaacggatgtctaggggagtggctaaaccatcactgtacactcaagagtctagcacagtgcctggcacacagtaaacagcaagtgaatgacaagcagttggcagtggccggagctccgtcgctggggcgtggagagggccgccccggcccgcagttcccgccctgacactgggataacttcccccgcggctgcccagcgccgccctgaccagaccctctgtaccccgacttctgtccggccagaagccacagccgcacgcagcgcctcgccccgtgacgtcactcggggcgggacttccggccgccgaagtttaacagtccaggcgggagccggaagcccagcgcggagccggccgcggcccctgttgtgttgctgcggagaggtacttggatgcattttacaggttagcctcacttgagctgttgtcctgcaagtaaagtgtatttttggtgattgaaagttggagaactttcatttcagctgagtggtgtagttgaattggttcctgtagccgctgtccctaaacccaggccgacgttaccgccttgtgtcctgactgctagctttcgacgggaccgtctttgagggactcatgtaaagtctctcccttaatgctcagttcttagaagaccgaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccaggcgtcctcatcccgtttgcacctaaacactacaatcaagcttat

SEQ ID NO: 460496 - DNA, 3330 bp, Homo sapiens
caaacaacaggacacagcgaaggtaaaacggatgtctaggggagtggctaaaccatcactgtacactcaagagtctagcacagtgcctggcacacagtaaacagcaagtgaatgacaagcagttggcagtggccggagctccgtcgctggggcgtggagagggccgccccggcccgcagttcccgccctgacactgggataacttcccccgcggctgcccagcgccgccctgaccagaccctctgtaccccgacttctgtccggccagaagccacagccgcacgcagcgcctcgccccgtgacgtcactcggggcgggacttccggccgccgaagtttaacagtccaggcgggagccggaagcccagcgcggagccggccgcggcccctgttgtgttgctgcggagaggtacttggatgcattttacaggttagcctcacttgagctgttgtcctgcaagtaaagtgtatttttggtgattgaaagttggagaactttcatttcagctgagtggtgtagttgaattggttcctgtagccgctgtccctaaacccaggccgacgttaccgccttgtgtcctgactgctagctttcgacgggaccgtctttgagggactcatgtaaagtctctcccttaatgctcagttcttagaagaccgagcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtcaatagtcagagtccataccataactttgacagtgtacacaaagctccagcgtcaggcatctgtttttctcctgtcaatgaattgctctttgtaaccataggcttggataaaagaatcatcctctatgacacttcaagtaagaaagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagcagacccagggatctgagtgctggagcaactctgaaatcgctgtgcatttctgccctgctgccagctttcggggtggctggagcttgtttttcactatctaacctgttcctggctttctgtgcctcaggagaagtgtgtctgtcccactttcagccctgcagagctgctgcagcacgtttggtgaagacgtacagtcagtgcctcttggttttgctgccctgtgctgcatgtctgcacctaggagtggcctcctctcttcaagaccttggctcttacagccttggctaccttggtaggcccaaactcttaatactcccccacccagcgagactatctcaacctccaggccactgcttcagctcggtttcttctccacactgtggaatcagcacatactctagaaggaaaaacagagaaaaagatatgaaaaagcatttcaaggaagaggaatggtatatgaacacaggaaagatattcaacttcacaattaatcagagaactaaaaatgcaatgagataccgtgtcacaccgagtaaatgggaaaatataaaaaatctggtaatactaagtcttgatgatatagagcaagaagaactctgttatactggtgacatccattgataactacctttggaaaacaatttgcatgattttgtaaaagtatacacttgagttacagttggttatatcatcaatggacattggcacatgtgggtttggagataatacatgattgtttataacaacgttggaatagtaaaaacttgaaaacagtcaaaatattaacaggaaaatagatacaccagtacaaactaatgatatacagatatataaaacatgaatcttcaaaacaatattgaattatttcttaaatataagctatatggtacccttttttgtaatgctcaaaaacatgcacaatgaaaacattgactacagattatatgttatacaaatgtattaaaaaagcaaaagcatttctttgtccaacaaaattcaggagagtaatgacttctttcttgggctttttcccaagagttaagtgatagaatcagacaggaacacacaggaagcttctattatttggtaatgttctagttcataagttgtgtggtgggtgactgagtgtttcttttgttattatacttaataatttttacatattcttttgtaggcatgaattaattgtattttattgagtaagccatgctatatccacccaaattgccactttatactgaaagtacattttttcaatagctaaactgataataataaaatgatctttctaacctagtgaattttctgtatttcattgtaagataagtttgtgtcttaatgacaatttctatataaaggaatatagtatcggagagttcaggggttaaacagcctgggtttacatcctagctccatcatttactggttgtgtgactttgaacaagttatatctactctggttaagttatttcttttgtaaaatggacctgtaataattgcatctacttgtgaagatattttaaacgagttcttacatttaaagtaaaggaaacagtgcctagcacatagtgaataaatgctcagtgcattggtatttttattattatagtaattattaacattcagtaatttggcaaatgaaaaagttt

SEQ ID NO: 460497 - DNA, 3316 bp, Homo sapiens
caaacaacaggacacagcgaaggtaaaacggatgtctaggggagtggctaaaccatcactgtacactcaagagtctagcacagtgcctggcacacagtaaacagcaagtgaatgacaagcagttggcagtggccggagctccgtcgctggggcgtggagagggccgccccggcccgcagttcccgccctgacactgggataacttcccccgcggctgcccagcgccgccctgaccagaccctctgtaccccgacttctgtccggccagaagccacagccgcacgcagcgcctcgccccgtgacgtcactcggggcgggacttccggccgccgaagtttaacagtccaggcgggagccggaagcccagcgcggagccggccgcggcccctgttgtgttgctgcggagaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtcaatagtcagagtccataccataactttgacagtgtacacaaagctccagcgtcaggcatctgtttttctcctgtcaatgaattgctctttgtaaccataggcttggataaaagaatcatcctctatgacacttcaagtaagaaagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagcagacccagggatctgagtgctggagcaactctgaaatcgctgtgcatttctgccctgctgccagctttcggggtggctggagcttgtttttcactatctaacctgttcctggctttctgtgcctcaggagaagtgtgtctgtcccactttcagccctgcagagctgctgcagcacgtttggtgaagacgtacagtcagtgcctcttggttttgctgccctgtgctgcatgtctgcacctaggagtggcctcctctcttcaagaccttggctcttacagccttggctaccttggtaggcccaaactcttaatactcccccacccagcgagactatctcaacctccaggccactgcttcagctcggtttcttctccacactgtggaatcagcacatactctagaaggaaaaacagagaaaaagatatgaaaaagcatttcaaggaagaggaatggtatatgaacacaggaaagatattcaacttcacaattaatcagagaactaaaaatgcaatgagataccgtgtcacaccgagtaaatgggaaaatataaaaaatctggtaatactaagtcttgatgatatagagcaagaagaactctgttatactggtgacatccattgataactacctttggaaaacaatttgcatgattttgtaaaagtatacacttgagttacagttggttatatcatcaatggacattggcacatgtgggtttggagataatacatgattgtttataacaacgttggaatagtaaaaacttgaaaacagtcaaaatattaacaggaaaatagatacaccagtacaaactaatgatatacagatatataaaacatgaatcttcaaaacaatattgaattatttcttaaatataagctatatggtacccttttttgtaatgctcaaaaacatgcacaatgaaaacattgactacagattatatgttatacaaatgtattaaaaaagcaaaagcatttctttgtccaacaaaattcaggagagtaatgacttctttcttgggctttttcccaagagttaagtgatagaatcagacaggaacacacaggaagcttctattatttggtaatgttctagttcataagttgtgtggtgggtgactgagtgtttcttttgttattatacttaataatttttacatattcttttgtaggcatgaattaattgtattttattgagtaagccatgctatatccacccaaattgccactttatactgaaagtacattttttcaatagctaaactgataataataaaatgatctttctaacctagtgaattttctgtatttcattgtaagataagtttgtgtcttaatgacaatttctatataaaggaatatagtatcggagagttcaggggttaaacagcctgggtttacatcctagctccatcatttactggttgtgtgactttgaacaagttatatctactctggttaagttatttcttttgtaaaatggacctgtaataattgcatctacttgtgaagatattttaaacgagttcttacatttaaagtaaaggaaacagtgcctagcacatagtgaataaatgctcagtgcattggtatttttattattatagtaattattaacattcagtaatttggcaaatgaaaaagttt

SEQ ID NO: 460498 - DNA, 3569 bp, Homo sapiens
caaacaacaggacacagcgaaggtaaaacggatgtctaggggagtggctaaaccatcactgtacactcaagagtctagcacagtgcctggcacacagtaaacagcaagtgaatgacaagcagttggcagtggccggagctccgtcgctggggcgtggagagggccgccccggcccgcagttcccgccctgacactgggataacttcccccgcggctgcccagcgccgccctgaccagaccctctgtaccccgacttctgtccggccagaagccacagccgcacgcagcgcctcgccccgtgacgtcactcggggcgggacttccggccgccgaagtttaacagtccaggcgggagccggaagcccagcgcggagccggccgcggcccctgttgtgttgctgcggagaggtacttggatgcattttacaggttagcctcacttgagctgttgtcctgcaagtaaagtgtatttttggtgattgaaagttggagaactttcatttcagctgagtggtgtagttgaattggttcctgtagccgctgtccctaaacccaggccgacgttaccgccttgtgtcctgactgctagctttcgacgggaccgtctttgagggactcatgtaaagtctctcccttaatgctcagttcttagaagaccgaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtcaatagtcagagtccataccataactttgacagtgtacacaaagctccagcgtcaggcatctgtttttctcctgtcaatgaattgctctttgtaaccataggcttggataaaagaatcatcctctatgacacttcaagtaagaaagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagcagacccagggatctgagtgctggagcaactctgaaatcgctgtgcatttctgccctgctgccagctttcggggtggctggagcttgtttttcactatctaacctgttcctggctttctgtgcctcaggagaagtgtgtctgtcccactttcagccctgcagagctgctgcagcacgtttggtgaagacgtacagtcagtgcctcttggttttgctgccctgtgctgcatgtctgcacctaggagtggcctcctctcttcaagaccttggctcttacagccttggctaccttggtaggcccaaactcttaatactcccccacccagcgagactatctcaacctccaggccactgcttcagctcggtttcttctccacactgtggaatcagcacatactctagaaggaaaaacagagaaaaagatatgaaaaagcatttcaaggaagaggaatggtatatgaacacaggaaagatattcaacttcacaattaatcagagaactaaaaatgcaatgagataccgtgtcacaccgagtaaatgggaaaatataaaaaatctggtaatactaagtcttgatgatatagagcaagaagaactctgttatactggtgacatccattgataactacctttggaaaacaatttgcatgattttgtaaaagtatacacttgagttacagttggttatatcatcaatggacattggcacatgtgggtttggagataatacatgattgtttataacaacgttggaatagtaaaaacttgaaaacagtcaaaatattaacaggaaaatagatacaccagtacaaactaatgatatacagatatataaaacatgaatcttcaaaacaatattgaattatttcttaaatataagctatatggtacccttttttgtaatgctcaaaaacatgcacaatgaaaacattgactacagattatatgttatacaaatgtattaaaaaagcaaaagcatttctttgtccaacaaaattcaggagagtaatgacttctttcttgggctttttcccaagagttaagtgatagaatcagacaggaacacacaggaagcttctattatttggtaatgttctagttcataagttgtgtggtgggtgactgagtgtttcttttgttattatacttaataatttttacatattcttttgtaggcatgaattaattgtattttattgagtaagccatgctatatccacccaaattgccactttatactgaaagtacattttttcaatagctaaactgataataataaaatgatctttctaacctagtgaattttctgtatttcattgtaagataagtttgtgtcttaatgacaatttctatataaaggaatatagtatcggagagttcaggggttaaacagcctgggtttacatcctagctccatcatttactggttgtgtgactttgaacaagttatatctactctggttaagttatttcttttgtaaaatggacctgtaataattgcatctacttgtgaagatattttaaacgagttcttacatttaaagtaaaggaaacagtgcctagcacatagtgaataaatgctcagtgcattggtatttttattattatagtaattattaacattcagtaatttggcaaatgaaaaagttt

SEQ ID NO: 460499 - DNA, 3491 bp, Homo sapiens
caaacaacaggacacagcgaaggtaaaacggatgtctaggggagtggctaaaccatcactgtacactcaagagtctagcacagtgcctggcacacagtaaacagcaagtgaatgacaagcagttggcagtggccggagctccgtcgctggggcgtggagagggccgccccggcccgcagttcccgccctgacactgggataacttcccccgcggctgcccagcgccgccctgaccagaccctctgtaccccgacttctgtccggccagaagccacagccgcacgcagcgcctcgccccgtgacgtcactcggggcgggacttccggccgccgaagtttaacagtccaggcgggagccggaagcccagcgcggagccggccgcggcccctgttgtgttgctgcggagagttggagaactttcatttcagctgagtggtgtagttgaattggttcctgtagccgctgtccctaaacccaggccgacgttaccgccttgtgtcctgactgctagctttcgacgggaccgtctttgagggactcatgtaaagtctctcccttaatgctcagttcttagaagaccgaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtcaatagtcagagtccataccataactttgacagtgtacacaaagctccagcgtcaggcatctgtttttctcctgtcaatgaattgctctttgtaaccataggcttggataaaagaatcatcctctatgacacttcaagtaagaaagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagcagacccagggatctgagtgctggagcaactctgaaatcgctgtgcatttctgccctgctgccagctttcggggtggctggagcttgtttttcactatctaacctgttcctggctttctgtgcctcaggagaagtgtgtctgtcccactttcagccctgcagagctgctgcagcacgtttggtgaagacgtacagtcagtgcctcttggttttgctgccctgtgctgcatgtctgcacctaggagtggcctcctctcttcaagaccttggctcttacagccttggctaccttggtaggcccaaactcttaatactcccccacccagcgagactatctcaacctccaggccactgcttcagctcggtttcttctccacactgtggaatcagcacatactctagaaggaaaaacagagaaaaagatatgaaaaagcatttcaaggaagaggaatggtatatgaacacaggaaagatattcaacttcacaattaatcagagaactaaaaatgcaatgagataccgtgtcacaccgagtaaatgggaaaatataaaaaatctggtaatactaagtcttgatgatatagagcaagaagaactctgttatactggtgacatccattgataactacctttggaaaacaatttgcatgattttgtaaaagtatacacttgagttacagttggttatatcatcaatggacattggcacatgtgggtttggagataatacatgattgtttataacaacgttggaatagtaaaaacttgaaaacagtcaaaatattaacaggaaaatagatacaccagtacaaactaatgatatacagatatataaaacatgaatcttcaaaacaatattgaattatttcttaaatataagctatatggtacccttttttgtaatgctcaaaaacatgcacaatgaaaacattgactacagattatatgttatacaaatgtattaaaaaagcaaaagcatttctttgtccaacaaaattcaggagagtaatgacttctttcttgggctttttcccaagagttaagtgatagaatcagacaggaacacacaggaagcttctattatttggtaatgttctagttcataagttgtgtggtgggtgactgagtgtttcttttgttattatacttaataatttttacatattcttttgtaggcatgaattaattgtattttattgagtaagccatgctatatccacccaaattgccactttatactgaaagtacattttttcaatagctaaactgataataataaaatgatctttctaacctagtgaattttctgtatttcattgtaagataagtttgtgtcttaatgacaatttctatataaaggaatatagtatcggagagttcaggggttaaacagcctgggtttacatcctagctccatcatttactggttgtgtgactttgaacaagttatatctactctggttaagttatttcttttgtaaaatggacctgtaataattgcatctacttgtgaagatattttaaacgagttcttacatttaaagtaaaggaaacagtgcctagcacatagtgaataaatgctcagtgcattggtatttttattattatagtaattattaacattcagtaatttggcaaatgaaaaagttt

SEQ ID NO: 460500 - DNA, 2897 bp, Homo sapiens
ttgaaagctactctgtaagctatactcattgcttgtcttcttagtgtgttagcttttataatcgcaattcttataatagtctagtgctatagatgttcatggattgtttgatgctccataactcctcatttagataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtcaatagtcagagtccataccataactttgacagtgtacacaaagctccagcgtcaggcatctgtttttctcctgtcaatgaattgctctttgtaaccataggcttggataaaagaatcatcctctatgacacttcaagtaagaaagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagcagacccagggatctgagtgctggagcaactctgaaatcgctgtgcatttctgccctgctgccagctttcggggtggctggagcttgtttttcactatctaacctgttcctggctttctgtgcctcaggagaagtgtgtctgtcccactttcagccctgcagagctgctgcagcacgtttggtgaagacgtacagtcagtgcctcttggttttgctgccctgtgctgcatgtctgcacctaggagtggcctcctctcttcaagaccttggctcttacagccttggctaccttggtaggcccaaactcttaatactcccccacccagcgagactatctcaacctccaggccactgcttcagctcggtttcttctccacactgtggaatcagcacatactctagaaggaaaaacagagaaaaagatatgaaaaagcatttcaaggaagaggaatggtatatgaacacaggaaagatattcaacttcacaattaatcagagaactaaaaatgcaatgagataccgtgtcacaccgagtaaatgggaaaatataaaaaatctggtaatactaagtcttgatgatatagagcaagaagaactctgttatactggtgacatccattgataactacctttggaaaacaatttgcatgattttgtaaaagtatacacttgagttacagttggttatatcatcaatggacattggcacatgtgggtttggagataatacatgattgtttataacaacgttggaatagtaaaaacttgaaaacagtcaaaatattaacaggaaaatagatacaccagtacaaactaatgatatacagatatataaaacatgaatcttcaaaacaatattgaattatttcttaaatataagctatatggtacccttttttgtaatgctcaaaaacatgcacaatgaaaacattgactacagattatatgttatacaaatgtattaaaaaagcaaaagcatttctttgtccaacaaaattcaggagagtaatgacttctttcttgggctttttcccaagagttaagtgatagaatcagacaggaacacacaggaagcttctattatttggtaatgttctagttcataagttgtgtggtgggtgactgagtgtttcttttgttattatacttaataatttttacatattcttttgtaggcatgaattaattgtattttattgagtaagccatgctatatccacccaaattgccactttatactgaaagtacattttttcaatagctaaactgataataataaaatgatctttctaacctagtgaattttctgtatttcattgtaagataagtttgtgtcttaatgacaatttctatataaaggaatatagtatcggagagttcaggggttaaacagcctgggtttacatcctagctccatcatttactggttgtgtgactttgaacaagttatatctactctggttaagttatttcttttgtaaaatggacctgtaataattgcatctacttgtgaagatattttaaacgagttcttacatttaaagtaaaggaaacagtgcctagcacatagtgaataaatgctcagtgcattggtatttttattattatagtaattattaacattcagtaatttggcaaatgaaaaagttt

SEQ ID NO: 460501 - DNA, 1441 bp, Homo sapiens
ggcggccgggcagaggccaagtgggcaccggatagcgccagccccgcccagagagcgaaatcatggagccttccaagaccttcatgagaaacctgccaatcacaccaggctatagcggctttgtgccattcctcagctgccaaggaatgtccaaggaggatgacatgaaccactgtgtgaaaaccttccaggagaaaacacagcgctataaagaacagctgcgggaattgtgctgcgcagtggccactgccccgaaactgaaacctgtcaactccgaggagacggtcctgcaggccctgcaccagtacaatctgcagtaccaccccctgatcctggaatgcaaatatgtaaagaaacctctccaggagcccccgatccctggctgggcaggctacctgccgagagccaaggtcactgaatttggctgtggcacgagatacactgtcatggccaaaaactgctacaaggacttcctggagatcacggagagggccaagaaggcacatctgaaaccatatgaagagtgaggagaaatgtctctttccttcctactaccgttttaaaaaggggatgaaatgtttgcagtggcctttctgcttagctgggccagctccctgcaactcacacggacggttcctctcctagatggaagctgccctgcccttggaaggcccctgagagaggaccccaaaactccgctgacatgtggctgtgctcagaggccaagtataccatgcagtgggaagatgtatctagagccactgtcctccgcaaagtatgcagaaggctagaagcgcagagtctcccaaggaggtgaactttaagtggggcttccaaaacctgccattctcatgttggaatcacgcccagtgagcaataaagaaatttagtaacaagaaatttttaactgccgcctgcatcctgagtggttgacggttgcatgtcattaatgataaagaccgttttttgtcatgtgggaataaagaggctgcttctccgcatgctaaagtttcttgtgcgggttttctccaggttatgttgaccatgagctagggttcctaacccccgagatggcctctggttccttaagcatattacctttccccaaacaatccaaagtttcccttggttccaggtctagagtgagcaacccaggcttttcataccctgcattaaagttaaaatctaatttagatgaaaatggatgcatagaaattaaacgtgcgtgcgtggctttcgtcgttaagttgtgggccccgtaacgagagctttaccaaatttattcccttggcttgaaaataaaaatgctttttgaaatttgattttgttgtgttacaaattgttttagctttgtgaatagtacaaaccccatttctgatctacctcaaacaaaaatagagcattaaagtgtttaagattcaatcaaaggcttgctgtgagc

SEQ ID NO: 460502 - DNA, 1001 bp, Homo sapiens
ggcggccgggcagaggccaagtgggcaccggatagcgccagccccgcccagagagcgaaatcatggagccttccaagaccttcatgagaaacctgccaatcacaccaggctatagcggctttgtgccattcctcagctgccaaggaatgtccaaggaggatgacatgaaccactgtgtgaaaaccttccaggagaaaacacagcgctataaagaacagctgcgggaattgtgctgcgcagtggccactgccccgaaactgaaacctgtcaactccgaggagacggtcctgcaggccctgcaccagtacaatctgcagtaccaccccctgatcctggaatgcaaatatgtaaagaaacctctccaggagcccccgatccctggctgggcaggctacctgccgagagccaaggtcactgaatttggctgtggcacgagatacactgtcatggccaaaaactgctacaaggacttcctggagatcacggagagggccaagaaggcacatctgaaaccatatgaagagtgagtctggcttgggtccgtaccccaggcacaaggtcaaagggagaagtgcaaacccaggatgggggtttaccagatgtccccatcccagcactaggactatttgtgtgtgatttgtcttagagaaggtgcctcatttgtagtttcagggcttccccagtaggcaggtgccctctgctcccaacctgtgctcagcattccccagcagctctacctgtggtctttgctggtttgcagggaggggatgggagtaaaaaccagcagggctaccatcctggcagtggcttaaggcccaagggtgctgagtggcctcagctttctcttctgcgaaatgaggagggtgatctttacctttagaataaattgtaaagaaataacataccatgttcatatatttactcatatttatgtattgtattttattctatttattattattctattcttaataaaaggtccataactttgtgacttctat

SEQ ID NO: 460503 - DNA, 1417 bp, Homo sapiens
ggcggccgggcagaggccaagtgggcaccggatagcgccagccccgcccagagagcgaaatcatggagccttccaagaccttcatgagaaacctgccaatcacaccaggctatagcggctttgtgccattcctcagctgccaaggaatgtccaaggaggatgacatgaaccactgtgtgaaaaccttccaggagaaaacacagcgctataaagaacagctgcgggaattgtgctgcgcagtggccactgccccgaaactgaaacctgtcaactccgaggagacggtcctgcaggccctgcaccagtacaatctgcagtaccaccccctgatcctggaatgcaaatatgtaaagaaacctctccaggagcccccgatccctggctgggcaggctacctgccgagagccaaggtcactgaatttggctgtggcacgagatacactgtcatggccaaaaactgctacaaggacttcctggagatcacggagagggccaagaaggcacatctgaaaccatatgaagaaatatatggagttagctccacaaaaacttctgctccgtctccaaaagttttgcagcatgaagagctgctgccaaaatatcccgatttttctattccagatggaagctgccctgcccttggaaggcccctgagagaggaccccaaaactccgctgacatgtggctgtgctcagaggccaagtataccatgcagtgggaagatgtatctagagccactgtcctccgcaaagtatgcagaaggctagaagcgcagagtctcccaaggaggtgaactttaagtggggcttccaaaacctgccattctcatgttggaatcacgcccagtgagcaataaagaaatttagtaacaagaaatttttaactgccgcctgcatcctgagtggttgacggttgcatgtcattaatgataaagaccgttttttgtcatgtgggaataaagaggctgcttctccgcatgctaaagtttcttgtgcgggttttctccaggttatgttgaccatgagctagggttcctaacccccgagatggcctctggttccttaagcatattacctttccccaaacaatccaaagtttcccttggttccaggtctagagtgagcaacccaggcttttcataccctgcattaaagttaaaatctaatttagatgaaaatggatgcatagaaattaaacgtgcgtgcgtggctttcgtcgttaagttgtgggccccgtaacgagagctttaccaaatttattcccttggcttgaaaataaaaatgctttttgaaatttgattttgttgtgttacaaattgttttagctttgtgaatagtacaaaccccatttctgatctacctcaaacaaaaatagagcattaaagtgtttaagattcaatcaaaggcttgctgtgagc

SEQ ID NO: 460504 - DNA, 1524 bp, Homo sapiens
ctctctggtttctcttcttataatcgtagcgagtgcacggagtgtgtgactgtgccctccgatggatggcatcctctctggggttggtttttgccttgtgttctcagctgctgggacacccatgcccctgaactggatggaattagcagtttctggtgacacagacgtcaacatgactaacaatgtccatgctctcagcaacacatttatcttcaactgcttgaatttaacagtaaaacaatcagaaaacatgagtaaaaatcaaaaggcaaaaaataaggaatgtaacttctcactgagagattatttggggatggagagggttgcctctccaaggggccaagcgaatgaagagggcacaccaagagcatcatttactggaaagggggctgctggagaaaagagcaccaatatctcacttgcctattggaagtctgcttatgcagtctctcaaactggggcctggctggcatcagagagagggaataatatgagctctgatttagaagggacattgattaacttaaccaaaatgaacttcaccagaaaaccaaaagatctctgcctcgcatacatcaatgtgtgggaaagggagtttcaagagaatgtctctgcaaatattgcctgcagaaataaatgagttatgtctgagccccaccaaattaataaactggtttcacaagtaatctttgaccagttactcaatatcactgagcttcaaaactgggttacctcatttaaaacactgaggtgctagtaccacacctttatacatttattatgtaatctctatgactgcatatcatatggctgatgttcttcagacacaatatatgattagagactggcagttctattatatggcactgcagaaagttagagcccttcatcaagtaaaaacctttaagaagtcaaagcaaggtcactaacactcaagggaaattgtgtttttcacaaaattgccttacaagtgagggagggaatgggaaaatatgtttttaaatcttttacttcttcacgttaaatcattctatttacacagttagataaagatataaatttagagtttttagatctttggggatgaaggttcatttgtggaatagccccttctctgtggcattgatatggcatgccaattttgtcatataatgaggttccacacaagcatggttctgtttctcagcattctgactgtttctgcacctatgccacactgaataaccaaagctcaagagttaagtcatctggtttaacagttctggaggctgggaagtgcaagaccaagatatgaacagattcattatctggtacagataccctgcatatttttggcctcatatgaagaaagaaatgtttttgaaagtttacgtgtgtgcatttatcatcataaatacatttaattcattgtaaagacatagcaagataatcagctgtctgataattataaggtgttgattagaaaataggtacttactttaaataaaattgttatattaaactatctggctttacctgcccttt

SEQ ID NO: 460505 - DNA, 523 bp, Homo sapiens
agccacaggtcagcctggggaaaaagcaggaagaaaaactggcaatacgagggcccaacccaaaagttattcctgaagagaaacaacggttcatttgtggaatagccccttctctgtggcattgatatggcatgccaattttgtcatataatgaggttccacacaagcatggttctgtttctcagcattctgactgtttctgcacctatgccacactgaataaccaaagctcaagagttaagtcatctggtttaacagttctggaggctgggaagtgcaagaccaagatatgaacagattcattatctggtacagataccctgcatatttttggcctcatatgaagaaagaaatgtttttgaaagtttacgtgtgtgcatttatcatcataaatacatttaattcattgtaaagacatagcaagataatcagctgtctgataattataaggtgttgattagaaaataggtacttactttaaataaaattgttatattaaactatctggctttacctgcccttt

SEQ ID NO: 460506 - DNA, 422 bp, Homo sapiens
aaaattcttaaagtacttgaaaatccaagactattttcattttgtaactattttcaaatgtatttaacatttaggttcaaagccaggagcagtggcaaagcacctgttgtcccagctacttgagaggctggagctggaagatcacttaaggccaagagttcaagaccagcccggatgacatagagagattcccatcttttttaaaaaagtacagataccctgcatatttttggcctcatatgaagaaagaaatgtttttgaaagtttacgtgtgtgcatttatcatcataaatacatttaattcattgtaaagacatagcaagataatcagctgtctgataattataaggtgttgattagaaaataggtacttactttaaataaaattgttatattaaactatctggctttacctgcccttt

SEQ ID NO: 460507 - DNA, 1091 bp, Homo sapiens
acagcagccacttgggcacacatgaatccctgggagctttggatagccaggcttcccagcaaaacagtgatgatctgcaggccccacttccgtgacacttcacaggacccgctgacttggaactccagtaagccactggtagcagcattgcacctctctgagggagctcccagagtaaggggtggctgccatcttagctgtttctcagttttagctatcgttgccttcggtgctctagggagtccgaggagaccagggaatgaagcgctccccagcacagtgcagcagttctacagagaagcagccagactgatttttcgtgcaagtcctttatgctgtttctctttactgggcagaatctccaaaccgaggacgacaaccacccccatagatgtgttcaggcaagcaaataggattacatatgcatatgattagttgttcattcatttattaatttattcactcaatcacctgtataccaaatatgtattaagtatctgttatgtgccaggaacctgttccaggttcagagaatacagtgaataaacagactgaaccctgctctcaatgaacatcttcatgttacttgatatgagttcattccttgaactagaacatcaataagatgctggagtttaatcaaccacagcagactgtgaggtggaagccacttggtgattgtgagccagcaccaagatcgaaggcatttggatccctggtgatcacagacccagcatgtcatctctgcaaaggtctttgagcaggagcccaaggaaggaaaaataaggacacacatttttggctggattagtaacatctttcctttgtcttcatccaccagtgttcttgcttcccagaaagtgtggaatattggccttccttttcagattcatgtgaaagcttggagaaaagaacacagactaaaaggaatataaatccaaaagaatgagtgaaatgggaatacacaaggcatgagcaataagactgttctctcagaaacaatgagaataactgctctacatcttacaaaccagaaacttacacgttgtatctcattaaattttattttgaatattgagaacattcagtgc

SEQ ID NO: 460508 - DNA, 776 bp, Homo sapiens
agcggcggtttgcttcttgatccccgacatgctggctggctgcggcggagcccgggtcccgggagcagagaccgaaggacgcagggacggcggcggcggcggcggcagcagcagcagcagcagcagcagcagcggctgccggactcccgggaaggagatgctcgtgtcaaagagaagagctacaagactgtttctgcccccaaggtgctccagtccattggagaagcaaacacataactgagaatgactcaccttgtgatggctgctatgatgaggttcatacctggtgctacaggacacagagaggcataataatgtggtcacactaatgcaagaagtagattcccatggtcttgggcactctgcccctgtggctttgcagggtacagcctcccttctgtctgatttcacaggccggcattgaatgtctgtgacttttccaggtggagtcttgctctgtcacccaggttggagtgcagtggcacgatcttggctcactgcaacctccacctccttggttcaagtgattctactgcctcagcctcccaagtagctgggattacaggcatgcaccaccaggcctggctaatttttgtatttttagtagagatggggtttcaccatgttggccaggctgctcttgaactcctgacctcaggtgatctgcctgcctctgcctcccaaagtattgggattacaggcgtgagccactgtggccaggccgaactacctttttcatattacataagatacagtcttagatctgactgttcatt

SEQ ID NO: 460509 - DNA, 993 bp, Homo sapiens
ctaagtcaagacaataaagctaatgcacatagcacttaatactcttctgagtaccttacatatattaactaatttaaccttcataacaactatgaagcagatggctggtaaagtattgttgctgggtgtgtctgtgagggtgttatcagcagagattgacagtcgagttggtggactggaagaggaagacccaccctcaatgcccaccagaggcaatttgcctcttactcctgtccataaggcctaccagaggcaatttgccttcagccagcaaggccagcaatgtcttgctcacagagattttgatcacttttcccttccacaagatatcacactagttcattgcatcagtgacactatgctaattggacccaatgctcgtgtcaaagagaagagctacaagactgtttctgcccccaaggtgctccagtccattggagaagcaaacacataactgagaatgactcaccttgtgatggctgctatgatgaggttcatacctggtgctacaggacacagagaggcataataatgtggtcacactaatgcaagaagtagattcccatggtcttgggcactctgcccctgtggctttgcagggtacagcctcccttctgtctgatttcacaggccggcattgaatgtctgtgacttttccaggtggagtcttgctctgtcacccaggttggagtgcagtggcacgatcttggctcactgcaacctccacctccttggttcaagtgattctactgcctcagcctcccaagtagctgggattacaggcatgcaccaccaggcctggctaatttttgtatttttagtagagatggggtttcaccatgttggccaggctgctcttgaactcctgacctcaggtgatctgcctgcctctgcctcccaaagtattgggattacaggcgtgagccactgtggccaggccgaactacctttttcatattacataagatacagtcttagatctgactgttcatt

SEQ ID NO: 460510 - DNA, 709 bp, Homo sapiens
cctgtgtaggacactcaccatgaatgcagctttcaggactggaagttgctctggctggaactctctggagccccaaagcagggtccctgacagaaactgcatctccaggggacctaaccactgttagaacttggggccacgggggctggctgctcgacaggactcctccactccgtttgtgtttccttttctttcttgcagaagagccgtcctctggcagatatgtgaaagaactgcctatgaggagcgagaggctacttcgcacacctcgcagctcaggactccaccaggcacttggtaattctgccttatccttcactttttgcttgagcagcgccgaaaggagggaaatttggacatggacacatagggaagacagccatgtggagacagaggcagaggtggacctgctgccgcaaaaccacagggcgccaagtactgtgggccactgagaaaactaaaggagaggaaggattcttccctggagctttggagagggtaatgaactgtaacctcactggacgtgtaaacagactgtgacctacctactcttgtgccaatcatggagtttcagccaatcacaggcggccggctgttcaaaccatgtttaaataaggcaaacgcagagctgtaagcaatctaggtgtttctgcacctctcgtccattttctgtaagtcctttttctgttcataaatcttcttccatcac

SEQ ID NO: 460511 - DNA, 1233 bp, Homo sapiens
gacattacaacaaaatttaagtgattttcttaaaaattagttgtaatatgggatatgaaaccatacgaatgaatattttatacactttgaactgcgttggctatctttactttttaaaatttgtgtacacttatggatactttttaaaatttgtatacatttatgagtacaagtataattttgttatatattgcatagtgatgaagtcaaggcatttggtgtacacatcactgaatgaagagcaagcgaaagcaagatcctggaagatactggcaagtggccggatcacagaatccaggttagaaaggggggaaaaaaaggtcaagagaggtctgacaaatcaggagaaaatgaatggaataacgaaatggaagaatctttctaaagaacataatctcaaattccctgctgctcactttttgtaaaaattaagaaatattcaccaaaaaaaaaaaagtcaggagaatatgaagccactcattttacttctagaagtttttcttacagaaaatcaatcaaggagagagaattgtgtattaatttaattgtttggcctttagaatcatgttccttagagggcatcggtgcgacggcttcaccattctgcacatccacctgagttttaaaacacggtttctactaaacatctggtatcttgtatacaggggatgaatgtggtcttgtttccttctttagctgctggaaaccttagagcaaaaaataaggccacttttgtaactgtgtctgactcagcagcataacttttccgttgtcttccatgtgctatcctgtttttatttttcctttcccttgattgctctctatacatacatttttgagaagttgtttttctttatttttcaaactaattcattcaatactctcctccaggtagagtttataattgtttgtagttgagaaaattggactagaatgaagccttgtggaatccaagaagaattcgttattctttagctgctttcatctccaactgtgttaggcatcctcctaagatggtccccaagatggcagacccctggaatcatctgtacaatttcctctcttttcacaggcttttatgagttgatttttcagcgaaccttcaaggggctaaggggaacattacccttggccactatactgccaacaacctatgagcctggaagaggatcccaagtctcagatgaaaccaggacctcagccaacaccttgatttcagcctcatgagatcct

SEQ ID NO: 460512 - DNA, 1366 bp, Homo sapiens
gacattacaacaaaatttaagtgattttcttaaaaattagttgtaatatgggatatgaaaccatacgaatgaatattttatacactttgaactgcgttggctatctttactttttaaaatttgtgtacacttatggatactttttaaaatttgtatacatttatgagtacaagtataattttgttatatattgcatagtgatgaagtcaaggcatttggtgtacacatcactgaatgaagagcaagcgaaagcaagatcctggaagatactggcaagtggccggatcacagaatccaggttagaaaggggggaaaaaaaggtcaagagaggtctgacaaatcaggagaaaatgaatggaataacgaaatggaagaatctttctaaagaacataatctcaaattccctgctgctcactttttgtaaaaattaagaaatattcaccaaaaaaaaaaaagtcaggagaatatgaagccactcattttacttctagaagtttttcttacagaaaatcaatcaaggagagagaattgtgtattaatttaattgtttggcctttagaatcatgttccttagagggcatcggtgcgacggcttcaccattctgcacatccacctgagttttaaaacacggtttctactaaacatctggtatcttgtatacaggggatgaatgtggtcttgtttccttctttagctgctggaaaccttagagcaaaaaataaggccacttttgtaactgtgtctgactcagcagcataacttttccgttgtcttccatgtgctatcctgtttttatttttcctttcccttgattgctctctatacatacatttttgagaagttgtttttctttatttttcaaactaattcattcaatactctcctccaggtagagtttataattgtttgtagttgagaaaattggactagaatgaagccttgtggaatccaagaagaattcgttattctttagctgctttcatctccaactgtgttaggcatcctcctaagatggtccccaagatggcagacccctggaatcatctgtacaatttcctctcttttcacaggtaagggattttataaacataataagatttctttcctgtaattgggttacattgaataacaaaggtgaagggattacacagatgtaatgaaggtccctactcacttggctctgagttaatcaaaagggagattatcctaagtgggcctgacctaatcaggtgagctcttgataagagggtgctggccttccctgagagattcaaagcagcacaaatgctctcctgttggatttgtagaaacataatgctatgctgtgaaaagggccacttagggctgcagtcctccagctataa

SEQ ID NO: 460513 - DNA, 1177 bp, Homo sapiens
ggagattcccatggatggtatgaacaccagggaaataaactggatccagatgaccaacatcaggaaactacataatgggaagcccctgcaggctccctcaaagaagcctcattatagatctagcttttggatactgtcacacagaggttatcaaaatccagttaatgaggactgcatccttacccagtcaagtaagaaaataatcgcccttttctctgtacttgggatagagaaaaaaaggctttccatcatccctcctctgtctttggtggttaaggttctattacctgaaaaattgtgtagccaaagcgccaataaccagcttgtaaaaggagataatgacttgaaacagagcagtaacagaggtggtggtgagaagcagtcagcttctgaatgtagaataaagagccattaaatccatttagcttatcattgactgaagtactgtttttataattatttgtgatatatactttcatagtaaaatgtttgaaaatatagacttagttattaccaggaacagatgaccagttgcaagaactgtcactattttaacattctccatcagctgtggccatgttggatttctggcacctgagcattcacatccatctgtttatagggcattatgcccactcatgaggtttattccagtttcaaaaagtcatgtgtaaaccaagattggaaatatatattccttgagaaatagagacacagacacacaagggagagtgccatatgaaaatggaggcagaatggagtgatgcatctacaagccaaggaacaccaaaaattgccagcaactactagaagctagaagaggcaagaaaggactttctagagcctttggaaagcatgattctgccacatcttgattttggacttccagcctctagaactgtgagagagtaagtttccattgttttaaaccacccaatttgtattaatttgttatagaagccctgggaaacaaataaactactttagatcagttaggaaggcttcttgaactatatgacatttaaacagagacataaatgatgagactgtcccagccaagttaaaaatatcactgggaatcaaactcactggtgttattccagctcagtggtaaatgttctactggtattttaaataattctaaaataaagtcattatttttctttgcactccaaag

SEQ ID NO: 460514 - DNA, 3325 bp, Homo sapiens
  misc_feature (2)..(2): n is a, c, g, or t
  misc_feature (6)..(6): n is a, c, g, or t
  misc_feature (9)..(9): n is a, c, g, or t
  misc_feature (11)..(11): n is a, c, g, or t
  misc_feature (13)..(15): n is a, c, g, or t
  misc_feature (482)..(482): n is a, c, g, or t
  misc_feature (485)..(485): n is a, c, g, or t
  misc_feature (490)..(491): n is a, c, g, or t
antggnaancntnnngaaagaagccattttgggatgtctggatttcagctgcttgcagatgggggagttggtggagaatgggttggagagattaggagttgttgggtggaatcacccacaggagagacactgctgtgcaagccacaccaatattttcaccaaattgagcttctggatgccaagatcccttgggctccagaggtggtgatgctgctgtgggctgccactctaggcaaggagtacatcccaccatcagaggaagaagaagatggaaagaagaagtttgacaaagagagtgaaaaatattactctatccttgaaaagcatttaaatttgtccgcaaagaaaaaggagtctcatttacaagaggcagatacacaaattgaccgagaacatcagaacttctatgaagcatcattagaatatgtctttaaaattcaagaggtccaagaaaaaaagaagtttgaatttgttgaaccgangtntcaannaggtatcaccattttaggactctaccgaataggaggagtgaactccaaagttcaaaaactcatgaataccacattttctcctaaatcccctcctgatattgatattgatattgaactgtgggacaataagacgataacaagtgggctgaaaaactacctcaggtgccttgcagaaccactgatgacttacaagttgcacaaagattttatcattgctgttagtgactcctatagcagcagcccagacagcacacctatggggagcattgagtcactctcttctcattcctctgaacaaaatagcactacaaagtcagcttcctgccagcccagggagaaatctggagggattccttggattgcaaccccatcatcttccaatggacagaaaagccttggtctgtggacaactagtcctgaatcaagttccagagaagatgcaaccaagacagatgcagaatcagactgccagagtgttgcttcagtcactagcccaggagacgtttccccacccatagacctagtcaagaaagagccttatgggctttcaggactgaaaagagcttctgcttcttctctcagatccatctctgcagctgaaggaaacaagagctacagtggatctattcaaagcttaacttctgtaggttccaaggagacacccaaagcttcaccaaacccagacctgcctccgaaaatgtgcaggagattaagactagacactgcctcaagcaatggctatcagcggcctggctcagtagtggcagcaaaagctcaactgtttgaaaatgttggttcacctaaaccagtttcttctgggcgccaagccaaagccatgtactcctgtaaagcagagcacagtcatgagctttccttcccacaaggagcaatattttctaatgtgtacccatcagtggaaccaggatggttaaaggcaacttatgaaggcaaaacaggactagttccagaaaattatgttgtcttcctctaatactatttagtggatggcagtatcttcatggtatccatggtaacgaataaatgctatgattttatctgacacagatacacggggatcagcccactaagtgaaaacagtcaatttctatcaagttcttcaccagcagactatgtagctccttattaatggaaaaaaagatttaaattgttggccattcttttttggttggtttcttattttaaaatatcttacttgtgaaaaatgtgtttttggataatatgtaactctccacaatgtcgcttccgtagcaattgtagagtttcaaatactgtgttaaatactgtatcccagaaatttggaaaccagaaatctgctatatggattttgagatctgtcctttactgcctggcattctctgaggatctctgaaattgttacttaaaaatgtaatttaaattgttcatttattgttttttttttcttagaaatatactgcttttatatatgattgttttgctggtcctaaacatttcaaggatgtaagtctttgttttaatataactttatttgttttccaagtagatgataatattcaaaagcaataatgtatatgatatctataaaggaagcaaaattaagtcatacactgattccactgtaaacaatctgtccagaattccagacaccttcagcaaactttttctgtaaaggcctgatagcaaatatttttgtggtgggttgaatttggcttatgggttatagtttgctgacacctagtttagagggtgtgtaaaactatcttcataactttgagatttttataaaattttacatgaaaatatactgataaattatatgcacatattttctaccagtagcattatagtggcatcatagaagaatatttaccaatgatggggaaactgtaaaactacagtatcaaggcatacaacttaaattccacttggaagattgtaaagtgtcaaagtattttaatgataatttaatttgggcttttgaaatgttcttctacaaatgaaaaagatgtttaaaaacgttacaagggaagctatgccttctgaagtctatccttagttgaaacagaaaataaacacaaaggtacaagatccttaaattattttgaaccacagaggttgaaattgttttgtgatcttcagcagaaataaaatctgtacatgattttcttttatgccttttagtttacagtctttattagcaatttcagtgaatttgtagagcatagtaataggtatttactgtccacttatatatatcagcatctggtcatgcacgaaccattaattctatatttctatttcaataattctaatatattatttctataaatgtaatatctgtatgtggcaaagagcctttcttctcaagatcctgaaaagctggttacctgccctttgagtgccacagtcctgaactgcttgttcttgacatcttgcatattacttcagagttccccactgtgcagactctcaggtattaactgtaaaaaactctttacatgccattattatctgtaatctctatctcttctactttaaattaatgtttctagaattaataggttaaatacacatacacacacacaactatgcctcagaaaagttaggcttttacaaataaaaagaataagattagaattaacaagtagagagaataacggtaggcagagtcagaatcaggaataaatatcagtgaatcaaaagaatgaaaaatattatgtaataaaaattagcaatgtaatgtaaacgtttgataaaagagtatctttttcttttatctcttactgttgacctctgtgcactgtaataaggtgtgttgctggatcttcttggtc

SEQ ID NO: 460515 - DNA, 3271 bp, Homo sapiens
  misc_feature (2)..(2): n is a, c, g, or t
  misc_feature (6)..(6): n is a, c, g, or t
  misc_feature (9)..(9): n is a, c, g, or t
  misc_feature (11)..(11): n is a, c, g, or t
  misc_feature (13)..(15): n is a, c, g, or t
  misc_feature (482)..(482): n is a, c, g, or t
  misc_feature (485)..(485): n is a, c, g, or t
  misc_feature (490)..(491): n is a, c, g, or t
antggnaancntnnngaaagaagccattttgggatgtctggatttcagctgcttgcagatgggggagttggtggagaatgggttggagagattaggagttgttgggtggaatcacccacaggagagacactgctgtgcaagccacaccaatattttcaccaaattgagcttctggatgccaagatcccttgggctccagaggtggtgatgctgctgtgggctgccactctaggcaaggagtacatcccaccatcagaggaagaagaagatggaaagaagaagtttgacaaagagagtgaaaaatattactctatccttgaaaagcatttaaatttgtccgcaaagaaaaaggagtctcatttacaagaggcagatacacaaattgaccgagaacatcagaacttctatgaagcatcattagaatatgtctttaaaattcaagaggtccaagaaaaaaagaagtttgaatttgttgaaccgangtntcaannaggtatcaccattttaggactctaccgaataggaggagtgaactccaaagttcaaaaactcatgaataccacattttctcctaaatcccctcctgatattgatattgatattgaactgtgggacaataagacgataacaagtgggctgaaaaactacctcaggtgccttgcagaaccactgatgacttacaagttgcacaaagattttatcattgctgttagtgactcctatagcagcagcccagacagcacacctatggggagcattgagtcactctcttctcattcctctgaacaaaatagcactacaaagtcagcttcctgccagcccagggagaaatctggagggattccttggattgcaaccccatcatcttccaatggacagaaaagccttggtctgtggacaactagtcctgaatcaagttccagagaagatgcaaccaagacagatgcagaatcagactgccagagtgttgcttcagtcactagcccaggagacgtttccccacccatagacctagtcaagaaagagccttatgggctttcaggactgaaaagagcttctgcttcttctctcagatccatctctgcagctgaaggaaacaagagctacagtggatctattcaaagcttaacttctgtaggttccaaggagacacccaaagcttcaccaaacccagacctgcctccgaaaatgtgcaggagattaagactagacactgcctcaagcaatggctatcagcggcctggctcagtagtggcagcaaaagctcaactgtttgaaaatgttggttcacctaaaccagtttcttctgggcgccaagccaaagccatgtactcctgtaaagcagagcacagtcatgagctttccttcccacaaggagcaatattttctaatgtgtacccatcagtggaaccaggatggttaaaggcaacttatgaaggcaaaacaggactagttccagaaaattatgttgtcttcctctaatactatttagtggatggcagtatcttcatggtatccatggtaacgaataaatgctatgattttatctgacacagatacacggggatcagcccactaagtgaaaacagtcaatttctatcaagttcttcaccagcagactatgtagctccttattaatggaaaaaaagatttaaattgttggccattcttttttggttggtttcttattttaaaatatcttacttgtgaaaaatgtgtttttggataatatgtaactctccacaatgtcgcttccgtagcaattgtagagtttcaaatactgtgttaaatactgtatcccagaaatttggaaaccagaaatctgctatatggattttgagatctgtcctttactgcctggcattctctgaggatctctgaaattgttacttaaaaatgtaatttaaattgttcatttattgttttttttttcttagaaatatactgcttttatatatgattgttttgctggtcctaaacatttcaaggatgtaagtctttgttttaatataactttatttgttttccaagtagatgataatattcaaaagcaataatgtatatgatatctataaaggaagcaaaattaagtcatacactgattccactgtaaacaatctgtccagaattccagacaccttcagcaaactttttctgtaaaggcctgatagcaaatatttttgtggtgggttgaatttggcttatgggttatagtttgctgacacctagtttagagggtgtgtaaaactatcttcataactttgagatttttataaaattttacatgaaaatatactgataaattatatgcacatattttctaccagtagcattatagtggcatcatagaagaatatttaccaatgatggggaaactgtaaaactacagtatcaaggcatacaacttaaattccacttggaagattgtaaagtgtcaaagtattttaatgataatttaatttgggcttttgaaatgttcttctacaaatgaaaaagatgtttaaaaacgttacaagggaagctatgccttctgaagtctatccttagttgaaacagaaaataaacacaaaggtacaagatccttaaattattttgaaccacagaggttgaaattgttttgtgatcttcagcagaaatatttcagtgaatttgtagagcatagtaataggtatttactgtccacttatatatatcagcatctggtcatgcacgaaccattaattctatatttctatttcaataattctaatatattatttctataaatgtaatatctgtatgtggcaaagagcctttcttctcaagatcctgaaaagctggttacctgccctttgagtgccacagtcctgaactgcttgttcttgacatcttgcatattacttcagagttccccactgtgcagactctcaggtattaactgtaaaaaactctttacatgccattattatctgtaatctctatctcttctactttaaattaatgtttctagaattaataggttaaatacacatacacacacacaactatgcctcagaaaagttaggcttttacaaataaaaagaataagattagaattaacaagtagagagaataacggtaggcagagtcagaatcaggaataaatatcagtgaatcaaaagaatgaaaaatattatgtaataaaaattagcaatgtaatgtaaacgtttgataaaagagtatctttttcttttatctcttactgttgacctctgtgcactgtaataaggtgtgttgctggatcttcttggtc

SEQ ID NO: 460516 - DNA, 3268 bp, Homo sapiens
  misc_feature (2)..(2): n is a, c, g, or t
  misc_feature (6)..(6): n is a, c, g, or t
  misc_feature (9)..(9): n is a, c, g, or t
  misc_feature (11)..(11): n is a, c, g, or t
  misc_feature (13)..(15): n is a, c, g, or t
  misc_feature (482)..(482): n is a, c, g, or t
  misc_feature (485)..(485): n is a, c, g, or t
  misc_feature (490)..(491): n is a, c, g, or t
antggnaancntnnngaaagaagccattttgggatgtctggatttcagctgcttgcagatgggggagttggtggagaatgggttggagagattaggagttgttgggtggaatcacccacaggagagacactgctgtgcaagccacaccaatattttcaccaaattgagcttctggatgccaagatcccttgggctccagaggtggtgatgctgctgtgggctgccactctaggcaaggagtacatcccaccatcagaggaagaagaagatggaaagaagaagtttgacaaagagagtgaaaaatattactctatccttgaaaagcatttaaatttgtccgcaaagaaaaaggagtctcatttacaagaggcagatacacaaattgaccgagaacatcagaacttctatgaagcatcattagaatatgtctttaaaattcaagaggtccaagaaaaaaagaagtttgaatttgttgaaccgangtntcaannaggtatcaccattttaggactctaccgaataggaggagtgaactccaaagttcaaaaactcatgaataccacattttctcctaaatcccctcctgatattgatattgatattgaactgtgggacaataagacgataacaagtgggctgaaaaactacctcaggtgccttgcagaaccactgatgacttacaagttgcacaaagattttatcattgctgttagtgactcctatagcagcagcccagacagcacacctatggggagcattgagtcactctcttctcattcctctgaacaaaatagcactacaaagtcagcttcctgccagcccagggagaaatctggagggattccttggattgcaaccccatcatcttccaatggacagaaaagccttggtctgtggacaactagtcctgaatcaagttccagagaagatgcaaccaagacagatgcagaatcagactgccagagtgttgcttcagtcactagcccaggagacgtttccccacccatagacctagtcaagaaagagccttatgggctttcaggactgaaaagagcttctgcttcttctctcagatccatctctgcagctgaaggaaacaagagctacagtggatctattcaaagcttaacttctgtaggttccaaggagacacccaaagcttcaccaaacccagacctgcctccgaaaatgtgcaggagattaagactagacactgcctcaagcaatggctatcagcggcctggctcagtagtggcagcaaaagctcaactgtttgaaaatgttggttcacctaaaccagtttcttctgggcgccaagccaaagccatgtactcctgtaaagcagagcacagtcatgagctttccttcccacaaggagcaatattttctaatgtgtacccatcagtggaaccaggatggttaaaggcaacttatgaaggcaaaacaggactagttccagaaaattatgttgtcttcctctaatactatttagtggatggcagtatcttcatggtatccatggtaacgaataaatgctatgattttatctgacacagatacacggggatcagcccactaagtgaaaacagtcaatttctatcaagttcttcaccagcagactatgtagctccttattaatggaaaaaaagatttaaattgttggccattcttttttggttggtttcttattttaaaatatcttacttgtgaaaaatgtgtttttggataatatgtaactctccacaatgtcgcttccgtagcaattgtagagtttcaaatactgtgttaaatactgtatcccagaaatttggaaaccagaaatctgctatatggattttgagatctgtcctttactgcctggcattctctgaggatctctgaaattgttacttaaaaatgtaatttaaattgttcatttattgttttttttttcttagaaatatactgcttttatatatgattgttttgctggtcctaaacatttcaaggatgtaagtctttgttttaatataactttatttgttttccaagtagatgataatattcaccactgtaaacaatctgtccagaattccagacaccttcagcaaactttttctgtaaaggcctgatagcaaatatttttgtggtgggttgaatttggcttatgggttatagtttgctgacacctagtttagagggtgtgtaaaactatcttcataactttgagatttttataaaattttacatgaaaatatactgataaattatatgcacatattttctaccagtagcattatagtggcatcatagaagaatatttaccaatgatggggaaactgtaaaactacagtatcaaggcatacaacttaaattccacttggaagattgtaaagtgtcaaagtattttaatgataatttaatttgggcttttgaaatgttcttctacaaatgaaaaagatgtttaaaaacgttacaagggaagctatgccttctgaagtctatccttagttgaaacagaaaataaacacaaaggtacaagatccttaaattattttgaaccacagaggttgaaattgttttgtgatcttcagcagaaataaaatctgtacatgattttcttttatgccttttagtttacagtctttattagcaatttcagtgaatttgtagagcatagtaataggtatttactgtccacttatatatatcagcatctggtcatgcacgaaccattaattctatatttctatttcaataattctaatatattatttctataaatgtaatatctgtatgtggcaaagagcctttcttctcaagatcctgaaaagctggttacctgccctttgagtgccacagtcctgaactgcttgttcttgacatcttgcatattacttcagagttccccactgtgcagactctcaggtattaactgtaaaaaactctttacatgccattattatctgtaatctctatctcttctactttaaattaatgtttctagaattaataggttaaatacacatacacacacacaactatgcctcagaaaagttaggcttttacaaataaaaagaataagattagaattaacaagtagagagaataacggtaggcagagtcagaatcaggaataaatatcagtgaatcaaaagaatgaaaaatattatgtaataaaaattagcaatgtaatgtaaacgtttgataaaagagtatctttttcttttatctcttactgttgacctctgtgcactgtaataaggtgtgttgctggatcttcttggtc

SEQ ID NO: 460517 - DNA, 790 bp, Homo sapiens
tccccctcacgatgctccccctcacaaagtccccctcacgacgccttcctcactacgtgccctcctcacgtcgcgcctccctcacgacacatccccctcatgacgcggccccctcacaatgcgcccccctcacgacgtccctctcctgaccccccctcaccacgcctccactgacaacgtccttctcacgacgcccccctcacgacgtccccgtcaccacgctcccccctcacgacgtccccctcaggacacccctctcacgacgtccccctcacgacgtccccctcacactaccgcccctcttggcagcttgaccttcaaccctccagggtttctttttgacctttgctttccttccaaactttcccgcctctggaataaaagagtcgcagaacagagaaaggcttcagggatgggctgttttgcagatgccacacaccacgtgttcccagctctaagaggcctgtttgtccccattttaccacctctggattcaggacacgcctggctgcattgtctccttgtctgcatagaaacttgtgggacagaagccgctggcagacgttggtggggaccctcacaacgcccccaattcaggcccctgaggccacaggaaaggatgtggcacaaggaggccaaccatgcagtcctgcttggagcggtgactgggaagacagacgtaccctgaagaagcacagaggaatcgagaccaattgtttttgccttattttcctagttaagtatacaaaggagtgatatcaataaaaacctatgtctaaataagtaaaaa

SEQ ID NO: 460518 - DNA, 1446 bp, Homo sapiens
cagggctgggcatggcagctcacacctgtaatcccagtgcttcgggaggctaggagtggagcttctaggaaaggtggtctgcagcaggcatccctgagctgggcccccaggcactgtcggggtgacgcttcttacctggaccaccatctgtgtccgctgcactgcacttcccctcctccagcaccgtcatctaagggtgaggccagccaggggccaggaagaaagaggcctccaggggtcctcagaagtatcttcgtccccaaggcggctccttccaggctggccgcggcatctgtatcaccagcctgcgcactagtgtctgtgatgagacgccatagcacaggcactggggtccagcacatggagtctcagatgggcttcctgcctgggttgaagggtcgttctctgctagggacagccatcggctccttctcaaagcctccaagagatgtgtctgtcggcgtctcagccacgcatccctgtctcagggacttgcctgagcacagggccgggcctggtgtctgcagctctgacagcacccaggggatgcggattgggccacactttgaggaggactggactgtgacgtgcctttcacagaggaaggaaggacaggcaggagtcgaggcaaggagtcgagacaaggcgagcctgttgccagcgagtcacagagttgtgcagggtctgccgcagagctcccagtgcactccaaccctgccaccggaccagctaggccagacccccagggagccgagcaccccagctttacagttttcccaggtggttctgagtcactgagccacaggcaagcctggagccaggaacagctatggaggatccagatgcagatgcactgaagcccacacctgccccccagtccagcccagtgagtgtgcatgtgtgtgcatgtgtgcacctgtgtgcgtgtatgtgtacctgtgtctctatgtacatctatgagtgtgtgcatgcatgtgtatgtgtacatgtatgagtgcgtgcatgcattcctgtgtctgccagtgtgtgtacatgtatttgtgcgtgtgtgcatgtatgtgttcacatctgtgtgtgcacatgtgtgtgcctgtgtgtgcatgtctgtgcctgtgtatgcacttatgtgtgcctgtgtgtgcatctacctgggtgtgcacgtacatgtgcctgtgtgtgcatctacctgggtgtgcacgtacgtgtgcctgtgtgtgcatctgagtgagcacagatgtgtgcgcatctacctgggtgtgcatgtatgtgtgcctgtgtgcaggcacctagttgccaaacagatcacgccgactcactagtgatatgtcaacaataaaactggattgtcatctttgtagagcagtagttctcaaagtcagttcttcatcagaaatctaggggccaggcctccaggcagctgtgacacagccaacggccaagagctgc

SEQ ID NO: 460519 - DNA, 1025 bp, Homo sapiens
ggattttggagatcatagatttcggatcgcggattgggggttggatctcggattgggggttggatcggggatttgggagccggtggttgggggtctgagaagtcaccaccatgaagttgttcggcttcgggagccgcaggggccagacggtcctgggctccatacaccacgtctacacgggttccgggtaccgaatccgggactccgaactgcagaagatccacaaggcggctgtcaggggcgacgccacggaggtggagcgctgtctggcgcgcagaagcggagacctggacgcccttggcaagcagcaaagaactgctctacatttggcctgtgccagcggccatgtgaaagtggtcactctcctggttagcagaaaatgccagattgatatctgtgacaaagaaaatagaacgcctttgatacaggctgtccattgccaggaagaggcttgtgccgttattctgctggaacatggcgccaatccaaaccttaaggatatctaccgcaacactgctctccattatgccacgtatagtgagagcacctcactggcagaaaaactgctttcccatgatgcagatattgaagcactggacaagaaatatgcaggtcacttggaaattagaacagcccttatgcttgctgtgcactatgactcaccgggtattgtcaacatccttcttaaacaaaatattaatgtctttactcaagacgtgtggacaagatgcagaagattacactatttctcgctgtttgacaaagctgaagatttgaagattggagacttctgtggagccctgcagaagtggaatctggaagtgggagcccataggaagacagatacttagatagtacttagggaaatagagggggaagctggatataaactggcagttaaaaaattgtaaagaaatcaacttgctcattttcattgtgtatttttgctcccaagcattttccatgaactgtgtgtggattcattgcctgcattagatgacgaagtcttgagtgttgctgctaag

SEQ ID NO: 460520 - DNA, 676 bp, Homo sapiens
gaggcctctgcagctgtgcagaactctggccaaggcggaggaggcagagagggccagcgcggtgagcaccgccgtgcagtgggtcaacagcaccatcacgcacgagctccaggggatggcaccctctgaccaggcagaggtggatcacctactcaggatattcttcgcaagtaaagtacaagaagataaggggagaaaagaattggaaaagagcctggaatactcaacagtgcctacacctctacctccagtaccaccaccaccaccccctccacctcctaccaaaaaaaaggggcaaaagccagggaggaaggatactattacagagaaacctattgcgcctgcagagcctgttgagcctgtactcagtggcagtatggccataggggccgtgtcactagctgttgccaaagcctgtgccatgctgcttaataaacctctgtacttaaatatcgctctactgaagcacaatcaggaacagccaacaacgctatctatgcctttgctgatggtatcgctggtcagctgtgggaagtcatcatctgggaagctaaatttaatgaaagaagtgatttgtataccccatcctgaattaacaaccaaacaagtaccttacattatcttaaattaccttttctaaaaaaaaaaaaaatatatatatatatatatatactcc

SEQ ID NO: 460521 - DNA, 758 bp, Homo sapiens
aagattccacgtataaatgagatcatggccagggcaggcaggacctcgggcctcagtcaaagccgtgccagtcgctgtgctccgagtagtattccagcttggcacccatgcatttgacaccgtccagcagcatgcatgtgccatggcgtcagcccatgatgcaggcttgcaccttccgcgcacgcagaaagctgctgtccctctcctggatgaccatgaccaccgagtcctgcaacttctcatcaaagtggacgtggctttgggagccctctgcatcgtggcctgtcacaaagaccaagccactcatgcccagcagcctcccatgctccggggacaacagcaggagccttgcagggtgcagcccggggcggacagggcagggacgaccgctgaggcggtggcagggtctcaacgctgagcacaaggaagggagcaaggctcctcttttaatttggttttcagtcagttggaactcagtccttagtttaggactggagcttgggaaaagagaagtgaagaagaggaagattttcaattactactgggcttgcttcagactggatccaaggctcactgcctttgcagcaaggagcaggaattgcctagtcacgtcatgcagtcatgtccccaggaaaaacatgaacaatcacagcttttcctttctgggcctctcctctttgttttgtttgtttgtgtttgtttgtttttttagagacagggtatcatcgctgttgcccaggctggagtgcagaggtgcc

SEQ ID NO: 460522 - DNA, 1300 bp, Homo sapiens
tctctctccctgagaatttttgctaatttagtaaccaggggaaatgattgcaatatctcctagtgatctggtggcagggggagcatctggtttggacagcattgaaaggcgggaatcagtgcctcctcctagtgatagtgcctcaattgagcagggcttattccgagctcagtatgcaacatcccgacagggcaaatctaggtattgctctcaagtcactatccaacatcccgatgggttgaatggcatgccaaacacagcaataagcaatataaaaaagccaggccgccccggggatggtgttcgcagcgattcaaagggtggcactgggttggacgttttggttacgagccagcctattcccacattgtgccctttgcacccaacagtgcgtgtgaggaacgaactgctgtttgagcctcccctgagattgtgcgtagcctccgtgtaaatgtaatagcctccatggcttaattggctatcaagcgaattttcacagatgaaagcaatgttaggttaggggacgacggtgcagccacccagcctttaccagcagcgtgctgcagacgaaggcagtcaaggtgtggaggtgatcatgcaggtgcagctcagttgccgtgatgctccttgagtcaatgagctctttggtctgctcttctgctcaagcagaaaatgatctgcgcttcacccttgagaagctgacaagaaccacaggcttcttcgggcaggtggtggaacatgggtgtatcctgcaggttctcacagtatctccctttgctcaggctctagcctgattttctggctcataaggccaaagggagccggaaaggtccccacggcaggactcatggtggagagagaatggtctggaggattcaggcctctgcacactgtgtctgggtccctccttaaagaatgataaagacaagcaaagagcttgaagcagcctggagtccagccagaaacctttaactgagctttaaaggagatggtcacaacacttttcagaatactggcaaaggcctcctgtggccaggtttgtcctgggatgagcaaaatttaatgttaacctgctgtatctttgcttttaatatatctgcttgcccaccacaatgacgttatggttaatttcaccaatttggtaacctgcctcatgggaagtacgaaagtaagcaagggccaggtgtggtgactcacgcctgtaatcccagtactttgggtggctgaggcaggtggattgcttgagcccaggagttcaagaccaacctgggcaccatgacaaaaccccgtctctaaaaaa

SEQ ID NO: 460523 - DNA, 700 bp, Homo sapiens
gatcacaccctggattcttctcttccaggtgcagctcagttgccgtgatgctccttgagtcaatgagctctttggtctgctcttctgctcaagcagaaaatgatctgcgcttcacccttgagaagctgacaagaaccacaggcttcttcgggcaggtggtggaacatgggtgtatcctgcaggctctagcctgattttctggctcataaggccaaagggagccggaaaggtccccacggcaggactcatggtggagagagaatggtctggaggattcaggcctctgcacactgtgtctgggtccctccttaaagaatgataaagacaagcaaagagcttgaagcagcctggagtccagccagaaacctttaactgagctttaaaggagatggtcacaacacttttcagaatactggcaaaggcctcctgtggccaggtttgtcctgggatgagcaaaatttaatgttaacctgctgtatctttgcttttaatatatctgcttgcccaccacaatgacgttatggttaatttcaccaatttggtaacctgcctcatgggaagtacgaaagtaagcaagggccaggtgtggtgactcacgcctgtaatcccagtactttgggtggctgaggcaggtggattgcttgagcccaggagttcaagaccaacctgggcaccatgacaaaaccccgtctctaaaaaa

SEQ ID NO: 460524 - DNA, 1314 bp, Homo sapiens
cgcctcatgttctccctcatagaagcatcttcttgaaacccatctcaattctctcctcttgacaacatgtgttgcaactactacggcaactcctgtggctatggctccagctatggctgtggctatggctctggttatggctatggctatggctccagctatggctgtggctatggaactggctacagctgtggctatggctgtggctatggctctggttatggctgtggctatggctccagctatggctgtggctatggaactggctacagctgtggctatggctctggctacagctgtggctatggctctggctctggctgtggctatggaactggcttcggctgtgggtatggctgtggttatggaactggctatggctgtggatgtggctctggctctggctactgtttatgtaagtacactgtgaaatctgcatggcaaacatcattgccttatgatacatttctcaaattttcagaacatatccctgttgtttagcagcacgtgaatgtatttgatttattgtcttgatgtccctttgctttccccatgtgttaccatcaactgcctaatgaaacagcctgggattgtgtaatgactaacttagtgctttgagtttaattctttttcagccactgtggtatgttgattactatattaataatgtgtctcctttatgtgtttttaaatagttacttggtcatgaactatttataagctttggaaacatgatttcatttattctgcaggataacttcaggaagtgggtattaattctcactgtataagtgaagacattaagcaccagagtttaagtagcttgatccactgaaagagattcaactgtgtggaacctatgccgcggagaattgctttctgccattgttattgtccagcagttgccgaatagctctgacctgagcaaagcagtgaaacgcggtgctgttgagtgggttgccactgcacctttttcaactactctagtcttgtggagaaaacaccccttctaaattttttcttcattgaatactctccctcagctccagggtaccatatagagttttcttgtattttagagttactgttttatcaaagtgtaccagtcttttgtattacatttctcctgtctaaatcaactgtgtggtttctactcattatggatatagattgacacaaactcaataaatatttttgaatgaataactccacagtccaagttattttaatcactatacaaaatctccagagtttcttccatatttctgaacatggtaactatgtatcaagagacaaaccacaaatttaaagaag

SEQ ID NO: 460525 - DNA, 527 bp, Homo sapiens
tgtttttttaatgatagttaagtaatttagcgcccctagatccactgaaagagattcaactgtgtggaacctatgccgcggagaattgctttctgccattgttattgtccagcagttgccgaatagctctgacctgagcaaagcagtgaaacgcggtgctgttgagtgggttgccactgcacctttttcaactactctagtcttgtggagaaaacaccccttctaaattttttcttcattgaatactctccctcagctccagggtaccatatagagttttcttgtattttagagttactgttttatcaaagtgtaccagtcttttgtattacatttctcctgtctaaatcaactgtgtggtttctactcattatggatatagattgacacaaactcaataaatatttttgaatgaataactccacagtccaagttattttaatcactatacaaaatctccagagtttcttccatatttctgaacatggtaactatgtatcaagagacaaaccacaaatttaaagaag

SEQ ID NO: 460526 - DNA, 656 bp, Homo sapiens
gctattctcatgatagtgaataagtctcaggagatctgatgggtttatcaggggtttccacttttgcttcttcctcattttctcttgctgctgccatgtaagaagtgcctttcaccttccgccacgattctcaggcctccccagccatgtggaactgtaagtctaattaagcctctttttcttcccagtctctggtatgcttttatcagcagcatgaaaacgaattaatgcacttggtaacatgccaattacttgaccaagggaaggtgaggcaccttgctttaaaagtgaatgccaaagagaatagcagctcctcagtgaaataatgaagctgtgttagctgatgggagaaaaggttgctgaggagaccacaggaacagatgtctgcagaagtgtttctgtttcttgtcatcagcctcattgctgtaatggctccccaaggctgccagagtttacatttatttaaatagaatcaacatgtttctgtttcatagcatctttggtaaaattatactatgtaaaatgaggattacagtcttctcaccaaaagtaagatctctgccttgtctttctggcccatctggagaaaaggagcttgcgctccgccgaagagctttggttgcctcacctttctttctctttaaaagctccgttct

SEQ ID NO: 460527 - DNA, 675 bp, Homo sapiens
gctattctcatgatagtgaataagtctcaggagatctgatgggtttatcaggggtttccacttttgcttcttcctcattttctcttgctgctgccatgtaagaagtgcctttcaccttccgccacgattctcaggcctccccagccatgtggaactctctgccctcatcatgagaccatgcccaggctagtctgctggaaggaagtcagaggcacacggaagagagccacattcagccaaggccattctagaccagttgttccctgtcacttcactaattggccacagcacaaggtacacggatggagctggaagccattatcctcagcaaactaatgtaggaacagaaaaccaaatattgcatgttcttacttataagtgggagctgaacaacgagaacacatggacacagggagggaaacaacacacactggggcctgtccagcagtaaggttgaggcagggaaagcattaggaaaaatagctatgcatgctgggctgaatactgggtgatggattgataggtgcagcaaaccaccatggcatatgtttacctttgtaagaaaccagcacatcctgcacatgtaccctggaacttaaaataaaaattaaaatgttttttaaaaaagtcaaaacacaaaacaaaacaacaaaacaacacaacaacaaacagggg

SEQ ID NO: 460528 - DNA, 731 bp, Homo sapiens
gctattctcatgatagtgaataagtctcaggagatctgatgggtttatcaggggtttccacttttgcttcttcctcattttctcttgctgctgccatgtaagaagtgcctttcaccttccgccacgattctcaggcctccccagccatgtggaactctctgccctcatcatgagaccatgcccaggctagtctgctggaaggaagtcagaggcacacggaagagagccacattcagccaaggccattctagaccagttgttccctgtcacttcactaattggccacagcacaaggttttgttgaagattgaatgagtgtgtaaagtgcccaacagaaagtctggcacatggtacacggatggagctggaagccattatcctcagcaaactaatgtaggaacagaaaaccaaatattgcatgttcttacttataagtgggagctgaacaacgagaacacatggacacagggagggaaacaacacacactggggcctgtccagcagtaaggttgaggcagggaaagcattaggaaaaatagctatgcatgctgggctgaatactgggtgatggattgataggtgcagcaaaccaccatggcatatgtttacctttgtaagaaaccagcacatcctgcacatgtaccctggaacttaaaataaaaattaaaatgttttttaaaaaagtcaaaacacaaaacaaaacaacaaaacaacacaacaacaaacagggg

SEQ ID NO: 460529 - DNA, 916 bp, Homo sapiens
aggctctgctgggtatgcacaccatggcatcctgggaaagagcatggcggtgttgtccctaccctgggctgacagcacggtggtatatttggaaggcaactggatggggccttctcacccactcctatccaggttacaggtgtgtcctggtgtggaggttgcaatcccttgggcatcatggtaagttggaaaagatatgtaagcaaatgactaaagtgtgtatggaacttggcactggggaagtgacagtcaaaagtcagttaaatctcagctgtgacttcagctggcatagtgactttgatcaatgcctgcaaattctctgggctctggtttctttatttctctgccctcatcatgagaccatgcccaggctagtctgctggaaggaagtcagaggcacacggaagagagccacattcagccaaggccattctagaccagttgttccctgtcacttcactaattggccacagcacaaggttttgttgaagattgaatgagtgtgtaaagtgcccaacagaaagtctggcacatggtacacggatggagctggaagccattatcctcagcaaactaatgtaggaacagaaaaccaaatattgcatgttcttacttataagtgggagctgaacaacgagaacacatggacacagggagggaaacaacacacactggggcctgtccagcagtaaggttgaggcagggaaagcattaggaaaaatagctatgcatgctgggctgaatactgggtgatggattgataggtgcagcaaaccaccatggcatatgtttacctttgtaagaaaccagcacatcctgcacatgtaccctggaacttaaaataaaaattaaaatgttttttaaaaaagtcaaaacacaaaacaaaacaacaaaacaacacaacaacaaacagggg

SEQ ID NO: 460530 - DNA, 3095 bp, Homo sapiens
ttttttgttttgttttgttttgttttgtttcttttttttttttttctttttgacatggagtcttgctcctgtcgcacacgctggtggagtgcgatggtcttatcgttccttgtcgtggagggccgccctcttcactgtaggatgcttagcagcatacctggccctgacccactagataccagcagcaatgtcccagttgagaccatcaaaaaaagtctacagacattgccagatgttccctggggaaacacagaagggaggatcatgtgcaatgaggatggtggtgagaatgaccccctcctggctcaggtgcaggacccaatgtctctgaaacacaaaaagcaaagggacagcagagggacacagccacatgagacaagagcagcagctaggaggaaaggctgtctctctgggatgagagagaagactgatgaacagggtgcccacttacccacttatgatgctgctgtcattacctataatgcagtatctgtgagcatgcagcttgtatgagaaagttctgatcttgacagttcacgtaacattcaatcaattataccattgctctatctctaaagttttctttttctccttttctcagtgtcttaccaagaatgaaaggcaacctatgtaaaaactatgggctttctagtataaataaaaactactcatctccagaaaataaacaatgactgctaagatgattgaaaaaagaaaggagaagaaagtagcttgtaaaagcgtgtgaaatgcattcacgttggaatctcctacaggcacttcaggtcaaagactaccgatgtccagatcataatgcgaggacagtttgagcccagtgctctctgactgaggtagaacccccgggaaggtgaagagggcagccgtctgcgaaacagcccagcatttaagaatgggcagcacctggccaggtgcatttgagaactaggaatgtggcaacaataacatttatttatttggatgaagagaagaagatgtattggattccctgaaacaatcattgacctgcctgaatcccaactgttgcactgactccactaattcaccaatccacttgagctgggaggagagcccatgcacagaagtttatggataaacagacctgaacgtctagcatgatgtcaaatttatatggccacagaactacaaaaggaaataactataacctcactgaccacagtgctgctgacacttggacaacatgggtttgagcttcatgggtccacttagacaataattttttcactaactatattggaaatgtttttggaaatttataacagtttgaaaaatattgtagaccaacatgtagcctagaaatattaaaacattaagaagcaagtatggcatgaatacatagaatatatgtagatactattctattttatcatttactactataaatatatgcaaatctattaaatgaggttaacatttatcaaagcatgtggtcacaaactcttatagtttgtacatggcaccatttacagacaaggaaatagaagccaatgtaaaaatgcagtattaagtcataaccgcataaaagtaactgtggcacatactgcactaccatgataatttcacaggcacctcccactgctattgtggtgagcccacgtgttgtgagcttccgcataaagccctgcaattctgatcattgccacgtgggcagtttgtgtctctagttagttgtgtactgtagtaaaaagtgatctcgcagttcttgcataatttccgtgtttagtgcgatatggtaaacattgaatagcaccatgaaacccacacgaagggccactggtgatgttggaaggctcccaagaagcagagaaaattcatgacattacaaaatcagtcaaatttcttcatatgcactgtagattgaggtctgcagctggggtttcccattgttttaagataaatgaatcagcctaaagatcattgtaaaaaaagaaaaagatattggagaggctataactgcagctatgccagcaacagcagtagttacatttctgaagagacaaaatttgtcagtgggttttcaagagctcaagggtaacaccctaacccccacgttgttcaagggtcaactgtattgcagtcaaaaacagaaatttaaaaaaaaaattccttcaaaaaaataaaattgtattacacacttgctaatccaattttgacacacaattttcttcaccatcaatataagatatgctatgccaggtttccttatttgtaataattcatgtattacttatagtttgctttagatatggtggttctttgtctaagaaacataaaactttctattcatattttaccttttctccctttttgcaaatatgtatgataccttattcttgtggtagaatgttacacatagaaataaaagatttagttagcaacagcaaacctgaaaatggattaatgaaatatttaagacagggcaagcaagtccatttccgaatgatgggtgtttgcatttatccagtggagctgctgttcatggagacacagcagcatcccccgagaaggctgatagccctggcttcccttcccttcaggggcaggagaaagctgagcctctggtgctgtgtttgacaacacagacacagcttggaggtcttgcgggcttggttccagacccctgcagtaaagtaaatattaaataaagcaagttttacacaggtatttgggtttcccagtgcatgtaaaagttaggcttacactatactatagtctattaactgtgcattggcatgatgtctaaaaaatgtacatagttaactaaaaatattttattgctaaaaatggtaacaatcagtagtgaattttttccagatgttttcaatttactttgcccagacccatcagaggaatcattatctgtggcagttttaaccatatcacaagtatttcttaagtagtaaaacttaaaagtcaacattactctttgatccatgggctgcagaatgggtgttgtgtttgcagacatgaaacagtattaatcttcttgcacatctccatcagacctcttgggtcaccagtggtactgttaaggaccactaatatttttaaaagaa

SEQ ID NO: 460531 - DNA, 1389 bp, Homo sapiens
ccctcctcgaccgccccgcccgtcagtcctgaaaacctggcgagaggcgcgtactgtcctaggggaattcccctgcaaacagaagggagcccgccctgcgcgtcctggagtgggtgcggcaggagcgcttccaggcactgcgtccccaggtgaggggcggagccggggcgcggttcgcggcagtggccaggcctttgtttccttgggttggggtgacccctggtggtcatccagagcgcaacaagggctactccctggtccagaattcagtcctttccaggggagaaatggagaatgatggagggtggcccaggcggtgctgattggagtagacagccatcctcccgaggttggcactgagggtgatagagacctacctgcctggccaagctactccgccctgcctaagcatccccttccagagctccaggctggtggggttttattaagggaggcggtgctccttacacaggcctcttcctgctccccgtaaccctgtcgctggaggtgtctgtgggaaaggccaccgacatctacgctgtcaatggcacggagatcctgctgccctgcaccttctccagctgctttggcttcgaggacctccacttccggtggacctacaacagcagtgacgcattcaagattctcatagaggggactgtgaagaatgagaagtctgaccccaaggtgacgttgaaagacgatgaccgcatcactctggtaggctctactaaggagaagatgaacaacatttccattgtgctgagggacctggagttcagcgacacgggcaaatacacctgccatgtgaagaaccccaaggagaataatctccagcaccacgccaccatcttcctccaagtcgttgatagactggaagaagtggacaacacagtgacactcatcatcctggctgtcgtgggcggggtcatcgggctcctcatcctcatcctgctgatcaagaaactcatcatcttcatcctgaagaagactcgggagaagaagaaggagtgtctcgtgagctcctcggggaatgacaacacggagaacggcttgcctggctccaaggcagaggagaaaccaccttcaaaagtacgcagaatcagtttcggcagatgtccctgccagctctgcttcctccagccctcagctatagagactgtgcgctgcacttctgccctgaatggattcaccacccgggttccccacgcagccactttcctgtcttcaggaatcactgacctgtgctgcctgatgccctgtgtctgaaagccatttcgtgcattttccccccagcgttttagttgtttcagatgggaaagtaattgcattttttgttactgcattcttgtcagaagaaattcatgaaaatttatgttcactgaaaaa

SEQ ID NO: 460532 - DNA, 195 bp, Homo sapiens
ccggagagaacaggactatgcccggggctggggacggaggcaaagccccggcgagatggctgggcactgggcttttgggcctcttcctgctccccgtaaccctgtcgctggaggtgtctgtgggaaaggccaccgacatctacgctgtcgggctagtcggggactgtcgggctagtcgggggggtaccgagctcg

SEQ ID NO: 460533 - DNA, 3425 bp, Homo sapiens
  misc_feature (1)..(2): n is a, c, g, or t
  misc_feature (10)..(10): n is a, c, g, or t
  misc_feature (12)..(13): n is a, c, g, or t
nngttgcttntnnagccaagatgttagagagaggttctccacatagttattacgtgaccccaaatgatgtcacagctggaaatggaaaagaagatataaactaccagagacaaattttcagccccaactcagcaaaagcaagtgatgaggctagacttccactcttttcaggctataccaaggtgaccaactcacccaaaaatatggtgtcagagaaactgaatgtagacagccttgcaccctcagtgtcagtgaaggacatcgatgaagctggaaaccatcattctcagcaaactaacacagaaacggaaaaccaaacagtgcatgttctcactcataagtgggatttgaacaatgagaacacgtggacacagggaggggaacatcacacaccggggcctgtctggggggtgggtctaggggagggacagcattaggagaaatacctaatgtagatgacgggttgatgggtgcagcaaaccacaatggcatgtgtatacctatgtaacaaacctgcatgttctgcacatgtatcccagaacttaaagtataatttaaaaaaaagttgtcatattttttctagtaattgcatcattttgagtttccaacttatctatattatcaccaacacttgttattgcctatttttttattatagctattcttgtaggtgtgaagtggtagctcattgtgctttaaatttgaatttctctcaagtctaatagtgtcaacaatcataccatgagtttattggcaattcatatatcttctttgttgaatttttttggtgaaatgggttgtcttcttattatcaagtaataagatatatttttatattctagatacaaaatttatttttatttccttgtatcacatattatttatataaattatctcctaatctgtgacttgtgttttcattttaatggtgtcctttgaagtacaaaaggttttaatatctgtcattttattatttgttttgatatatttaacataataaagaaatttatataacaaagtgaggaatatttagcatatattcatcaaatataaaaagttgactaagttttcacatagttaaattaaaaagaaaataaataggccaatcaaatgatgactacaatgcatgcactaacaattagaataaatcacattgcaaatggtgagtcaacataaaaatatatattaaaaaattaatattcaaataaatttaaattttaaagtaatattttactttgcttcttaaatcagcaaaattgaaaaaaataataagaatgacccttgaagtagtgaagaaagggtctgttgataggacctgttttctctgttctggaccaacttgacacaatttgtcctgttggttgtcccacagaaagccaattattgagagaatgagtattgccagagaagaaggctttattcgggtgctccagttgagaagatgggagattaggttactaaacaattaattcaattaattttattcagttacatagctgtgaatgtgttatggcctgaatatttgtgtcttcctcaaatttatatactgaaattcaaatccccaaggcaatagtaccaggagaattcaacatttttgttgaaggaatgaaaatacattgagacatacttttcatattcaaataaccgacattgacattcttcattccttaaatataatcttcgcaggcaagagaactgagccagggctgtgtggttaagatagttggacagtctttgcattataaatcatgaaatgattggagtatagaccccaatggtgtttatatgtactccaagatatattttacatctatttatttatttatctatttacattgatatatatatctgtatatagagaaacatatagatatatatagccatataactttatatttatagacatatctgatacattttatatattaatctcaatactattattataattacagcagtatattgagtctttacaatgtttaatatatattatatattggaacatttttcattaaagatactccttactttcaaattaaaaaaaaaaagattaaacttagcaaaatagatgatataaaatggtcttgtttctatgaaaattgttaaaccatgttttatttgacatttggaatgattttgcaatccatgtgtttatttagcatcaattatcataacttcctaagaaattcaacaattcttttatgccaaatataaatcataaagggaaaagggcaaatatctcttcatttctttctttgcaactgatatttgatgatagattagtggccacacctactcacaacctatttttaagtggtgtagaactgattatgctgttgaatatatgagtagtatgtcatttttattattaaatgtcatatttaagtgggaaaaaatatgaaattttaaagatgtgaagatttctttaaattctccatatttgctgagccttttttttccctgtatattcacagtaacacacagaactctagctcattcaactctacggattagctttatacattttgcacacgtgaatctggacttaatttttctggaatcagaactaatctatggtgaaatatggatattgaaatgcaaacaaaatcaacactgccaagaagcctccccaacaatctgctatttacataagttaacccatattgtggactattgactcttggcagtagacaagttggctacctaatttgtgcagtcactgaattttttaatatctggaaagtttctattccttaaaatattatgtacttttacatataatttttttctgggtagtgactaaatgtatatgctggaatgagacaaatgtatattttacatacaaataactaaagtgtgtctatttgaagcaaattataagtgatgtaagaaaataagagtttgatattaatttctagtttttctacaccagtctaagaaatttatggaagcccttagttggtgcaggaaagtgtttccactctggattatgttttttcctacatattcccatgttcttttccatctacactctaagagtctttgtttcttacgaagtcctattgctacacaaaaatttttcctcattttaactgatgaagtaattgaagtgtgcttcatgtactatactggtatagcttaccccctgcatgacgccttcctgtgccaacatcctgggttacttgaatttttggcttcagaaaactttgtttgggttctcaatctgtaggtattatgccatttataaatcagcaaataatttacagagggaagtgacactaaatgtcagctttaccttagtgcatttactcatttcttcaagatcatggtgccctaaattctggctgccttagtagttccctgatacttaaaaaaaaattgtttttgttttgtttcttttggctgtattttgcagattttgtttc

SEQ ID NO: 460534 - DNA, 1624 bp, Homo sapiens
gtcgacgcggccggtccataaatgccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgtgccctcaaccctgccggctgggcctgaaatagggcccagcccagcacccccctatgggctcttcgttgggggccgtttccaggctcctggggcccgaagctccaggcccatccgggattcgtctggcaatctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaaccctagctgtgcttctgcgagaagaaagg

SEQ ID NO: 460535 - DNA, 1661 bp, Homo sapiens
tacgagtgagaacattcagtgtttggttttctgaaggatcagcatggagctagaagccacgaatatagttgttagggctgttctcctgtttccaaggaccacaggccagccccttagcacaaggaggagagctcctatagaaggcattcttccaagctcatctgttctccttcagttggataaggataaaaaatttgaatattccccttctaaagtgcacttgattggccacagcttgggagcacacctggctggggaagctgggtcaaggataccaggccttggaagaataactgggttggacccagctgggccatttttccacaacactccaaaggaagtcaggctagacccctcggatgccaactttgttgacgttattcatacaaatgcagctcgcatcctctttgagcttggtgttggaaccattgatgcttgtggtcatcttgacttttacccaaatggagggaagcacatgccaggatgtgaagacttaattacacctttactgaaatttaacttcaatgcttacaaaaaagaaatggcttccttctttgactgtaaccatgcccgaagttatcaattttatgctgaaagcattcttaatcctgatgcatttattgcttatccttgtagatcctacacatcttttaaagcaggaaattgcttcttttgttccaaagaaggttgcccaacaatgggtcattttgctgatagatttcacttcaaaaatatgaagactaatggatcacattattttttaaacacagggtccctttccccatttgcccgttggaggcacaaattgtctgttaaactcagtggaagcgaagtcactcaaggaactgtctttcttcgtgtaggcggggcaattgggaaaactggggagtttgccattgtcagtggaaaacttgagccaggcatgacttacacaaaattaatcgatgcagatgttaacgttggaaacattacaagtgttcagttcatctggaaaaaacatttgtttgaagattctcagaataagttgggagcagaaatggtgataaatacatctgggaaatatggatataaatctaccttctgtagccaagacattatgggacctaatattctccagaacctgaaaccatgctaatctcagatacagtcttgatggatttctttagtaggagcaatgaagaaaagtgtctccttccacctggcatccagaccaaatttgacccttgtaaatgacttagtcatttacaagggtcttactcagagtcaagtacgggtttgctttttttctgtgtagaatgttcatctaactgcaccttaaaaacacactgaaccctgggacaaaagataattactatgatctgtaggaatctggatatcattgacaaaatagagctgttttggaattttcctgaataagaggaggtgatgcaaatgtatgttgagtgtataaactcactggacaaaagtaagcctctggcttgctgagtttttgaagtatattttcaggtataataatcattgttctaaaattatataaaactatttgttatgttgttaaatcttgctgagacaaattatgactatagtgcatgatatatagtagattataaccttgtgggttgatgtgtctatctagtaataataaaaactaatgagatggc

SEQ ID NO: 460536 - DNA, 1780 bp, Homo sapiens
tacgagtgagaacattcagtgtttggttttctgaaggatcagcatggagctagaagccacgaatatagttgttagggctgttctcctgtttccaaggaccacaggccagccccttagcacaaggaggagagctcctatagaaggcattcttccaagctcatctgttctccttcagttggataaggataaaaaatttgaatattccccttctaaagtgcacttgattggccacagcttgggagcacacctggctggggaagctgggtcaaggataccaggccttggaagaataactgggttggacccagctgggccatttttccacaacactccaaaggaagtcaggctagacccctcggatgccaactttgttgacgttattcatacaaatgcagctcgcatcctctttgagcttggtgttggaaccattgatgcttgtggtcatcttgacttttacccaaatggagggaagcacatgccaggatgtgaagacttaattacacctttactgaaatttaacttcaatgcttacaaaaaagaaatggcttccttctttgactgtaaccatgcccgaagttatcaattttatgctgaaagcattcttaatcctgatgcatttattgcttatccttgtagatcctacacatcttttaaagcaggaaattgcttcttttgttccaaagaaggttgcccaacaatgggtcattttgctgatagatttcacttcaaaaatatgaagactaatggatcacattattttttaaacacagggtccctttccccatttgcccgttggaggcacaaattgtctgttaaactcagtggaagcgaagtcactcaaggaactgtctttcttcgtgtaggcggggcaattgggaaaactggggagtttgccattgtcagtggaaaacttgagccaggcatgacttacacaaaattaatcgatgcagatgttaacgttggaaacattacaagtgttcagttcatctggaaaaaacatttgtttgaagattctcagaataagttgggagcagaaatggtgataaatacatctgggaaatatggatataaatctaccttctgtagccaagacattatgggacctaatattctccagaacctgaaaccatgctaatctcagatacagtcttgatggatttctttagtaggagcaatgaagaaaagtgtctccttccacctggcatccagaccaaatttgacccttgtaaatgacttagtcatttacaagggtcttactcagagtcaagtacgggtttgctttttttctgtgtagaatgttcatctaactgcaccttaaaaacacactgaaccctgggacaaaagataattactatgatctgtaggaatctggatatcattgacaaaatagagctgttttggaattttcctgaataagaggaggtgatgcaaatgtatgttgagtgtataaactcactggacaaaagtaagcctctggcttgctgagtttttgaagtatattttcaggtataataatcattgttctaaaattatataaaactatttgttatgttgttaaatcttgctgagacaaattatgactatagtgcatgatatatagtagattataaccttgtgggttgatgtgtctatctagtaataataaaaactaatgagatggcactagtatttccaaggtgttccttggtgttcagggtgtgcacaagagagattttggagcttatctgttatgtgttcatcagttagcaatgggacctgaagttcaacaacccagggtata

SEQ ID NO: 460537 - DNA, 1583 bp, Homo sapiens
gagattgaacgagatcatgtgtgtaaatgagatatgtacgccacaaactaaacaactctgcggagaaaacttgcccatctccttagacattcacagccacgctgcagggtcggtgttctgttcccacttccacagaccaaaaagttatactgtgatacaacttctggttctgcaacttcatgtcacaaagcgcagtgagctggcccagtcggtgataggagtgttcctgcaagccattccctatcctggaagtacgtgcatggcctgtgaaccatataaatacattccaccaatcccaagccagagtcagatccccccaaaatgttcaccagacccaccgagaagccagagcagaaaaggagagaaatgtgacaatgagcttcagctctgtcgaatccggactacatggaacctctctgggttggcttctcaaccgatttcagagttgtgagctgagaaagaacagcaggagagaggccacagttattcaggggactcctgccttgctgggggcttccgcagcccctgaccaaccatcctggtgtcactgctgagacagcagcctgaacaagggcaatgggaccccagagactgcatctgtacaggcggagccccagggctttagaccctttgctccagtgatcttagagccataatattatcatccaaaatgatgagagagtaagtggcaagcatacctagacatcttctgagcccagcagacagaattttggtttaaggagaacctgggtagtataatgacacataatatttttttatatataggcatcacagtctatgaattgtactgattcatctcatctcaagaagatggtattttagatgtatgtgtatatatttgaagccaaaactgtttattttgtgtaattttttgtgcctattagtttctgaatatctgtgcataaaagcttctgtttctctgcctgcacacatttgtgggtacacactatacacctatgtggggtaggaggggggaatgggcatatttgtttgcatttaccttgtgtttggtcctaggaagggatcttggtgatcattccagcccagctctttcacctcaatggtgaagaaactgaggtccagaaaggcaaggtgacttgtcacaggtaacacagctggctatggagacagaggtgacacaagaacctaggatttctgatttgtagatgagaactctttctataatattaaaatcaattataaattttggggagggaagcagggagatccttgttttttcctcccccaactgataagtaagtactaagaaggtcaatcttgaattagctatataataccaaaagttaagtttttcacacagacctggttcagtattgattccttttatgaaaaccctgtttatactcaagttgtcaaagaattccagagggcatatgaagccattgttaaaataattttatgcctttgtttttgaagaaaagtatccaaaatatataagcttattgtttgagttaaacaataaaaacatctgctgtttctcaggatggctctagtcttaatataacatggcaaaataataccccctaaatatccatgattaa

SEQ ID NO: 460538 - DNA, 2011 bp, Homo sapiens
cctcctcctgcctgcagacagcatgagcccggcagcaggccaccgtgggcagtctctctagccgagggcaggctgccttgttcctgtgatggagcagggaaagagctccgtccattctgggcagagcaggtgggtgtcccacgaagtcatgaagccacaggctgccatccgggcccctcggtggcggggaggtctgttggacggcgaagtggtctcctgagggggctccaacacggagccttgccagagctggcagaggacagaaacgcgtccccgccccccagctgaatctgagccgctcgccgagggcaggggcgggcgcggcctgagccgcagtcagggcccagcacaggctgtgcacatggcgtcccctggtggcacagagcgggcctcatgagcggcgccccgggagtttgcagctctaagcctgccgccgcctttccctgcttttgtgggctcttagtgccagatgaggaaggagtggtcattaatgttgtacaacagcctaatatgcatcatcccatttggcctcatgacagcctccataaggaggtatcacacgtgtgctacagatggagaaccagactcgagtgtgcttgtcggaggggatggtgacctgaccctgctggtggcagccctgggtttggacctgggcctgaccctctctctgctgccctgcagggaccccaccccaggcctgaccctctctctgctgccccacaggcccttcatgctgctgccgcccctcatggagtggatgcgcgtggccatcacctacgcagagcaccgccgcagcctcaccgtggacagcggcgacatccggcaggcagcccggctgctgctgcctggtctggactgtgaacctcggcagctcaaacccgaacactgtttcagttccttccggaggctggatgcccgagcagctactgaaaaattcaaccaggacctgggtttccgcatgctcaactgtgggaggacggacctcatcaaccaagccatcgaggccttgggtccggatggggttaacaccatggatgaccagggtatgacgccactgatgtacgcctgcgctgctggggacgaagcgatggtccagatgttgattgatgctggggcaaacttggacatccaggttccaagcaactcccccaggcacccttccatccaccccgacagccggcactggacctcactgacattcgctgtgctgcatggacacatctctgtggtccagttgctgctggatgctggtgcccatgtcgagggctcggcagtgaacggcggcgaggacagctatgcggagacgcccctgcagctggcctctgcggcagggaactatgagctggtcagtttgttgctgagccgaggcgccgaccccctcctcagcatgctggaggcccacggcatgggctcctccctccacgaggacatgaactgcttcagccactcagctgcccacggccacaggaacgtcctgaggaagctcctgacgcagccacagcaggctaaagcggacgtgctgtccctggaggagatcctggccgagggtgtggaggaaagtgatgcgtcgagccagggcagtggcagcgaggggcccgtgcggctgagccggacccgcaccaaggccctacaggaggccatgtactacagcgctgagcacggctacgtggacatcaccatggagctgagggcactgggtgaggcctcacgggcatgcacacccatgtccatgcatgcatatggacacacacggtcactccctgctgctcttcagcaggcctgagagggccagggcctgcagggacagacaagccccagggcagctgagcacagactgggtggaggctgggacccccctgctacacggccagttcaggaggggccctgggcctcagacagtgctcaacagtgccacgtcttggggtcatggcccagtcccctgccctcgggccctccaccctgcctggctggagcttcgctgccccctccccagtcacagcccagggatgtc

SEQ ID NO: 460539 - DNA, 921 bp, Homo sapiens
gtgtgacatttagcagctaaccttgaaatgcttgtgctctttcctgatctggacttggactgagatgcacctacctttgcacgttacactcagagcacaagtgattctgctggggaggtcaagagggaaccaggaagttatgacttgactaacatggcaaatcctcactgtctttggaagggaggatgtggagaggaggatgatgggtagagaagatcctcccctttttcacaaggaaggaagaagactaaatcctagagaggtgaggcccgaaaacagagcatgggcctggttctcccaactgtggcccagagctgcctccacaagaagagcaaagacttttcatacaaagtgggaaagaactgcaatagaggcatgtgtcactgcagcaaacaggcgcatacccattccagggaggtgtttccagctagagggctcagcacatacaaaggaacaagtaccaagaagctgggttcggcacgtacaaaggaacaagtaccaagaagccctatgtccagagaacagggagagtttagtgtgggagagaaaaacagaaagggaatttgaaaggagcgatgtgggagcacgctgtagagaagagaaaaaaatctgggcattagaggcagggagactgactcaaaatgatagacactcgttctgagcaagaaagagtgacatcatctcattgtaatttttttaaagtgtaatttacatacagtaaaattcatttttagtgtagaattctgccaattttgacaaatgtacacaagtaagcaactaccaccatagctccatcacccacaaaaagcctcgcttgccctttatagccaacccgtccccaacctatagcgccttacaaccactgttttgtttgctgtccctattgtttgctgtccctatagtttgctttttccagaatgt

SEQ ID NO: 460540 - DNA, 959 bp, Homo sapiens
tccacctggaaggtgtggatgggagtcttcttcgtgtggacggactctacagactgcatgcccagtccttccggaggggacgcacagcacgccgggcacgcccagtccttccagaggagacgcacagcacgccgggcacgcccagtccttccggaggggacgcacagcacgccgggcacgcccagtccttccggaggagacgcacagcacgccgggcacgcccagtccttccggaggggacgcacagcacgccgggcacgcccagtccttccagaggagacgcacagcatgccgggaatgagcaggcccctgttcttcggaacaaaccatctggagaaagagctggaatggagcccatcagtggtgcttcactgcttcaggaagatgcatggctcagcaggacacacagggctcagcaggtcacagccataggtaagcaaccaaagcaccctagaccccaccacctctttgaataaaattacccagtcatgccaggcttctcacctttcccagaaggagtagtacttcacacacacacacacacacacacacacatgcacgtgtacacacatatatacaaacacattcagacacatacgcatgcacatacacaacacacacatgcacgctacacatacacatacatacacacatatacagatacacacatacacacacgcacatacacacacactacacatacgcacacacacacacatatatgcatgcgtgcatccctctttctgtggcatccctgactttttggagattgagtcatttaattatttgtttaaatggctttgtaaatgttctaatgtccagaatatttgctagacaataacaacgttttccatggtttattaagtaaataattgtcctaatagaaatataaattgttacagaagtgcataaaatgaaattatttttccaaatggagttaaataagagtatattgaagg

SEQ ID NO: 460541 - DNA, 6030 bp, Homo sapiens
ggtcaggtcttctaaatgcaggctgtggtaaagccctcccctagtgtgctgacagctgtgcatggtgaacagctccttccaagtgctcgcttagcaccaagtactctcctgacacttatcagtggctgtcattgtgtctctcccccggccactacgccaggaggcggctatgcccctttgcctccccagcacgcctcgctgcgcctgacactaggaggcacccagcaagtagaacgtcatgacatgaataccttaagcctgcccctgaacatacgccgaggggggtcagacaccaacctcaactttgatgtcccggatggcatcctggacttccacaaggtcaaactcactgcagacagcctgaagcaaaaaattctaaaggtaacagagcagataaaaattgagcaaacatcgcgcgatgggaatgttgcggagtatctgaaactagtgaacaacgcagacaagcagcaggcgggacgtatcaagcaagtctttgagaagaagaatcagaaatcagctcactccatcgcccagctgcagaagaagttagagcagtatcatcgaaagctcagagagatcgagcagaatggagcctctaggagctcaaaggacatttccaaagaccacctgaaggatatacatcgctctttgaaagatgcccacgtgaaatctcgaactgccccccattgcatggagagcagcaaatcgggcatgccaggggtctcacttactccacctgtgttcgttttcaataagtccagagagtttgccaacctgatccggaataagtttggcagcgccgacaacattgctcacttgaaaaattccttagaggagtttaggccagaggcgagtgccagggcctacgggggcagcgctaccatcgtgaacaaacccaagtatggcagtgatgatgaatgttcgagtggcacgtcaggctcggccgacagtaacggaaaccagtcgtttggggctggtggagccagcacactggacagccagggcaagctcgccgtgatcctggaggaactgagggagatcaaggatacccaagctcagctggctgaggacatcgaggcactgaaggtgcagtttaagagagaatatggttttatttctcagaccctgcaagaggaaagatacaggtatgagcgactggaggaccagctgcatgacctgacggacctgcatcaacatgagacagccaacctgaagcaggagctggccagcattgaggagaaggtggcctaccaggcctacgagcgctcgcgggacatccaggaagccttggaatcctgccagactcgcatttctaagctggagctccaccagcaagagcagcaagctctgcagacagacaccgtgaatgctaaagttctcctggggaggtgcatcaacgtgatcctggccttcatgactgtcatcttagtgtgtgtgtccaccatcgcgaagttcgtctcacccatgatgaagagtcgctgccacattcttggcaccttctttgccgtgactcttcttgctatattttgtaaaaactgggaccatatcctgtgtgccatagaaaggatgataataccaagatgaagccactggttcctgccttcaagttctttcaagtttttattttaaagaaaactctgtgcatactaccaaattttacagtgaatgattgtgcggactcgtgtgtaagaaaaactaggactgtgtggtgtaaataactacaattctcttaactccgtagcagttgccaactcagtccttgtacttcgttaacacgaatctgtttcagagctctcctaccttgctcactgccttaatcagaccgatttcctgcccacctgaccagcccagcgtggtaaacctctgtatattgagaccttggcataattggtgatcctgaagaaagaggtctctctcctaagtctctgtcagaattgagcttcacaattgctaatggttgttttctgtgagtcctataaaaagcaaggatatgcatgattcagggaatgaaggaatcacaggcttgggcagtgttaaacactgtggcctattgtccccgtgtgatccaccctggcttctctccagggggaccataggtcccgttcatgttactcagtgttccacagcagttcagtcgtgtatgaccctgtaacgtggaaatcttatcacacacctgttatccaacaagtctacctgaggggttttgttacactttaaatgggaaggcatagggatttatgaatggggctttcaccttctcatacccaggcaaccaacacctgattttgtctcaactggctagcaaatgcccagccttcagagtgtgcaggaatgttttcaaatccctcatcagactgtgactttaacattaatttggaatcctgtgagcactactctgaaggtttgtgttttggcaaatcttttttcttttttgagacagggctctgctaaatattgctcaggctggttgcaaactccttgcttcaagggatcctcccacctcagcctcccaagcagccgggactgcaggcacaagccaccatgcctggctgttttttggcaaatcttgattgtgataagcccccctggaggatatgattcactttatgtgattcatcttattcacaggtctgtgagggactgcaaagcttactcaggaaatgaaaacaaatgatggtcatgttgcagttttttccttgaaggacaaccgaaccatagcctctaaagttcaagtgcactgaggtgtcggaacgctgaaagcatgaggaaacgaggacgtagggtgtgactgaatggtggctagattagtgggagcagttcacctggatgaagattgagagcatcgtctttgagaagtgaaagactagcaagaataaaataaattaagtccagtgtttgagccaaggttgccacctgtctcttaacatctcactgaacataagtcctgaggtattaggacgaccatactgcctctgagctgaaaacattcaaaagttcacatccctgtttgggggataccattcaccgccttcagcccagatgatactttcctttaaatctgtgtctctgtgtgtataacaaagaggaagatggaaacaatgttcatggaaactgctgttgagccccttgtcccaccactcccgccatctgctgcaggcaggaaggcatgtgagtgtacgttttcttccaggagacatcaggtccccctggattcaaattaagtgcaatattttgcaaacagctcttcttagggaaatctcctgaaggaaaaaaatgtgacagaatgttccatagtctgagagaatggaatcgttgagcatttagtacaagtccagtgtgtgtgagcgggacttaggcagctcaagcttgcttttttttttaagcgtacaattgagtggttttagtaaattcacaaacttgttcaaccatcaccactatctaattccagactcacgcttttttaaacaataaatgtcatttcatgaaatctttggtgataaagtattttggattcagagaagagctcccttaccagtcccaccctgatctcatggctgtctctcctttcattgtcagactccccctggtctaccgcgttgatgtgtatacactgatctttcaagtctgggagacagataaggaggccaggtgcaaggcagggaggcagagagaatgttgtgcttcctttagcttttgtatttcgatggccagcattaccctttacctgtgggcatcagactcagcgtgggctgagtgctgagtgtaacttacactcctaaatcaagctggggcctgggtgggcccctcttggtatctgtgaatctttccaagcaccacttcggacacaccagggattgagtgctgctgttagtttagagaaggagagatgtctaacccttgaggtgaagggctctgggagggtccaagaagacgtaggcttcattttcacaccagcccacaccattccagtgctcagcctagcaaatgtgctttaatgcacacttctcagacctgtgatccgtgtatcttctccccagtgacagaagtagagaagagaatggaaagcagcacactccgtcccctctagtctggagctgttaacagaatctgctagaaactagctttattctaacataccgtaggatctaaatcctcctacctggatcatgaattcctttgaaataattcatattttcattgactctcactaaatgtcaaataaccttgttttcacttggataggctcaacctacctggcatatttattttgcagtcttgttgaaagttcatgaaactttgtactttttaataagatgatacactcgaaggaaacttttaatctctgcagtttattctctcttaaggaataaacactcccactgtttgttctcttcaatgtgtaaggagattaaatgacattttagaaatattacaattaaaaatagtgatgtagctgtaacatatgctggaattggatatttaatttatgtttgtgtcaactataatcctttccccacccctttcatttatggtaaacatcttgggcaaacccaaagatggaaagtgcttgttgggtgggtaagcaccacctggtctctcagcaaacactcctgagtggttgaagatgctggacattggattctagcactgggtttatctggtgacatagtctcctgtgggtcttgagttggttatttcaagctcaaactctgaatatgattaaaccagaacaccccacccccaactgccaaaaaaaaaaaaaaaaaatgggaattccataatggaaacagcaaaaaagtactccgttgctgggtttggacaatgaacatgggattagtcccaagtttgtagcttggaacggtagcatttttgcctgcgtgatccttgtcagctattcacagaaggaaatcttccgaaactccgtctttcatttcagccggtgaggctgttatccttctctgtcaattagcattcatgtggttttcgctctttccagctctgtcactcttgttttcatttaaatattgccccactctgtgtttattgccttgccatttctctagcatatcaggtttaattatgggctcagtaataatgaggaactagcttccctcaggcaactaattacttttgtcttttttggtcggattgtaccaaattattttgcattgaatgggaatgtttttgcagtgaatccagatatagttgtattggtttggaaaaacatttaaatatatttattcatatgaacatgtgtgattaaacaacctattttacatatttctgtaattctgaggagtgggctgggggtaggaagaaatggcaccacttaaaattcagggcttatatgaagaggtgttttaaggttagcacatgcacaaaggaacgagttggtttaaaaagataaatcactgcaaagaatgaaattggcttattcacatcaaaactagataagatgctaaaaaaaaaagatatgaaacagaactaacctatagtttcctgaaatcagtacagtttaatttataagaagctagaaagtaatgcaccttgattgttttaggaatgatttatgtgttgcaattttaatttatttaaagcatgtctactgtgtttgtcctaagagaaatatttcaacaaaacgtgctctgtgtttaagatatgtttaggcagtagttagcaactctgaaagtagaaactggaaatgtttattgtgaggcttgttgcagaatttccattttgtgagttactacttagtttcatgtcagcctaaaattgtaaattccctgtagatcttcaccccattgtggtgtcatcaatgaatccaaagcaggtgccattatttttttaaataaacacttgatgttagctttggtgttaaataaagaggtagatttcttaaattttcacatttgttggagcccatctcagtagcaaatgtgtgtgtgtgaccaatttttttaatagattttattttttagggcactttcaggttcacagcaaaattgagcagaaggtacagagatttccctt

SEQ ID NO: 460542 - DNA, 325 bp, Homo sapiens
attactgacatttgtattgggtacagtgcagggcgtggagtttctctgagacaaacacaggaataccccgagataatgtgagcagtatctccaaagtccaggctgagtcatatggtaggtgctgtttggaatatctagcctgcctgccttgcagattcaaatgcctcgggcaggagggtgagctagctgccgatcctgctctgctcctgggtttgctgtgtggcccttggtaagtctcttcacaactcttccgtttcagccagagtgtgtaaatatgtattgtggagctttgtggtctttaatatcctgggaatgccagtaaaga

SEQ ID NO: 460543 - DNA, 6010 bp, Homo sapiens
accagaggcaacagctgcagcagccgcgccgccccctcgcccgcggctcccagggtgatcccgagcacagccggtggctcgcggcgcggcagccccagaagacgggaaagttcgcggccggagcgcggagatgccgggcagcgacacggcgctcaccgtggaccggacctactcggaccccggccggcaccaccgctgcaagagccgggtagaacgtcatgacatgaataccttaagcctgcccctgaacatacgccgaggggggtcagacaccaacctcaactttgatgtcccggatggcatcctggacttccacaaggtcaaactcactgcagacagcctgaagcaaaaaattctaaaggtaacagagcagataaaaattgagcaaacatcgcgcgatgggaatgttgcggagtatctgaaactagtgaacaacgcagacaagcagcaggcgggacgtatcaagcaagtctttgagaagaagaatcagaaatcagctcactccatcgcccagctgcagaagaagttagagcagtatcatcgaaagctcagagagatcgagcagaatggagcctctaggagctcaaaggacatttccaaagaccacctgaaggatatacatcgctctttgaaagatgcccacgtgaaatctcgaactgccccccattgcatggagagcagcaaatcgggcatgccaggggtctcacttactccacctgtgttcgttttcaataagtccagagagtttgccaacctgatccggaataagtttggcagcgccgacaacattgctcacttgaaaaattccttagaggagtttaggccagaggcgagtgccagggcctacgggggcagcgctaccatcgtgaacaaacccaagtatggcagtgatgatgaatgttcgagtggcacgtcaggctcggccgacagtaacggaaaccagtcgtttggggctggtggagccagcacactggacagccagggcaagctcgccgtgatcctggaggaactgagggagatcaaggatacccaagctcagctggctgaggacatcgaggcactgaaggtgcagtttaagagagaatatggttttatttctcagaccctgcaagaggaaagatacaggtatgagcgactggaggaccagctgcatgacctgacggacctgcatcaacatgagacagccaacctgaagcaggagctggccagcattgaggagaaggtggcctaccaggcctacgagcgctcgcgggacatccaggaagccttggaatcctgccagactcgcatttctaagctggagctccaccagcaagagcagcaagctctgcagacagacaccgtgaatgctaaagttctcctggggaggtgcatcaacgtgatcctggccttcatgactgtcatcttagtgtgtgtgtccaccatcgcgaagttcgtctcacccatgatgaagagtcgctgccacattcttggcaccttctttgccgtgactcttcttgctatattttgtaaaaactgggaccatatcctgtgtgccatagaaaggatgataataccaagatgaagccactggttcctgccttcaagttctttcaagtttttattttaaagaaaactctgtgcatactaccaaattttacagtgaatgattgtgcggactcgtgtgtaagaaaaactaggactgtgtggtgtaaataactacaattctcttaactccgtagcagttgccaactcagtccttgtacttcgttaacacgaatctgtttcagagctctcctaccttgctcactgccttaatcagaccgatttcctgcccacctgaccagcccagcgtggtaaacctctgtatattgagaccttggcataattggtgatcctgaagaaagaggtctctctcctaagtctctgtcagaattgagcttcacaattgctaatggttgttttctgtgagtcctataaaaagcaaggatatgcatgattcagggaatgaaggaatcacaggcttgggcagtgttaaacactgtggcctattgtccccgtgtgatccaccctggcttctctccagggggaccataggtcccgttcatgttactcagtgttccacagcagttcagtcgtgtatgaccctgtaacgtggaaatcttatcacacacctgttatccaacaagtctacctgaggggttttgttacactttaaatgggaaggcatagggatttatgaatggggctttcaccttctcatacccaggcaaccaacacctgattttgtctcaactggctagcaaatgcccagccttcagagtgtgcaggaatgttttcaaatccctcatcagactgtgactttaacattaatttggaatcctgtgagcactactctgaaggtttgtgttttggcaaatcttttttcttttttgagacagggctctgctaaatattgctcaggctggttgcaaactccttgcttcaagggatcctcccacctcagcctcccaagcagccgggactgcaggcacaagccaccatgcctggctgttttttggcaaatcttgattgtgataagcccccctggaggatatgattcactttatgtgattcatcttattcacaggtctgtgagggactgcaaagcttactcaggaaatgaaaacaaatgatggtcatgttgcagttttttccttgaaggacaaccgaaccatagcctctaaagttcaagtgcactgaggtgtcggaacgctgaaagcatgaggaaacgaggacgtagggtgtgactgaatggtggctagattagtgggagcagttcacctggatgaagattgagagcatcgtctttgagaagtgaaagactagcaagaataaaataaattaagtccagtgtttgagccaaggttgccacctgtctcttaacatctcactgaacataagtcctgaggtattaggacgaccatactgcctctgagctgaaaacattcaaaagttcacatccctgtttgggggataccattcaccgccttcagcccagatgatactttcctttaaatctgtgtctctgtgtgtataacaaagaggaagatggaaacaatgttcatggaaactgctgttgagccccttgtcccaccactcccgccatctgctgcaggcaggaaggcatgtgagtgtacgttttcttccaggagacatcaggtccccctggattcaaattaagtgcaatattttgcaaacagctcttcttagggaaatctcctgaaggaaaaaaatgtgacagaatgttccatagtctgagagaatggaatcgttgagcatttagtacaagtccagtgtgtgtgagcgggacttaggcagctcaagcttgcttttttttttaagcgtacaattgagtggttttagtaaattcacaaacttgttcaaccatcaccactatctaattccagactcacgcttttttaaacaataaatgtcatttcatgaaatctttggtgataaagtattttggattcagagaagagctcccttaccagtcccaccctgatctcatggctgtctctcctttcattgtcagactccccctggtctaccgcgttgatgtgtatacactgatctttcaagtctgggagacagataaggaggccaggtgcaaggcagggaggcagagagaatgttgtgcttcctttagcttttgtatttcgatggccagcattaccctttacctgtgggcatcagactcagcgtgggctgagtgctgagtgtaacttacactcctaaatcaagctggggcctgggtgggcccctcttggtatctgtgaatctttccaagcaccacttcggacacaccagggattgagtgctgctgttagtttagagaaggagagatgtctaacccttgaggtgaagggctctgggagggtccaagaagacgtaggcttcattttcacaccagcccacaccattccagtgctcagcctagcaaatgtgctttaatgcacacttctcagacctgtgatccgtgtatcttctccccagtgacagaagtagagaagagaatggaaagcagcacactccgtcccctctagtctggagctgttaacagaatctgctagaaactagctttattctaacataccgtaggatctaaatcctcctacctggatcatgaattcctttgaaataattcatattttcattgactctcactaaatgtcaaataaccttgttttcacttggataggctcaacctacctggcatatttattttgcagtcttgttgaaagttcatgaaactttgtactttttaataagatgatacactcgaaggaaacttttaatctctgcagtttattctctcttaaggaataaacactcccactgtttgttctcttcaatgtgtaaggagattaaatgacattttagaaatattacaattaaaaatagtgatgtagctgtaacatatgctggaattggatatttaatttatgtttgtgtcaactataatcctttccccacccctttcatttatggtaaacatcttgggcaaacccaaagatggaaagtgcttgttgggtgggtaagcaccacctggtctctcagcaaacactcctgagtggttgaagatgctggacattggattctagcactgggtttatctggtgacatagtctcctgtgggtcttgagttggttatttcaagctcaaactctgaatatgattaaaccagaacaccccacccccaactgccaaaaaaaaaaaaaaaaaatgggaattccataatggaaacagcaaaaaagtactccgttgctgggtttggacaatgaacatgggattagtcccaagtttgtagcttggaacggtagcatttttgcctgcgtgatccttgtcagctattcacagaaggaaatcttccgaaactccgtctttcatttcagccggtgaggctgttatccttctctgtcaattagcattcatgtggttttcgctctttccagctctgtcactcttgttttcatttaaatattgccccactctgtgtttattgccttgccatttctctagcatatcaggtttaattatgggctcagtaataatgaggaactagcttccctcaggcaactaattacttttgtcttttttggtcggattgtaccaaattattttgcattgaatgggaatgtttttgcagtgaatccagatatagttgtattggtttggaaaaacatttaaatatatttattcatatgaacatgtgtgattaaacaacctattttacatatttctgtaattctgaggagtgggctgggggtaggaagaaatggcaccacttaaaattcagggcttatatgaagaggtgttttaaggttagcacatgcacaaaggaacgagttggtttaaaaagataaatcactgcaaagaatgaaattggcttattcacatcaaaactagataagatgctaaaaaaaaaagatatgaaacagaactaacctatagtttcctgaaatcagtacagtttaatttataagaagctagaaagtaatgcaccttgattgttttaggaatgatttatgtgttgcaattttaatttatttaaagcatgtctactgtgtttgtcctaagagaaatatttcaacaaaacgtgctctgtgtttaagatatgtttaggcagtagttagcaactctgaaagtagaaactggaaatgtttattgtgaggcttgttgcagaatttccattttgtgagttactacttagtttcatgtcagcctaaaattgtaaattccctgtagatcttcaccccattgtggtgtcatcaatgaatccaaagcaggtgccattatttttttaaataaacacttgatgttagctttggtgttaaataaagaggtagatttcttaaattttcacatttgttggagcccatctcagtagcaaatgtgtgtgtgtgaccaatttttttaatagattttattttttagggcactttcaggttcacagcaaaattgagcagaaggtacagagatttccctt

SEQ ID NO: 460544 - DNA, 5636 bp, Homo sapiens
cgactttagctcggtaccccgtgctgaagaatgttgcggagtatctgaaactagtgaacaacgcagacaagcagcaggcgggacgtatcaagcaagtctttgagaagaagaatcagaaatcagctcactccatcgcccagctgcagaagaagttagagcagtatcatcgaaagctcagagagatcgagcagaatggagcctctaggagctcaaaggacatttccaaagaccacctgaaggatatacatcgctctttgaaagatgcccacgtgaaatctcgaactgccccccattgcatggagagcagcaaatcgggcatgccaggggtctcacttactccacctgtgttcgttttcaataagtccagagagtttgccaacctgatccggaataagtttggcagcgccgacaacattgctcacttgaaaaattccttagaggagtttaggccagaggcgagtgccagggcctacgggggcagcgctaccatcgtgaacaaacccaagtatggcagtgatgatgaatgttcgagtggcacgtcaggctcggccgacagtaacggaaaccagtcgtttggggctggtggagccagcacactggacagccagggcaagctcgccgtgatcctggaggaactgagggagatcaaggatacccaagctcagctggctgaggacatcgaggcactgaaggtgcagtttaagagagaatatggttttatttctcagaccctgcaagaggaaagatacaggtatgagcgactggaggaccagctgcatgacctgacggacctgcatcaacatgagacagccaacctgaagcaggagctggccagcattgaggagaaggtggcctaccaggcctacgagcgctcgcgggacatccaggaagccttggaatcctgccagactcgcatttctaagctggagctccaccagcaagagcagcaagctctgcagacagacaccgtgaatgctaaagttctcctggggaggtgcatcaacgtgatcctggccttcatgactgtcatcttagtgtgtgtgtccaccatcgcgaagttcgtctcacccatgatgaagagtcgctgccacattcttggcaccttctttgccgtgactcttcttgctatattttgtaaaaactgggaccatatcctgtgtgccatagaaaggatgataataccaagatgaagccactggttcctgccttcaagttctttcaagtttttattttaaagaaaactctgtgcatactaccaaattttacagtgaatgattgtgcggactcgtgtgtaagaaaaactaggactgtgtggtgtaaataactacaattctcttaactccgtagcagttgccaactcagtccttgtacttcgttaacacgaatctgtttcagagctctcctaccttgctcactgccttaatcagaccgatttcctgcccacctgaccagcccagcgtggtaaacctctgtatattgagaccttggcataattggtgatcctgaagaaagaggtctctctcctaagtctctgtcagaattgagcttcacaattgctaatggttgttttctgtgagtcctataaaaagcaaggatatgcatgattcagggaatgaaggaatcacaggcttgggcagtgttaaacactgtggcctattgtccccgtgtgatccaccctggcttctctccagggggaccataggtcccgttcatgttactcagtgttccacagcagttcagtcgtgtatgaccctgtaacgtggaaatcttatcacacacctgttatccaacaagtctacctgaggggttttgttacactttaaatgggaaggcatagggatttatgaatggggctttcaccttctcatacccaggcaaccaacacctgattttgtctcaactggctagcaaatgcccagccttcagagtgtgcaggaatgttttcaaatccctcatcagactgtgactttaacattaatttggaatcctgtgagcactactctgaaggtttgtgttttggcaaatcttttttcttttttgagacagggctctgctaaatattgctcaggctggttgcaaactccttgcttcaagggatcctcccacctcagcctcccaagcagccgggactgcaggcacaagccaccatgcctggctgttttttggcaaatcttgattgtgataagcccccctggaggatatgattcactttatgtgattcatcttattcacaggtctgtgagggactgcaaagcttactcaggaaatgaaaacaaatgatggtcatgttgcagttttttccttgaaggacaaccgaaccatagcctctaaagttcaagtgcactgaggtgtcggaacgctgaaagcatgaggaaacgaggacgtagggtgtgactgaatggtggctagattagtgggagcagttcacctggatgaagattgagagcatcgtctttgagaagtgaaagactagcaagaataaaataaattaagtccagtgtttgagccaaggttgccacctgtctcttaacatctcactgaacataagtcctgaggtattaggacgaccatactgcctctgagctgaaaacattcaaaagttcacatccctgtttgggggataccattcaccgccttcagcccagatgatactttcctttaaatctgtgtctctgtgtgtataacaaagaggaagatggaaacaatgttcatggaaactgctgttgagccccttgtcccaccactcccgccatctgctgcaggcaggaaggcatgtgagtgtacgttttcttccaggagacatcaggtccccctggattcaaattaagtgcaatattttgcaaacagctcttcttagggaaatctcctgaaggaaaaaaatgtgacagaatgttccatagtctgagagaatggaatcgttgagcatttagtacaagtccagtgtgtgtgagcgggacttaggcagctcaagcttgcttttttttttaagcgtacaattgagtggttttagtaaattcacaaacttgttcaaccatcaccactatctaattccagactcacgcttttttaaacaataaatgtcatttcatgaaatctttggtgataaagtattttggattcagagaagagctcccttaccagtcccaccctgatctcatggctgtctctcctttcattgtcagactccccctggtctaccgcgttgatgtgtatacactgatctttcaagtctgggagacagataaggaggccaggtgcaaggcagggaggcagagagaatgttgtgcttcctttagcttttgtatttcgatggccagcattaccctttacctgtgggcatcagactcagcgtgggctgagtgctgagtgtaacttacactcctaaatcaagctggggcctgggtgggcccctcttggtatctgtgaatctttccaagcaccacttcggacacaccagggattgagtgctgctgttagtttagagaaggagagatgtctaacccttgaggtgaagggctctgggagggtccaagaagacgtaggcttcattttcacaccagcccacaccattccagtgctcagcctagcaaatgtgctttaatgcacacttctcagacctgtgatccgtgtatcttctccccagtgacagaagtagagaagagaatggaaagcagcacactccgtcccctctagtctggagctgttaacagaatctgctagaaactagctttattctaacataccgtaggatctaaatcctcctacctggatcatgaattcctttgaaataattcatattttcattgactctcactaaatgtcaaataaccttgttttcacttggataggctcaacctacctggcatatttattttgcagtcttgttgaaagttcatgaaactttgtactttttaataagatgatacactcgaaggaaacttttaatctctgcagtttattctctcttaaggaataaacactcccactgtttgttctcttcaatgtgtaaggagattaaatgacattttagaaatattacaattaaaaatagtgatgtagctgtaacatatgctggaattggatatttaatttatgtttgtgtcaactataatcctttccccacccctttcatttatggtaaacatcttgggcaaacccaaagatggaaagtgcttgttgggtgggtaagcaccacctggtctctcagcaaacactcctgagtggttgaagatgctggacattggattctagcactgggtttatctggtgacatagtctcctgtgggtcttgagttggttatttcaagctcaaactctgaatatgattaaaccagaacaccccacccccaactgccaaaaaaaaaaaaaaaaaatgggaattccataatggaaacagcaaaaaagtactccgttgctgggtttggacaatgaacatgggattagtcccaagtttgtagcttggaacggtagcatttttgcctgcgtgatccttgtcagctattcacagaaggaaatcttccgaaactccgtctttcatttcagccggtgaggctgttatccttctctgtcaattagcattcatgtggttttcgctctttccagctctgtcactcttgttttcatttaaatattgccccactctgtgtttattgccttgccatttctctagcatatcaggtttaattatgggctcagtaataatgaggaactagcttccctcaggcaactaattacttttgtcttttttggtcggattgtaccaaattattttgcattgaatgggaatgtttttgcagtgaatccagatatagttgtattggtttggaaaaacatttaaatatatttattcatatgaacatgtgtgattaaacaacctattttacatatttctgtaattctgaggagtgggctgggggtaggaagaaatggcaccacttaaaattcagggcttatatgaagaggtgttttaaggttagcacatgcacaaaggaacgagttggtttaaaaagataaatcactgcaaagaatgaaattggcttattcacatcaaaactagataagatgctaaaaaaaaaagatatgaaacagaactaacctatagtttcctgaaatcagtacagtttaatttataagaagctagaaagtaatgcaccttgattgttttaggaatgatttatgtgttgcaattttaatttatttaaagcatgtctactgtgtttgtcctaagagaaatatttcaacaaaacgtgctctgtgtttaagatatgtttaggcagtagttagcaactctgaaagtagaaactggaaatgtttattgtgaggcttgttgcagaatttccattttgtgagttactacttagtttcatgtcagcctaaaattgtaaattccctgtagatcttcaccccattgtggtgtcatcaatgaatccaaagcaggtgccattatttttttaaataaacacttgatgttagctttggtgttaaataaagaggtagatttcttaaattttcacatttgttggagcccatctcagtagcaaatgtgtgtgtgtgaccaatttttttaatagattttattttttagggcactttcaggttcacagcaaaattgagcagaaggtacagagatttccctt

SEQ ID NO: 460545 - DNA, 3575 bp, Homo sapiens
attactgacatttgtattgggtacagtgcagggcgtggagtttctctgagacaaacacaggaataccccgagataatgtgagcagtatctccaaagtccaggctgagtcatatggtaggtgctgtttggaatatctagcctgcctgccttgcagattcaaatgcctcgggcaggagggtgagctagctgccgatcctgctctgaaatgaaaacaaatgatggtcatgttgcagttttttccttgaaggacaaccgaaccatagcctctaaagttcaagtgcactgaggtgtcggaacgctgaaagcatgaggaaacgaggacgtagggtgtgactgaatggtggctagattagtgggagcagttcacctggatgaagattgagagcatcgtctttgagaagtgaaagactagcaagaataaaataaattaagtccagtgtttgagccaaggttgccacctgtctcttaacatctcactgaacataagtcctgaggtattaggacgaccatactgcctctgagctgaaaacattcaaaagttcacatccctgtttgggggataccattcaccgccttcagcccagatgatactttcctttaaatctgtgtctctgtgtgtataacaaagaggaagatggaaacaatgttcatggaaactgctgttgagccccttgtcccaccactcccgccatctgctgcaggcaggaaggcatgtgagtgtacgttttcttccaggagacatcaggtccccctggattcaaattaagtgcaatattttgcaaacagctcttcttagggaaatctcctgaaggaaaaaaatgtgacagaatgttccatagtctgagagaatggaatcgttgagcatttagtacaagtccagtgtgtgtgagcgggacttaggcagctcaagcttgcttttttttttaagcgtacaattgagtggttttagtaaattcacaaacttgttcaaccatcaccactatctaattccagactcacgcttttttaaacaataaatgtcatttcatgaaatctttggtgataaagtattttggattcagagaagagctcccttaccagtcccaccctgatctcatggctgtctctcctttcattgtcagactccccctggtctaccgcgttgatgtgtatacactgatctttcaagtctgggagacagataaggaggccaggtgcaaggcagggaggcagagagaatgttgtgcttcctttagcttttgtatttcgatggccagcattaccctttacctgtgggcatcagactcagcgtgggctgagtgctgagtgtaacttacactcctaaatcaagctggggcctgggtgggcccctcttggtatctgtgaatctttccaagcaccacttcggacacaccagggattgagtgctgctgttagtttagagaaggagagatgtctaacccttgaggtgaagggctctgggagggtccaagaagacgtaggcttcattttcacaccagcccacaccattccagtgctcagcctagcaaatgtgctttaatgcacacttctcagacctgtgatccgtgtatcttctccccagtgacagaagtagagaagagaatggaaagcagcacactccgtcccctctagtctggagctgttaacagaatctgctagaaactagctttattctaacataccgtaggatctaaatcctcctacctggatcatgaattcctttgaaataattcatattttcattgactctcactaaatgtcaaataaccttgttttcacttggataggctcaacctacctggcatatttattttgcagtcttgttgaaagttcatgaaactttgtactttttaataagatgatacactcgaaggaaacttttaatctctgcagtttattctctcttaaggaataaacactcccactgtttgttctcttcaatgtgtaaggagattaaatgacattttagaaatattacaattaaaaatagtgatgtagctgtaacatatgctggaattggatatttaatttatgtttgtgtcaactataatcctttccccacccctttcatttatggtaaacatcttgggcaaacccaaagatggaaagtgcttgttgggtgggtaagcaccacctggtctctcagcaaacactcctgagtggttgaagatgctggacattggattctagcactgggtttatctggtgacatagtctcctgtgggtcttgagttggttatttcaagctcaaactctgaatatgattaaaccagaacaccccacccccaactgccaaaaaaaaaaaaaaaaaatgggaattccataatggaaacagcaaaaaagtactccgttgctgggtttggacaatgaacatgggattagtcccaagtttgtagcttggaacggtagcatttttgcctgcgtgatccttgtcagctattcacagaaggaaatcttccgaaactccgtctttcatttcagccggtgaggctgttatccttctctgtcaattagcattcatgtggttttcgctctttccagctctgtcactcttgttttcatttaaatattgccccactctgtgtttattgccttgccatttctctagcatatcaggtttaattatgggctcagtaataatgaggaactagcttccctcaggcaactaattacttttgtcttttttggtcggattgtaccaaattattttgcattgaatgggaatgtttttgcagtgaatccagatatagttgtattggtttggaaaaacatttaaatatatttattcatatgaacatgtgtgattaaacaacctattttacatatttctgtaattctgaggagtgggctgggggtaggaagaaatggcaccacttaaaattcagggcttatatgaagaggtgttttaaggttagcacatgcacaaaggaacgagttggtttaaaaagataaatcactgcaaagaatgaaattggcttattcacatcaaaactagataagatgctaaaaaaaaaagatatgaaacagaactaacctatagtttcctgaaatcagtacagtttaatttataagaagctagaaagtaatgcaccttgattgttttaggaatgatttatgtgttgcaattttaatttatttaaagcatgtctactgtgtttgtcctaagagaaatatttcaacaaaacgtgctctgtgtttaagatatgtttaggcagtagttagcaactctgaaagtagaaactggaaatgtttattgtgaggcttgttgcagaatttccattttgtgagttactacttagtttcatgtcagcctaaaattgtaaattccctgtagatcttcaccccattgtggtgtcatcaatgaatccaaagcaggtgccattatttttttaaataaacacttgatgttagctttggtgttaaataaagaggtagatttcttaaattttcacatttgttggagcccatctcagtagcaaatgtgtgtgtgtgaccaatttttttaatagattttattttttagggcactttcaggttcacagcaaaattgagcagaaggtacagagatttccctt

SEQ ID NO: 460546 - DNA, 3869 bp, Homo sapiens
  misc_feature (3854)..(3854): n is a, c, g, or t
accagaggcaacagctgcagcagccgcgccgccccctcgcccgcggctcccagggtgatcccgagcacagccggtggctcgcggcgcggcagccccagaagacgggaaagttcgcggccggagcgcggagatgccgggcagcgacacggcgctcaccgtggaccggacctactcggaccccggccggcaccaccgctgcaagagccgggtagaacgtcatgacatgaataccttaagcctgcccctgaacatacgccgaggggggtcagacaccaacctcaactttgatgtcccggatggcatcctggacttccacaaggtcaaactcactgcagacagcctgaagcaaaaaattctaaaggtaacagagcagataaaaattgagcaaacatcgcgcgatgggaatgttgcggagtatctgaaactagtgaacaacgcagacaagcagcaggcgggacgtatcaagcaagtctttgagaagaagaatcagaaatcagctcactccatcgcccagctgcagaagaagttagagcagtatcatcgaaagctcagagagatcgagcagaatggagcctctaggagctcaaaggacatttccaaagaccacctgaaggatatacatcgctctttgaaagatgcccacgtgaaatctcgaactgccccccattgcatggagagcagcaaatcgggcatgccaggggtctcacttactccacctgtgttcgttttcaataagtccagagagtttgccaacctgatccggaataagtttggcagcgccgacaacattgctcacttgaaaaattccttagaggagtttaggccagaggcgagtgccagggcctacgggggcagcgctaccatcgtgaacaaacccaagtatggcagtgatgatgaatgttcgagtggcacgtcaggctcggccgacagtaacggaaaccagtcgtttggggctggtggagccagcacactggacagccagggcaagctcgccgtgatcctggaggaactgagggagatcaaggatacccaagctcagctggctgaggacatcgaggcactgaaggtgcagtttaagagagaatatggttttatttctcagaccctgcaagaggaaagatacaggtatgagcgactggaggaccagctgcatgacctgacggacctgcatcaacatgagacagccaacctgaagcaggagctggccagcattgaggagaaggtggcctaccaggcctacgagcgctcgcgggacatccaggaagccttggaatcctgccagactcgcatttctaagctggagctccaccagcaagagcagcaagctctgcagacagacaccgtgaatgctaaagttctcctggggaggtgcatcaacgtgatcctggccttcatgactgtcatcttagtgtgtgtgtccaccatcgcgaagttcgtctcacccatgatgaagagtcgctgccacattcttggcaccttctttgccgtgactcttcttgctatattttgtaaaaactgggaccatatcctgtgtgccatagaaaggatgataataccaagatgaagccactggttcctgccttcaagttctttcaagtttttattttaaagaaaactctgtgcatactaccaaattttacagtgaatgattgtgcggactcgtgtgtaagaaaaactaggactgtgtggtgtaaataactacaattctcttaactccgtagcagttgccaactcagtccttgtacttcgttaacacgaatctgtttcagagctctcctaccttgctcactgccttaatcagaccgatttcctgcccacctgaccagcccagcgtggtaaacctctgtatattgagaccttggcataattggtgatcctgaagaaagaggtctctctcctaagtctctgtcagaattgagcttcacaattgctaatggttgttttctgtgagtcctataaaaagcaaggatatgcatgattcagggaatgaaggaatcacaggcttgggcagtgttaaacactgtggcctattgtccccgtgtgatccaccctggcttctctccagggggaccataggtcccgttcatgttactcagtgttccacagcagttcagtcgtgtatgaccctgtaacgtggaaatcttatcacacacctgttatccaacaagtctacctgaggggttttgttacactttaaatgggaaggcatagggatttatgaatggggctttcaccttctcatacccaggcaaccaacacctgattttgtctcaactggctagcaaatgcccagccttcagagtgtgcaggaatgttttcaaatccctcatcagactgtgactttaacattaatttggaatcctgtgagcactactctgaaggtttgtgttttggcaaatcttttttcttttttgagacagggctctgctaaatattgctcaggctggttgcaaactccttgcttcaagggatcctcccacctcagcctcccaagcagccgggactgcaggcacaagccaccatgcctggctgttttttggcaaatcttgattgtgataagcccccctggaggatatgattcactttatgtgattcatcttattcacaggtctgtgagggactgcaaagcttactcaggaaatgaaaacaaatgatggtcatgttgcagttttttccttgaaggacaaccgaaccatagcctctaaagttcaagtgcactgaggtgtcggaacgctgaaagcatgaggaaacgaggacgtagggtgtgactgaatggtggctagattagtgggagcagttcacctggatgaagattgagagcatcgtctttgagaagtgaaagactagcaagaataaaataaattaagtccagtgtttgagccaaggttgccacctgtctcttaacatctcactgaacataagtcctgaggtattaggacgaccatactgcctctgagctgaaaacattcaaaagttcacatccctgtttgggggataccattcaccgccttcagcccagatgatactttcctttaaatctgtgtctctgtgtgtataacaaagaggaagatggaaacaatgttcatggaaactgctgttgagccccttgtcccaccactcccgccatctgctgcaggcaggaaggcatgtgagtgtacgttttcttccaggagacatcaggtccccctggattcaaattaagtgcaatattttgcaaacagctcttcttagggaaatctcctgaaggaaaaaaatgtgacagaatgttccatagtctgagagaatggaatcgttgagcatttagtacaagtccagtgtgtgtgagcgggacttaggcagctcaagcttgcttttttttttaagcgtacaattgagtggttttagtaaattcacaaacttgttcaaccatcaccactatctaattccagactcacgcttttttaaacaataaatgtcatttcatgaaatctttggtgataaagtattttggattcagagaagagctcccttaccagtcccaccctgatctcatggctgtctctcctttcattgtcagactccccctggtctaccgcgttgatgtgtatacactgatctttcaagtctgggagacagataaggaggccaggtgcaaggcagggaggcagagagaatgttgtgcttcctttagcttagatatcgtggcacataaccttactgtgggtcgaccacggggcgaggtggggatacacctaacaagtgggcggtggcccgcgttggatcccagcctcggccagcgagcggctaaagagtccccagagtgcgccgctccccccacgcaagaccgaggtccattgactaactaattaatatangcgtgcagccagccg

SEQ ID NO: 460547 - DNA, 3418 bp, Homo sapiens
  misc_feature (3394)..(3394): n is a, c, g, or t
accagaggcaacagctgcagcagccgcgccgccccctcgcccgcggctcccagggtgatcccgagcacagccggtggctcgcggcgcggcagccccagaagacgggaaagttcgcggccggagcgcggagatgccgggcagcgacacggcgctcaccgtggaccggacctactcggaccccggccggcaccaccgctgcaagagccgggtagaacgtcatgacatgaataccttaagcctgcccctgaacatacgccgaggggggtcagacaccaacctcaactttgatgtcccggatggcatcctggacttccacaaggtcaaactcactgcagacagcctgaagcaaaaaattctaaaggtaacagagcagataaaaattgagcaaacatcgcgcgatgggaatgttgcggagtatctgaaactagtgaacaacgcagacaagcagcaggcgggacgtatcaagcaagtctttgagaagaagaatcagaaatcagctcactccatcgcccagctgcagaagaagttagagcagtatcatcgaaagctcagagagatcgagcagaatggagcctctaggagctcaaaggacatttccaaagaccacctgaaggatatacatcgctctttgaaagatgcccacgtgaaatctcgaactgccccccattgcatggagagcagcaaatcgggcatgccaggggtctcacttactccacctgtgttcgttttcaataagtccagagagtttgccaacctgatccggaataagtttggcagcgccgacaacattgctcacttgaaaaattccttagaggagtttaggccagaggcgagtgccagggcctacgggggcagcgctaccatcgtgaacaaacccaagtatggcagtgatgatgaatgttcgagtggcacgtcaggctcggccgacagtaacggaaaccagtcgtttggggctggtggagccagcacactggacagccagggcaagctcgccgtgatcctggaggaactgagggagatcaaggatacccaagctcagctggctgaggacatcgaggcactgaaggtgcagtttaagagagaatatggttttatttctcagaccctgcaagaggaaagatacaggtatgagcgactggaggaccagctgcatgacctgacggacctgcatcaacatgagacagccaacctgaagcaggagctggccagcattgaggagaaggtggcctaccaggcctacgagcgctcgcgggacatccaggaagccttggaatcctgccagactcgcatttctaagctggagctccaccagcaagagcagcaagctctgcagacagacaccgtgaatgctaaagttctcctggggaggtgcatcaacgtgatcctggccttcatgactgtcatcttagtgtgtgtgtccaccatcgcgaagttcgtctcacccatgatgaagagtcgctgccacattcttggcaccttctttgccgtgactcttcttgctatattttgtaaaaactgggaccatatcctgtgtgccatagaaaggatgataataccaagatgaagccactggttcctgccttcaagttctttcaagtttttattttaaagaaaactctgtgcatactaccaaattttacagtgaatgattgtgcggactcgtgtgtaagaaaaactaggactgtgtggtgtaaataactacaattctcttaactccgtagcagttgccaactcagtccttgtacttcgttaacacgaatctgtttcagagctctcctaccttgctcactgccttaatcagaccgatttcctgcccacctgaccagcccagcgtggtaaacctctgtatattgagaccttggcataattggtgatcctgaagaaagaggtctctctcctaagtctctgtcagaattgagcttcacaattgctaatggttgttttctgtgagtcctataaaaagcaaggatatgcatgattcagggaatgaaggaatcacaggcttgggcagtgttaaacactgtggcctattgtccccgtgtgatccaccctggcttctctccagggggaccataggtcccgttcatgttactcagtgttccacagcagttcagtcgtgtatgaccctgtaacgtggaaatcttatcacacacctgttatccaacaagtctacctgaggggttttgttacactttaaatgggaaggcatagggatttatgaatggggctttcaccttctcatacccaggcaaccaacacctgattttgtctcaactggctagcaaatgcccagccttcagagtgtgcaggaatgttttcaaatccctcatcagactgtgactttaacattaatttggaatcctgtgagcactactctgaaggtttgtgttttggcaaatcttttttcttttttgagacagggctctgctaaatattgctcaggctggttgcaaactccttgcttcaagggatcctcccacctcagcctcccaagcagccgggactgcaggcacaagccaccatgcctggctgttttttggcaaatcttgattgtgataagcccccctggaggatatgattcactttatgtgattcatcttattcacaggtctgtgagggactgcaaagcttactcaggaaatgaaaacaaatgatggtcatgttgcagttttttccttgaaggacaaccgaaccatagcctctaaagttcaagtgcactgaggtgtcggaacgctgaaagcatgaggaaacgaggacgtagggtgtgactgaatggtggctagattagtgggagcagttcacctggatgaagattgagagcatcgtctttgagaagtgaaagactagcaagaataaaataaattaagtccagtgtttgagccaaggttgccacctgtctcttaacatctcactgaacataagtcctgaggtattaggacgaccatactgcctctgagctgaaaacattcaaaagttcacatccctgtttgggggataccattcaccgccttcagcccagatgatactttcctttaaatctgtgtctctgtgtgtataacaaagaggaagatggaaacaatgttcatggaaactgctgttgagccccttgtcccaccactcccgccatctgctgcaggcaggaaggcatgtgagtgtacgttttcttccaggatcaggcccctggattcattagttgcatattgcaacagtctctaggaatccgtacgaccaatgacgagttcctgctgaaaggatgtgacttgcagcccggtgctacggatgagcaccgctcccaacggtgtaacacaactgcacccattacagccgttacagtcaccggaatgggaaccctccctggttgcccagttccataggtgatctccagcgttttgtnccagaatacacaacatcgacgacg

SEQ ID NO: 460548 - DNA, 4458 bp, Homo sapiens
attactgacatttgtattgggtacagtgcagggcgtggagtttctctgagacaaacacaggaataccccgagataatgtgagcagtatctccaaagtccaggctgagtcatatggtaggtgctgtttggaatatctagcctgcctgccttgcagattcaaatgcctcgggcaggagggtgagctagctgccgatcctgctctgctcctgggtttgctgtgtggcccttggtagaacgtcatgacatgaataccttaagcctgcccctgaacatacgccgaggggggtcagacaccaacctcaactttgatgtcccggatggcatcctggacttccacaaggtcaaactcactgcagacagcctgaagcaaaaaattctaaaggtaacagagcagataaaaattgagcaaacatcgcgcgatgggaatgttgcggagtatctgaaactagtgaacaacgcagacaagcagcaggcgggacgtatcaagcaagtctttgagaagaagaatcagaaatcagctcactccatcgcccagctgcagaagaagttagagcagtatcatcgaaagctcagagagatcgagcagaatggagcctctaggagctcaaaggacatttccaaagaccacctgaaggatatacatcgctctttgaaagatgcccacgtgaaatctcgaactgccccccattgcatggagagcagcaaatcgggcatgccaggggtctcacttactccacctgtgttcgttttcaataagtccagagagtttgccaacctgatccggaataagtttggcagcgccgacaacattgctcacttgaaaaattccttagaggagtttaggccagaggcgagtgccagggcctacgggggcagcgctaccatcgtgaacaaacccaagtatggcagtgatgatgaatgttcgagtggcacgtcaggctcggccgacagtaacggaaaccagtcgtttggggctggtggagccagcacactggacagccagggcaagctcgccgtgatcctggaggaactgagggagatcaaggatacccaagctcagctggctgaggacatcgaggcactgaaggtgcagtttaagagagaatatggttttatttctcagaccctgcaagaggaaagatacaggtatgagcgactggaggaccagctgcatgacctgacggacctgcatcaacatgagacagccaacctgaagcaggagctggccagcattgaggagaaggtggcctaccaggcctacgagcgctcgcgggacatccaggaagccttggaatcctgccagactcgcatttctaagctggagctccaccagcaagagcagcaagctctgcagacagacaccgtgaatgctaaagttctcctggggaggtgcatcaacgtgatcctggccttcatgactgtcatcttagtgtgtgtgtccaccatcgcgaagttcgtctcacccatgatgaagagtcgctgccacattcttggcaccttctttgccgtgactcttcttgctatattttgtaaaaactgggaccatatcctgtgtgccatagaaaggatgataataccaagatgaagccactggttcctgccttcaagttctttcaagtttttattttaaagaaaactctgtgcatactaccaaattttacagtgaatgattgtgcggactcgtgtgtaagaaaaactaggactgtgtggtgtaaataactacaattctcttaactccgtagcagttgccaactcagtccttgtacttcgttaacacgaatctgtttcagagctctcctaccttgctcactgccttaatcagaccgatttcctgcccacctgaccagcccagcgtggtaaacctctgtatattgagaccttggcataattggtgatcctgaagaaagaggtctctctcctaagtctctgtcagaattgagcttcacaattgctaatggttgttttctgtgagtcctataaaaagcaaggatatgcatgattcagggaatgaaggaatcacaggcttgggcagtgttaaacactgtggcctattgtccccgtgtgatccaccctggcttctctccagggggaccataggtcccgttcatgttactcagtgttccacagcagttcagtcgtgtatgaccctgtaacgtggaaatcttatcacacacctgttatccaacaagtctacctgaggggttttgttacactttaaatgggaaggcatagggatttatgaatggggctttcaccttctcatacccaggcaaccaacacctgattttgtctcaactggctagcaaatgcccagccttcagagtgtgcaggaatgttttcaaatccctcatcagactgtgactttaacattaatttggaatcctgtgagcactactctgaaggtttgtgttttggcaaatcttttttcttttttgagacagggctctgctaaatattgctcaggctggttgcaaactccttgcttcaagggatcctcccacctcagcctcccaagcagccgggactgcaggcacaagccaccatgcctggctgttttttggcaaatcttgattgtgataagcccccctggaggatatgattcactttatgtgattcatcttattcacaggtctgtgagggactgcaaagcttactcaggaaatgaaaacaaatgatggtcatgttgcagttttttccttgaaggacaaccgaaccatagcctctaaagttcaagtgcactgaggtgtcggaacgctgaaagcatgaggaaacgaggacgtagggtgtgactgaatggtggctagattagtgggagcagttcacctggatgaagattgagagcatcgtctttgagaagtgaaagactagcaagaataaaataaattaagtccagtgtttgagccaaggttgccacctgtctcttaacatctcactgaacataagtcctgaggtattaggacgaccatactgcctctgagctgaaaacattcaaaagttcacatccctgtttgggggataccattcaccgccttcagcccagatgatactttcctttaaatctgtgtctctgtgtgtataacaaagaggaagatggaaacaatgttcatggaaactgctgttgagccccttgtcccaccactcccgccatctgctgcaggcaggaaggcatgtgagtgtacgttttcttccaggagacatcaggtccccctggattcaaattaagtgcaatattttgcaaacagctcttcttagggaaatctcctgaaggaaaaaaatgtgacagaatgttccatagtctgagagaatggaatcgttgagcatttagtacaagtccagtgtgtgtgagcgggacttaggcagctcaagcttgcttttttttttaagcgtacaattgagtggttttagtaaattcacaaacttgttcaaccatcaccactatctaattccagactcacgcttttttaaacaataaatgtcatttcatgaaatctttggtgataaagtattttggattcagagaagagctcccttaccagtcccaccctgatctcatggctgtctctcctttcattgtcagactccccctggtctaccgcgttgatgtgtatacactgatctttcaagtctgggagacagataaggaggccaggtgcaaggcagggaggcagagagaatgttgtgcttcctttagcttttgtatttcgatggccagcattaccctttacctgtgggcatcagactcagcgtgggctgagtgctgagtgtaacttacactcctaaatcaagctggggcctgggtgggcccctcttggtatctgtgaatctttccaagcaccacttcggacacaccagggattgagtgctgctgttagtttagagaaggagagatgtctaacccttgaggtgaagggctctgggagggtccaagaagacgtaggcttcattttcacaccagcccacaccattccagtgctcagcctagcaaatgtgctttaatgcacacttctcagacctgtgatccgtgtatcttctccccagtgacagaagtagagaagagaatggaaagcagcacactccgtcccctctagtctggagctgttaacagaatctgctagaaactagctttattctaacataccgtaggatctaaatcctcctacctggatcatgaattcctttgaaataattcatattttcattgactctcactaaatgtcaaataaccttgttttcacttggataggctcaacctacctggcatatttattttgcagtcttgttgaaagttcatgaaactttgtactttttaataagatgatacactcgaaggaaacttttaatctctgcagtttattctctcttaaggaataaacactcccactgtttgttctcttcaatgtgtaaggagattaaatgacattttagaaatattacaattaaaaatagtgatgtagctgt

SEQ ID NO: 460549 - DNA, 5770 bp, Homo sapiens
ggggtgatctagaggatcccaaatctctcatgggcacctcaactttgatgtcccggatggcatcctggacttccacaaggtcaaactcactgcagacagcctgaagcaaaaaattctaaaggtaacagagcagataaaaattgagcaaacatcgcgcgatgggaatgttgcggagtatctgaaactagtgaacaacgcagacaagcagcaggcgggacgtatcaagcaagtctttgagaagaagaatcagaaatcagctcactccatcgcccagctgcagaagaagttagagcagtatcatcgaaagctcagagagatcgagcagaatggagcctctaggagctcaaaggacatttccaaagaccacctgaaggatatacatcgctctttgaaagatgcccacgtgaaatctcgaactgccccccattgcatggagagcagcaaatcgggcatgccaggggtctcacttactccacctgtgttcgttttcaataagtccagagagtttgccaacctgatccggaataagtttggcagcgccgacaacattgctcacttgaaaaattccttagaggagtttaggccagaggcgagtgccagggcctacgggggcagcgctaccatcgtgaacaaacccaagtatggcagtgatgatgaatgttcgagtggcacgtcaggctcggccgacagtaacggaaaccagtcgtttggggctggtggagccagcacactggacagccagggcaagctcgccgtgatcctggaggaactgagggagatcaaggatacccaagctcagctggctgaggacatcgaggcactgaaggtgcagtttaagagagaatatggttttatttctcagaccctgcaagaggaaagatacaggtatgagcgactggaggaccagctgcatgacctgacggacctgcatcaacatgagacagccaacctgaagcaggagctggccagcattgaggagaaggtggcctaccaggcctacgagcgctcgcgggacatccaggaagccttggaatcctgccagactcgcatttctaagctggagctccaccagcaagagcagcaagctctgcagacagacaccgtgaatgctaaagttctcctggggaggtgcatcaacgtgatcctggccttcatgactgtcatcttagtgtgtgtgtccaccatcgcgaagttcgtctcacccatgatgaagagtcgctgccacattcttggcaccttctttgccgtgactcttcttgctatattttgtaaaaactgggaccatatcctgtgtgccatagaaaggatgataataccaagatgaagccactggttcctgccttcaagttctttcaagtttttattttaaagaaaactctgtgcatactaccaaattttacagtgaatgattgtgcggactcgtgtgtaagaaaaactaggactgtgtggtgtaaataactacaattctcttaactccgtagcagttgccaactcagtccttgtacttcgttaacacgaatctgtttcagagctctcctaccttgctcactgccttaatcagaccgatttcctgcccacctgaccagcccagcgtggtaaacctctgtatattgagaccttggcataattggtgatcctgaagaaagaggtctctctcctaagtctctgtcagaattgagcttcacaattgctaatggttgttttctgtgagtcctataaaaagcaaggatatgcatgattcagggaatgaaggaatcacaggcttgggcagtgttaaacactgtggcctattgtccccgtgtgatccaccctggcttctctccagggggaccataggtcccgttcatgttactcagtgttccacagcagttcagtcgtgtatgaccctgtaacgtggaaatcttatcacacacctgttatccaacaagtctacctgaggggttttgttacactttaaatgggaaggcatagggatttatgaatggggctttcaccttctcatacccaggcaaccaacacctgattttgtctcaactggctagcaaatgcccagccttcagagtgtgcaggaatgttttcaaatccctcatcagactgtgactttaacattaatttggaatcctgtgagcactactctgaaggtttgtgttttggcaaatcttttttcttttttgagacagggctctgctaaatattgctcaggctggttgcaaactccttgcttcaagggatcctcccacctcagcctcccaagcagccgggactgcaggcacaagccaccatgcctggctgttttttggcaaatcttgattgtgataagcccccctggaggatatgattcactttatgtgattcatcttattcacaggtctgtgagggactgcaaagcttactcaggaaatgaaaacaaatgatggtcatgttgcagttttttccttgaaggacaaccgaaccatagcctctaaagttcaagtgcactgaggtgtcggaacgctgaaagcatgaggaaacgaggacgtagggtgtgactgaatggtggctagattagtgggagcagttcacctggatgaagattgagagcatcgtctttgagaagtgaaagactagcaagaataaaataaattaagtccagtgtttgagccaaggttgccacctgtctcttaacatctcactgaacataagtcctgaggtattaggacgaccatactgcctctgagctgaaaacattcaaaagttcacatccctgtttgggggataccattcaccgccttcagcccagatgatactttcctttaaatctgtgtctctgtgtgtataacaaagaggaagatggaaacaatgttcatggaaactgctgttgagccccttgtcccaccactcccgccatctgctgcaggcaggaaggcatgtgagtgtacgttttcttccaggagacatcaggtccccctggattcaaattaagtgcaatattttgcaaacagctcttcttagggaaatctcctgaaggaaaaaaatgtgacagaatgttccatagtctgagagaatggaatcgttgagcatttagtacaagtccagtgtgtgtgagcgggacttaggcagctcaagcttgcttttttttttaagcgtacaattgagtggttttagtaaattcacaaacttgttcaaccatcaccactatctaattccagactcacgcttttttaaacaataaatgtcatttcatgaaatctttggtgataaagtattttggattcagagaagagctcccttaccagtcccaccctgatctcatggctgtctctcctttcattgtcagactccccctggtctaccgcgttgatgtgtatacactgatctttcaagtctgggagacagataaggaggccaggtgcaaggcagggaggcagagagaatgttgtgcttcctttagcttttgtatttcgatggccagcattaccctttacctgtgggcatcagactcagcgtgggctgagtgctgagtgtaacttacactcctaaatcaagctggggcctgggtgggcccctcttggtatctgtgaatctttccaagcaccacttcggacacaccagggattgagtgctgctgttagtttagagaaggagagatgtctaacccttgaggtgaagggctctgggagggtccaagaagacgtaggcttcattttcacaccagcccacaccattccagtgctcagcctagcaaatgtgctttaatgcacacttctcagacctgtgatccgtgtatcttctccccagtgacagaagtagagaagagaatggaaagcagcacactccgtcccctctagtctggagctgttaacagaatctgctagaaactagctttattctaacataccgtaggatctaaatcctcctacctggatcatgaattcctttgaaataattcatattttcattgactctcactaaatgtcaaataaccttgttttcacttggataggctcaacctacctggcatatttattttgcagtcttgttgaaagttcatgaaactttgtactttttaataagatgatacactcgaaggaaacttttaatctctgcagtttattctctcttaaggaataaacactcccactgtttgttctcttcaatgtgtaaggagattaaatgacattttagaaatattacaattaaaaatagtgatgtagctgtaacatatgctggaattggatatttaatttatgtttgtgtcaactataatcctttccccacccctttcatttatggtaaacatcttgggcaaacccaaagatggaaagtgcttgttgggtgggtaagcaccacctggtctctcagcaaacactcctgagtggttgaagatgctggacattggattctagcactgggtttatctggtgacatagtctcctgtgggtcttgagttggttatttcaagctcaaactctgaatatgattaaaccagaacaccccacccccaactgccaaaaaaaaaaaaaaaaaatgggaattccataatggaaacagcaaaaaagtactccgttgctgggtttggacaatgaacatgggattagtcccaagtttgtagcttggaacggtagcatttttgcctgcgtgatccttgtcagctattcacagaaggaaatcttccgaaactccgtctttcatttcagccggtgaggctgttatccttctctgtcaattagcattcatgtggttttcgctctttccagctctgtcactcttgttttcatttaaatattgccccactctgtgtttattgccttgccatttctctagcatatcaggtttaattatgggctcagtaataatgaggaactagcttccctcaggcaactaattacttttgtcttttttggtcggattgtaccaaattattttgcattgaatgggaatgtttttgcagtgaatccagatatagttgtattggtttggaaaaacatttaaatatatttattcatatgaacatgtgtgattaaacaacctattttacatatttctgtaattctgaggagtgggctgggggtaggaagaaatggcaccacttaaaattcagggcttatatgaagaggtgttttaaggttagcacatgcacaaaggaacgagttggtttaaaaagataaatcactgcaaagaatgaaattggcttattcacatcaaaactagataagatgctaaaaaaaaaagatatgaaacagaactaacctatagtttcctgaaatcagtacagtttaatttataagaagctagaaagtaatgcaccttgattgttttaggaatgatttatgtgttgcaattttaatttatttaaagcatgtctactgtgtttgtcctaagagaaatatttcaacaaaacgtgctctgtgtttaagatatgtttaggcagtagttagcaactctgaaagtagaaactggaaatgtttattgtgaggcttgttgcagaatttccattttgtgagttactacttagtttcatgtcagcctaaaattgtaaattccctgtagatcttcaccccattgtggtgtcatcaatgaatccaaagcaggtgccattatttttttaaataaacacttgatgttagctttggtgttaaataaagaggtagatttcttaaattttcacatttgttggagcccatctcagtagcaaatgtgtgtgtgtgaccaatttttttaatagattttattttttagggcactttcaggttcacagcaaaattgagcagaaggtacagagatttccctt

SEQ ID NO: 460550 - DNA, 3465 bp, Homo sapiens
accagaggcaacagctgcagcagccgcgccgccccctcgcccgcggctcccagggtgatcccgagcacagccggtggctcgcggcgcggcagccccagaagacgggaaagttcgcggccggagcgcggagatgccgggcagcgacacggcgctcaccgtggaccggacctactcggaccccggccggcaccaccgctgcaagagccgggtagaacgtcatgacatgaataccttaagcctgcccctgaacatacgccgaggggggtcagacaccaacctcaactttgatgtcccggatggcatcctggacttccacaaggtcaaactcactgcagacagcctgaagcaaaaaattctaaaggtaacagagcagataaaaattgagcaaacatcgcgcgatgggaatgttgcggagtatctgaaactagtgaacaacgcagacaagcagcaggcgggacgtatcaagcaagtctttgagaagaagaatcagaaatcagctcactccatcgcccagctgcagaagaagttagagcagtatcatcgaaagctcagagagatcgagcagaatggagcctctaggagctcaaaggacatttccaaagaccacctgaaggatatacatcgctctttgaaagatgcccacgtgaaatctcgaactgccccccattgcatggagagcagcaaatcgggcatgccaggggtctcacttactccacctgtgttcgttttcaataagtccagagagtttgccaacctgatccggaataagtttggcagcgccgacaacattgctcacttgaaaaattccttagaggagtttaggccagaggcgagtgccagggcctacgggggcagcgctaccatcgtgaacaaacccaagtatggcagtgatgatgaatgttcgagtggcacgtcaggctcggccgacagtaacggaaaccagtcgtttggggctggtggagccagcacactggacagccagggcaagctcgccgtgatcctggaggaactgagggagatcaaggatacccaagctcagctggctgaggacatcgaggcactgaaggtgcagtttaagagagaatatggttttatttctcagaccctgcaagaggaaagatacaggtatgagcgactggaggaccagctgcatgacctgacggacctgcatcaacatgagacagccaacctgaagcaggagctggccagcattgaggagaaggtggcctaccaggcctacgagcgctcgcgggacatccaggaagccttggaatcctgccagactcgcatttctaagctggagctccaccagcaagagcagcaagctctgcagacagacaccgtgaatgctaaagttctcctggggaggtgcatcaacgtgatcctggccttcatgactgtcatcttagtgtgtgtgtccaccatcgcgaagttcgtctcacccatgatgaagagtcgctgccacattcttggcaccttctttgccgtgactcttcttgctatattttgtaaaaactgggaccatatcctgtgtgccatagaaaggatgataataccaagatgaagccactggttcctgccttcaagttctttcaagtttttattttaaagaaaactctgtgcatactaccaaattttacagtgaatgattgtgcggactcgtgtgtaagaaaaactaggactgtgtggtgtaaataactacaattctcttaactccgtagcagttgccaactcagtccttgtacttcgttaacacgaatctgtttcagagctctcctaccttgctcactgccttaatcagaccgatttcctgcccacctgaccagcccagcgtggtaaacctctgtatattgagaccttggcataattggtgatcctgaagaaagaggtctctctcctaagtctctgtcagaattgagcttcacaattgctaatggttgttttctgtgagtcctataaaaagcaaggatatgcatgattcagggaatgaaggaatcacaggcttgggcagtgttaaacactgtggcctattgtccccgtgtgatccaccctggcttctctccagggggaccataggtcccgttcatgttactcagtgttccacagcagttcagtcgtgtatgaccctgtaacgtggaaatcttatcacacacctgttatccaacaagtctacctgaggggttttgttacactttaaatgggaaggcatagggatttatgaatggggctttcaccttctcatacccaggcaaccaacacctgattttgtctcaactggctagcaaatgcccagccttcagagtgtgcaggaatgttttcaaatccctcatcagactgtgactttaacattaatttggaatcctgtgagcactactctgaaggtttgtgttttggcaaatcttttttcttttttgagacagggctctgctaaatattgctcaggctggttgcaaactccttgcttcaagggatcctcccacctcagcctcccaagcagccgggactgcaggcacaagccaccatgcctggctgttttttggcaaatcttgattgtgataagcccccctggaggatatgattcactttatgtgattcatcttattcacaggtctgtgagggactgcaaagcttactcaggaaatgaaaacaaatgatggtcatgttgcagttttttccttgaaggacaaccgaaccatagcctctaaagttcaagtgcactgaggtgtcggaacgctgaaagcatgaggaaacgaggacgtagggtgtgactgaatggtggctagattagtgggagcagttcacctggatgaagattgagagcatcgtctttgagaagtgaaagactagcaagaataaaataaattaagtccagtgtttgagccaaggttgccacctgtctcttaacatctcactgaacataagtcctgaggtattaggacgaccatactgcctctgagctgaaaacattcaaaagttcacatccctgtttgggggataccattcaccgccttcagcccagatgatactttcctttaaatctgtgtctctgtgtgtataacaaagaggaagatggaaacaatgttcatggaaactgctgttgagccccttgtcccaccactcccgccatctgctgcaggcaggaaggcatgtgagtgtacgttttcttccaggagacatcaggtccccctggattcaaattaagtgcaatattttgcaaacagctcttcttagggaaatctcctgaaggaaaaaaatgtgacagaatgttccatagtctgagagaatggaatcgttgagcatttagtacaagtccagtgtgtgtgagcgggacttaggcagctcaagcttgcttttttttttaagcgtacaattgagtggttttagtaaattcacaaacttgttcaaccatcaccactatctaattccagactcacgcttttttaaacaataaatgtcatttcatga

SEQ ID NO: 460551 - DNA, 1206 bp, Homo sapiens
  misc_feature (1192)..(1192): n is a, c, g, or t
accagaggcaacagctgcagcagccgcgccgccccctcgcccgcggctcccagggtgatcccgagcacagccggtggctcgcggcgcggcagccccagaagacgggaaagttcgcggccggagcgcggagatgccgggcagcgacacggcgctcaccgtggaccggacctactcggaccccggccggcaccaccgctgcaagagccgggtagaacgtcatgacatgaataccttaagcctgcccctgaacatacgccgaggggggtcagacaccaacctcaactttgatgtcccggatggcatcctggacttccacaaggtcaaactcactgcagacagcctgaagcaaaaaattctaaaggtaacagagcagataaaaattgagcaaacatcgcgcgatgggaatgttgcggagtatctgaaactagtgaacaacgcagacaagcagcaggcgggacgtatcaagcaagtctttgagaagaagaatcagaaatcagctcactccatcgcccagctgcagaagaagttagagcagtatcatcgaaagctcagagagatcgagcagaatggagcctctaggagctcaaaggacatttccaaagaccacctgaaggatatacatcgctctttgaaagatgcccacgtgaaatctcgaactgccccccattgcatggagagcagcaaatcgggcatgccaggggtctcacttactccacctgtgttcgttttcaataagtccagagagtttgccaacctgatccggaataagtttggcagcgccgacaacattgctcacttgaaaaattccttagaggagtttaggccagaggcgagtgccagggcctacgggggcagcgctaccatcgtgaacaaacccaagtatggcagtgatgatgaatgttcgagtggcacgtcaggctcggccgacagtaacggaaaccagtcgtttggggctggtggagccagcacactggacagccagggcaagctcgccgtgatcctggaggaactgagggagatcaaggatacccaagctcagctggctgaggacatcgaggcactgaaggtgcagtttaagagagaatatggttttatttctcagaccctgcaagaggaaagatacaggtatgagcgactggaggaccagctgcatgacctgacggacctgcatcaacattcttcagcacggggnaccgagctagaagt

SEQ ID NO: 460552 - DNA, 1266 bp, Homo sapiens
ggtattccacacagcattacctctgaccaaggcacttactttatggctaaagaagagtggcagtgggctcatgctcatggaattcatgggtcttaccatgctccctatcatcctgaagcagctggattgacagaatggtggattggtcttgtgatgtcacaattgcaacaccaactaggtgacaatactttgcagggctggggcaaagttccccagaaggctgtgtatgctctgaatctgtgtccaatacatggtgcagtttctcccatagccaggattcacgggtccaggaatcaagaggtggaagtggaaagggaggaatgtgccaccaggagacacagcaacaatgccattgagttaagattgccacctggacactttgggctcctcctacctttaaggcaacagactaagaagggagttacagtgttggctaaggtgactgactcagactatcaagatgaaatcagtcgactactccacgatgcaggaatgaaggtttgggtcactccgccaggaaaacaacaacaacaacaacaacaacaacaacaaccacgacctgctgaggtgcttgctgaaggcaaagggaatacggaatgggtagtagaaggtcagtgtccttcctctggggaatctggaattgaaacggtaaacagacatcaagagaagagcactgctgtttttggaattaccaatgtcacttcagctcttaacaccattctatgcataggttatttttctaacaatctgaaagcttcagaagatgtctccccagagttcttgttccaaacctcctgggccctgacttactgttagcaaagagccactggcaaggaaataacctatcttaaaccttgacacaaatcatctgagaatcccatccacattccagttctcaggatcgaagaacaaagacagaattcagatgggccttttgtcagagcattcaggtacttactgattgaggaaggcaaagaggtacctcatcactataaggaccgacctgggcaaagtcaggaggagtttgcggatgtgaagcgccctctcatagagattatctattcctacagacagaagatgacatggtcagagtcctttcacttgccacatttaaaacagaacactgcagtacatgtattaccggtacacatctgaatataagcaacaccctgctcttgtgtgagatccaattgtaaccaaaacagcgaataaatgatcggcttgggtataccaccattccagagggcatctcctctgacccttacc

SEQ ID NO: 460553 - DNA, 1089 bp, Homo sapiens
acagatcatgaggcagattcagatgaggaagaggagggcgagtgtaaaaaactaacttcagattctgaatgtgaggaacagaaaccggaggaaatcaaagaaagggaaaccgaaaaaggtcctaataagagatgaagaacaatgaagatatcgtgaaaaatattttgcttccctgccttcatacaatcctctaacagtcaaaaatgtatctgcagcgcccagtaaggccaactgatgactcaaacacaaccccccaagggtgtccttatgcccttccattgcttaaaataaagagctcgggggtcacttacggaaatcaatggaatcttgctctgtcacccaggctggagtgcaatggcatgatctcgggtcactacaacctctgtctccccggttcaagcaattctcctgcctcaacctcctgcgtagctgggattacaggctccggggtgtctgctcctgctgcctggcctctctcagctctgggcctgctccagtctctgagcaaggttggggccaagtcctgggaccatgaatggcagtgggaggcagacagattcctgggcggaaggggttgggtcccccgtaaggccccaccttcaggccagggagggcctgaaggctggggaattcatccgtattgtagtatggatccatacttcattctttttaatgaccaaataatattctgttatatggatgaatttatctatgtttatacggtcatcgactgatagacttggggttgcttctgctttttggctattataaataatattgctgtgaatattcataaacaaatttatgtgtggagacatattttcagttctcttggatatattctaggagtagaattattgggtaacgtagtaattctgtgcttatcattttaaggaactgccaaactatttcccaaagcaaagacatcattttacattcccatcagcaatatttgagagttccagtttatccatatccttgtcaacacttgttattacttgactttttgattatagcccacttagtggcggggactccaagcctagtagcactgtggttcttgcagactcatagaggtactgccttgaa

SEQ ID NO: 460554 - DNA, 709 bp, Homo sapiens
acagatcatgaggcagattcagatgaggaagaggagggcgagtgtaaaaaactaacttcagattctgaatgtgaggaacagaaaccggaggaaatcaaagaaagggaaaccgaaaaaggtcctaataagagatgaagaacaatgaagatatcgtgaaaaatattttgcttccctgccttcatacaatcctctaacagtcaaaaatgtatctgcagcgcccagtaaggccaactgatgactcaaacacaaccccccaagggtgtccttatgcccttccattgcttaaaataaagagctcgggggtcacttacggaaatcaatggaatcttgctctgtcacccaggctggagtgcaatggcatgatctcgggtcactacaacctctgtctccccggttcaagcaattctcctgcctcaacctcctgcgtagctgggattacaggcgggagtgtggtcgcacaatctcggctcactgcaacctccgcctcccaggttccagcaattctcctgcctcagcttcccaagtagctgggactacaggcagacaccaccacacccggctaatttttgtattttaatagagacgaggttttgctatgttggccagactgttcttgaactcctgacctccagtgatccacccacctcagcctctcgaagtactgggattacaggcgtgagtcactgcacccagcctgttcttttgtctt

SEQ ID NO: 460555 - DNA, 965 bp, Homo sapiens
aagtgagttcgctccggagccgcgccgccgccggcccagcatctcgggcgcccgccgcccccgccgccgccgtcagcgcggggatgtaggatgcaggcgggcgccaggttccagcggcggcggcggcagctgcagcagcagcagccccggcggcggcagcctctcctctggccgatggacgcagagccgccgccgccgccgccctgggtctggatggtgccgggctcggccgggctgctccggctcagcgcgggggtcgtggttcccccggtgctgctcgcctcggccccgccgcccgcggccccgctgctccccggtctccccggctggccggccccgagcgagccggtgctcccgctgctgccgctgccctctgcgccagactccgccgccgccgccgccgcgcaccccttccccgcgctccacgggcagtggctgtttggtggccattctccgtccctaggactgcccccctcttccacagtggagctggtgcccgtcttcccacatctctgcccttctgctcttgcaacccctattgggaaaagttggatagacaaaaggattcctaactgtaagtgttatgcttgcattatttttcgacagatcttttttaataattcctttgctctggactcaacgtggatacatcctgaggagtcaaggtttttccatgggcatgaaaagcctcgtttgctggcaaatcaagtagctgtgtctctgtccaggccggctcctgcctccaggccgctccccacggtggtgttagcacctcagcccatcccaggttggtgcccaaataacattgacaatgtctgtttcatttttgcttcaatcataaattagttttagatatgaaaaccatactcatcattttaatgaaacaattatcttggtaaaatataattccttttcacaagcatgaagcttttttaaaaaaaactagtcttggatagcttatccac

SEQ ID NO: 460556 - DNA, 1448 bp, Homo sapiens
gccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttaacctccaagttggcattactgggacaggagtgtgtaacaactcacctgccgaatcaactagccctgaaaatggatggcgctggagcgtcgggcccatacccggccgtcgccggcagtcgagagtggacgggagcggcgggggccggccggcgcgcgcgcgtgtggtgtgcgtcggagggcggcggcggcggcggcggcgggggtgtgtggggtcctcccccgcccccccccccacgcctcctcccctcctcccgcccacgccccgctccccgcccccggagccccgcggacgtacgccgcgacgagtaggagggccgctgcggtgagccttgaagcctaggcgcggtcaccgggttgatgaactg

SEQ ID NO: 460557 - DNA, 1306 bp, Homo sapiens
gccaccctgagcagcctcactggtgacccggtgttcgaagatgtggccagagtggctttgatgcgcctctgggagagccggtcagatatcgggctgagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttaacctccaagttggcattactgggacaggagtgtgtaacaactcacctgccgaatcaactagccctgaaaatggatggcgctggagcgtcgggcccatacccggccgtcgccggcagtcgagagtggacgggagcggcgggggccggccggcgcgcgcgcgtgtggtgtgcgtcggagggcggcggcggcggcggcggcgggggtgtgtggggtcctcccccgcccccccccccacgcctcctcccctcctcccgcccacgccccgctccccgcccccggagccccgcggacgtacgccgcgacgagtaggagggccgctgcggtgagccttgaagcctaggcgcggtcaccgggttgatgaactg

SEQ ID NO: 460558 - DNA, 1097 bp, Homo sapiens
gaggactttgaagggccttgcggtcggtgctccttcctgtgagtgctctttcctacaggtgctccttcctatgagtgctccttcctatgggtgttccttcctgtgagtgctccttcctgtgggtgctccttcctgtgagtgctccttcctgcatctgagactcagcaaatcccagcctgagctcgcaggtttgctctcctgctccccacttatcccgggggcttccccatcgcaggccctggcatctccatctgaccagtggccccagccagacactcgagagttgcagggtctgccccagccttcccccagggcaccaggcctgttgatgccacctgggcatagctctggataaccttggataaccttccttttcttgtctccacggacactctctgggctgagctccagcatcccctggcttctttgctcccaagtgagggcattcccttctaactcgcaaatgtgttcttcctccttccgcgctggtggcctgtccttttcaggttggaacccaaagccctggcagagcctcagcgcctgcccaagatgccctctccagcccagctctgtctccctgtctgccaggccctgggctgccctcgcctctgctcccccagccccttggtccaaccaggtcctgcgcagcccatggtacagccaccccctcctccgtgtgttccccttgacccagatccctgtgtaccccacaccctgcttcttgcttacccagccagttgccaggccctgcgatttggcccttttgttcctaacactgccactctcctcgaacacgaccattatttttcttggaaaccaatggtttgtaagcagatttgtaaacaatggagccctttcttcccttgaaatctggagcagaaagtgggaggagagcagaaagggatgaggaggctggagaaggagacacgcatcctggtggcatcttctgagtgtggctgggctggacggtgtgccgctgctgcctttccaacagccccgtgagatagctcgagcccgcctcacagatgcaggcacgctcctgcagcaagttcaagtccctcgaggaaggccagaaggccagtgagggcagagccagg

SEQ ID NO: 460559 - DNA, 432 bp, Homo sapiens
atcttttcccaatttagtcagcaaaactggataagaaatgcatcgaagatattaatcagctcatagcacagaggttgtggattttcaaaccaatcccctgtggataacaactgtcgcagagtaagaccatttaaagggaccaaaaatggatgaacatacttggcactatgaactaaaagatctttggctaaagaagagatgaagactcattcaactcctacaagtgaattaaggagctctgagaaggcaaagccagcccaggagggtggacacactaagaacaatgtgccttgtcctgatacacagttgtggtataggtaacaaaatctgagtatccaacctaagatgttacccctcacctcaccagaatacctccaatcccttccctggaaacacagaataaattcctatagaaagttataaagcagaaaa

SEQ ID NO: 460560 - DNA, 1026 bp, Homo sapiens
acttggctgagacattgctcctcatcaatcaactcccagcagcatggaaggacatttcttctctacttctcatatttgctgtgtgaactttgtaaagtctccaaacttcaacactggctgcctcatttgtaaaaaaggaatgataataattctacctcacaagagttattttatcaggtttaaattacatgatgaaattaagctcttaacacagtgcctggcaaggagcaacagtttacagatacctgatgtagtccatacaaatcggattcctgatgcagaggagaaaactggaaaattgatcagaggggcagatgaaggatatccacttcaagataatgatagctatcttaactgttatgcaggctctattatgaatatcattttaactggcacacatagcacagaccaagatataatcgccttgaaagtggatgaaaagaatgcagctgaaacatttatcaaattattggaggccaaatgtgaacactagtgaagatcaactgtggttggagaaatgaagaacagcaaaactctaaccccgggacaagtacaagattactgagaaagcttcaccccacaaactcaggggcactaagactgaggctgagccgtaacgacagaattttcccactgttaaagcaaataaatatggcctgagaaggatttctatatttgagtccttgtggactaactgcaacctagcttaacagagtaagaccatttaaagggaccaaaaatggatgaacatacttggcactatgaactaaaagatctttggctaaagaagagatgaagactcattcaactcctacaagtgaattaaggagctctgagaaggcaaagccagcccaggagggtggacacactaagaacaatgtgccttgtcctgatacacagttgtggtataggtaacaaaatctgagtatccaacctaagatgttacccctcacctcaccagaatacctccaatcccttccctggaaacacagaataaattcctatagaaagttataaagcagaaaa

SEQ ID NO: 460561 - DNA, 2632 bp, Homo sapiens
gcggggatcatgaagagggtgttttgtatactcatcacaaccatgaagaagtactattattacccacatttcacagacgagaaaactaagaagtttagtgactcgcccaaggccacctgggaactggtggagctgggattcaaatttgggcagcctcatttctggatgtttctactcaccaatgctgctttcttcttcaactggtacatgataaaaaatcagatttctagcaaatccattgaaagttttatcactcctggtacccaaagggagggtgatgatggccttgattctccagctgtcagtatgctgttaacaggagcagcttctcatcattcctgcttggccttgtcggtgtcatcagccccatggagccggtggtcagatcctccagcggttaggaatgttgtgtgctgcttagacatcaataccagagattcagacagcacaagatgagggggcagttgaccttaacagccatcatggcaacatattttcttaaaatataatgttgaagacattgcacttgcagacgatgcctgaggggcacatttgctgctcctgtccttctgcatagctaagcccctgctgtttgagggattacatgcttctccatctatcagcagtagaaacggaccagtattggatagttgtaaagcacattttgtcagcctggtgaggggctgtgcaagatgatgatgattatgacagctttctttcactcactcattcattcatttgtttactaaatatatgaaagctgaacctgtgccagttggtcagcattgttttcaatgacttgctattctcattgatgaaacaggaccaagaggttaaatgtcttacatttgccaaagtgaattctgaaaggaacagggctggactaatataactggacttcccactttagataggagatgccaggatggctgcccataaccatggaagttgagagaagtgtttggacttatgatgccaaaatactttgcaactgtcttaatatttttttattctgattttaaagaggggatcaggggagcacttgcacacatagaataattatgcagcaatttaaaatttcgtataaagactattcaatgccaagagaaaacgttcgtgatacaagaaaagaaacagtttctaaaataaaacatattaccaattttgagagataataagactctatgtttatacatttgttaatacctacatgtggatatatatgcccattgaaaacatgacttgaaggatagacatcaaaatgttgacatcttttctgaatacctttaatttccttatttagactttccttcattttccaaacattttcacaaggaactctttttttggggggataaaaagtgtactgtttccgggggtgggggcggggagggttgtgcagggatgaataggcagagaacagagaattcttagggcagtaaaaccactctgtaggatactctaatggtgggtacatgtcattagacatttttccaaacccatagaatgtataagaccaagagtgaaccctaatgtaaactgtgggctccagtgataatgatgagtccatgtaggttcatcagttgtaacaaatgcacagctctagtggggatgttgataatggggaggctgtgcaattgtgggagggagggtatgtggggaatttctataccttcttcttaattttgctgtgaacctaaaattgctctaaaaatgaagtcttaagtgttttataaagaaaaaaatattttatccaatggaagagctagtgatgaatgaatgtgtgtagcacccagaactccctaagcttgattttgctgtgtgatcatgggcatatgcttgttttctcagtgccttggtttatcccagtgtggggtctatgagttctttgtgttttctttgtgcttattcattgggaagcaccgacaaggtaaaatttatttgcagctttcataaggctttgcctttaaatgtgaaaagcaaagttaagtttgctcaattccagtagctggcaaaactacaagttggcccagctctttcctcctaagtaggaggcttgttcactgcccctctccctacccctggaattctgtgaacccctcttttctcccagaattaattctttaaaaaagattctttggtatttctctttgtttcaataaataagaccaatccttccctacttcacccttttcttcactggtaaagtgaaggagttgggttaaataattttaatttaaaataaaatttattagcaacttaactagatcatttttaagattaaattgcattaagaatttaaaaacattttagctgaaataatgttaaattgctttagcatacatacaggaaaacattcaataatttctactgctgttgatattgctctaaatcctagtttctggaactggcccttagcaccacattgaaattccctgaaatttgtacagctgaagccaaatggccaatgtggcccttccacaaatgtaattatgatcaaggggaaaaaaaatgcaagcaacaagatgttgctcttgtctatttattgaattttaaaatgtctttagctggttaacttgaaatatttctcaaaatatatttcatgtatctatttcttacacattcatttttc

SEQ ID NO: 460562 - DNA, 1473 bp, Homo sapiens
ctgtgttttcagatgttagcccaggtgttattgctgccatgctgtgtggcagtggcgtcctttgaatgtactccagcctgggccacggagcgagacctgagaaagaaagaaagagggaaagaaagaaaagaagaaagagaaagaaggaaagaaagaaagaaagaaagaaagaaagaaagaaagaaagaaagaaagaaagaaagaaagaaagagaaagagagaaacagagaaaagagagaaggaaaaagaaagaagaatgagaaagagagagggagagaaagaaagaaagaaagaaagaaagaaagaaagagaaagaaagaaagaaagaaagaaagaaagaaagaaagaaagaaagaaagaaaagaaaagaaaagaaagaagaaagaaagacagagaaagaaagaaaaagactcgctgcatagaacctgcctcccaatggagatgcagagaaagaaggaacattcgctgggtggaggcaccttaagagaggaagggccatgccctgaagacacaggcaaagtgcctgtaaataaaccctgagtgggcaacatgaatggccgcagaccagacaaaatgagaatccagttaaacaagtgcatgaaatatgccccttagtccactcagcctgcaacacaaaagcacagaacaggcagcttctaaaccacagacattgacttccgttctggaggccggaagtccaagatggagggtcccgcagattccgtgtctggtctttttctacagaaacattggcaaaatcatcttcattgttcatagattgttgcagcagatccaactgaaggatacaccaaccattttaatcggacacaaaagaacaggctgtcctcacctgaccaccacccacaacaaccgaactttaatcagacacaaaagaacaggctgtcacctgaccaccacccacaacaaccgaagggcagggtgagtccatttagagtctcgagaatttcagacgtgcattcactttaaagcagggctcaggaccatgaccccaggctgaggactgagggtaaagtgccacttgccacatggggcctccgggggaagtcgggaagaaacctgcacaaggatgagaccgtcccccagcaggactccaggactccatccccagggccatggccaccccagggccatgcatgcccagaaacaccctccattccctgcaggcaggaacagcaggtgcagctcctctgcctgccagctttgggacctctaggactgaccgcttcctgtctggacaccagtcctgtaatgctctcatccttgctgtctgagcctggccagttcctactgccatctcagacggcctgtggtctggtcctcagcaaacccctctgggccaacttcttccctccttgtatcctcacaggcacccgttgctgcctctggctaccccctgcagccatgctgtcttctctttcacatcctcggccactggcctggggtgagactggg

SEQ ID NO: 460563 - DNA, 1308 bp, Homo sapiens
ctgtgttttcagatgttagcccaggtgttattgctgccatgctgtgtggcagtggcgtcctttgaatgtactccagcctgggccacggagcgagacctgagaaagaaagaaagagggaaagaaagaaaagaagaaagagaaagaaggaaagaaagaaagaaagaaagaaagaaagaaagaaagaaagaaagaaagaaagaaagaaagaaagagaaagagagaaacagagaaaagagagaaggaaaaagaaagaagaatgagaaagagagagggagagaaagaaagaaagaaagaaagaaagaaagaaagagaaagaaagaaagaaagaaagaaagaaagaaagaaagaaagaaagaaagaaaagaaaagaaaagaaagaagaaagaaagacagagaaagaaagaaaaagactcgctgcatagaacctgcctcccaatggagatgcagagaaagaaggaacattcgctgggtggaggcaccttaagagaggaagggccatgccctgaagacacaggcaaagtgcctgtaaataaaccctgagtgggcaacatgaatggccgcagaccagacaaaatgagaatccagttaaacaagtgcatgaaatatgccccttagtccactcagcctgcaacacaaaagcacagaacaggcagcttctaaaccacagacattgacttccgttctggaggccggaagtccaagatggagggtcccgcagattccgtgtctggtctttttctacagaaacattggcaaaatcatcttcattgttcatagattgttgcagcagatccaactgaaggatacaccaaccattttaatcggacacaaaagaacaggctgtcctcacctgaccaccacccacaacaaccgaactttaatcagacacaaaagaacaggctgtcacctgaccaccacccacaacaaccgaagggcagggtgagtccatttagagtctcgagaatttcagacgtgcattcactttaaagagtgcaccagaagtgtgatttgaagaggacaaatggttttctagctccagagtggttaaaatataatctgggtaagtaaggagaaatggaagtgcctaacgaatccaacgtgtgagaaaagctggtgaagacaattcatgggggatttgatgctctgtgtaaaacagagaaggaagaaagccatttagttgtgaaggaggcccttcgcaaataccagcaaaggcagcccaggacagggacgctggccaacctctgctagaatcacgttgctgctagataatgcaatgcacaaataaagtaacagatccaataatgcaaa

SEQ ID NO: 460564 - DNA, 1202 bp, Homo sapiens
aaaaacggaggctttccactctacgtcacccgccaggctcccagaacattccaaggcctcttctgggtcttctccttggcgctggtcgccatttgctatactttgccaggtataaactccgaattgttaagccaccaaaattacccctagagaaaaaacccaaccctgataaggatggtacgtattgagttctctgacctgtttctgtggcctgggctggagaccaggggcacccaaagccagtgggctgtggcacacaatcttttgttctgcacaggtccagattatgagcccaacctctggatgtgggtaaatcccaacattgtgtatccccctggaaagctggaggtctcaggacgtaggaagagggaggacctgacaagcacactcccctcctctcagccaccccagaaggaggaagatgccagctgctcagaggccgcaggggtggaatcactgtcccagtcctccagcaagcggtctccccctcggaagcggtttgccttttcccccagcacctgggagctcacagaagaggaggaggctgaggaccaggaagacagctcctctatggctctcccatcccctcacaaaagggcccccctccagagtcggaggcttcggcaagccagcagccaggcggggaggctctggtcccggccccctctcaattacttccacctaattgccctggcattaagaaacagttccccctgtggcctcaacgtgcaacagatctacagtttcactcgaaagcacttcccctttttccggacggccccggaaggctggaagaatactgtccgtcacaatctctgttttcgagacagctttgagaaagtgcctgtcagcatgcagggcggggccagcacacggcctcgatcttgcctctggaagttgaccgaggagggacaccgccgctttgcggaggaggcccgcgccttggcttccactcggctagaaagtatccaacagtgcatgagccagccagatgtgatgcccttcctctttgatctttaaccccaagaagcaacagccagctaatgctttattaaaattaccctcactagccttctgtgtgtgtctgtggaggtggggtctctaaggatggggttaagggtggaggtggagatcaactccaagctctgtccttctctttagaggctggttcattcatttgtgcatttgtttgttcacttatt

SEQ ID NO: 460565 - DNA, 2268 bp, Homo sapiens
gatgcagcggcaacgtgacgtaggttaagtgtgcatagagaaggaagtttccatctgctctgttcagcttcagccaggacccgaccagggaccgtcctgtgcccgacagggaccgagaccgcaggttggttgcattgtgcagatcggctccaccgtcgtcctcccggaagaactcctcgctggtcgacgcggccgcgctccttattgcatgaatgtcccctgtggtttcatcaatggtaaaaacggtgccagcgccatctcctgagagggtgtatttcgcagtgccctttcccttgtctaagtcggaatggagctttagggaagagagggagagagagaggaagagaaagagaaggacaaagaaagaacaccattaaaaggatgttgccaaattaaaaagtcataatttgcaatacaattcctttaatcaaaaatgttaaataaaaatcttatggttctgttaaaaaaaaaaaaaaaaaaacacagcgacgcggccgcgtcgaccaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaaaaaaaaaagtcgacgcggccgcgtgcttcaaatttttatcaaagttaatggatcagttt

SEQ ID NO: 460566 - DNA, 2129 bp, Homo sapiens
  misc_feature (1809)..(1809): n is a, c, g, or t
  misc_feature (1815)..(1815): n is a, c, g, or t
  misc_feature (1886)..(1886): n is a, c, g, or t
  misc_feature (1889)..(1889): n is a, c, g, or t
  misc_feature (1920)..(1920): n is a, c, g, or t
  misc_feature (1933)..(1933): n is a, c, g, or t
  misc_feature (1989)..(1989): n is a, c, g, or t
  misc_feature (1993)..(1993): n is a, c, g, or t
cggcaccagcggcacgagctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcntgctangattgtcttttttaaaagtcatttttatttataggaatatgggtgtttctataggaagaaacaggtttttngtnttttgttttttaagataaatttgacaaagtnaactgaaatttanctggtccattttattcatgctactaagatgggaatctttaaacacaagggtcagcnagcnttggccatggattggcacctgttacgtaaataaagtttctttgaacaagcctacactcatccattatgttttgctgggggtgcttccacaactgcagagttgtatggttgcagtctaaaaactttacaattggctc

SEQ ID NO: 460567 - DNA, 911 bp, Homo sapiens
cacgggatcaaggctggtagcatgagccgagtgcagcctgccgggccaggtcgtcagaacaagcccagcaggtgcaagcaaaacccaagcagagccaccggtggccacagaagttgctggctggtgaatttattatatatgaatttaatataccaaatagatagaatacaagaaatgataagtgggaaaatttcaaaagatttatatttctctagtgagcacaaaaatagcctatcctgcattcttctcagttgccacaagatgtgtagtactctgacttttcccacaagtgaagtgattaactgtcttggaaaaacagctggagcaattgaagttagggttaaggatctcaagggcttggacttctcagagatgaagatctggatcactccatcaggcaagcaacgaagaccagatgaaatgctgcttgaagggctggcatatctagaattggtggtagaaatatctttgcttgaaagtttgctcaagaaacaccatgcatatttgacatcataaggaaagaaatgagcagaaccatacatccaacttacattgcaattactgcagaggaagagagatggagaagttaaaatgaaacatttcaaggatgaatgggcactgaaaattggtaaagtggcagaaaagtccaagcttgaagaatgaaaaagtaaatgtatggagaaaaaggagtttggaaaacaggaaaaaaaaagatattttgcagaaacatctgtttgctgttgctaaaaattttagcatttaaatgttctcatttgggctctgaagttagcacttccttgaagtagttcacacctttgctattgctcctgttcagctacagatcattttatgcaaggctgattttaacaagaaaatggtgcattaatttacaatgtgttgagtgttttaaa

SEQ ID NO: 460568 - DNA, 4192 bp, Homo sapiens
tgcgttgggagtgactgttatttttctccctgctccatggagagagccttgcgccttcccctcccctgctgggggctgccctcctctctcccaggagtttggctgtgggctgctgcgcttgccattggctcagacaccagggccaccagaagctgcctgcagtgtgagcttagagcggtgccagcctcaaggctttccccgtgagtctccatgcaccctcactccaccgccccagcagagtgtattctatcttcattcaggctatagcatagatgactgacagcgctcaagttgttacccttctacgtggcggcatagatgcctttggcctgggagaccttcccaacctgctgggcctggtgggggaccagctgggcgacacagagcggaagcggcggcatgccaagccaggcagctacagcatcgaggtgctgctggtggtggacgactcggtggttcgcttccatggcaaggagcatgtgcagaactatgtcctcaccctcatgaatatcgcctggtgccagctggtgctgtccgtggctggtgacccagctgttatggtagaaaaacttttctccaccctcttatgttcagtactggagggcttctatgtttcctccacacccacagatgagcagggtcgagctccaagagaaagggagcagacatgctcagtgaaactgccagcaggagacttaaggccagcagaggacgtggaagggaaggctgaacaggtctcatgccccagggaactttccaatgatgaaaaactccccactattcagtgcatatatgggtgccaggaaggcccatggctgaagcctgacaccggctgctctgaagtctgcccattcatgaactggggcagctgccagttctgggcactgcggaaagtggcttgggactggggcttggtgatgcacgcggcttctgctgcccacagtttcgtgcttacagcctggctgcctccttggctggcccagaagggggtggacaagcagaggctgagtgtccgcctcatgaacactgttcaggagcttcctggcagaggagtgcaaagggctgcattctttgatgagctgtgcagggcactggcccacagtcctgggcctgaggcctggggtggggcccaagactctgcatttctcacaagctcccaggtgctgctgctgctccaaggtcctggagtatgtctcctggaggagtgcccactgctgcctccccagggccggggtactgtagggcagacattatgccagtggcaactggaacggtacacagggatgttagggcgagtggcctgtggttccctgagccaggtagatgagatttaccacgatgagtccctgggggttcatataaatattgccctcgtccgcttgatcatggttggctaccgacagtccctgagcctgatcgagcgcgggaacccctcacgcagcctggagcaggtgtgtcgctgggcacactcccagcagcgccaggaccccagccacgctgagcaccatgaccacgttgtgttcctcacccggcaggactttgggccctcagggtatgcacccgtcactggcatgtgtcaccccctgaggagctgtgccctcaaccatgaggatggcttctcctcagccttcgtgatagctcatgagaccggccacgtgctcggcatggagcatgacggtcaggggaatggctgtgcagatgagaccagcctgggcagcgtcatggcgcccctggtgcaggctgccttccaccgcttccattggtcccgctgcagcaagctggagctcagccgctacctcccctcctacgactgcctcctcgatgacccctttgatcctgcctggccccagcccccagagctgcctgggatcaactactcaatggatgagcagtgccgctttgactttggcagtggctaccagacctgcttggcagtggttgggggccagggcagtgtccttctgtggcccatgctgaccattcatgaggtgccttctgcccagctggccagtgggcctggtgatgggcccacagacacagtgccagccaccatgcagggatgcagagtgaacacctgtgggggcagtgccatggagaaaggaggggtccctggaggctgccggtacttggagttgagtaaacttgaagcagcagcagcagcccagggtgacctcatgccctctgctctgccccagtggtgcttcaaaggtcactgcatctggaagtcgccggagcagacatatggccaggatggaggctggagctcctggaccaagtttgggtcatgttcgcggtcatgtgggggcggggtgcgatcccgcagccggagctgcaacaacccctccccagcctatggaggccgcctgtgcttagggcccatgttcgagtaccaggtctgcaacagcgaggagtgccctgggacctacgaggacttccgggcccagcagtgtgccaagcgcaactcctactatgtgcaccagaatgccaagcacagctgggtgccctacgagcctgacgatgacccaggtccctacaggaatctggttcctgtggatgaaatccaaggtggtcttggaggttgtggcttccgttgctgcctagagagctgcctgcctgggtcaggatcctgcctgtcctgggttggagctcccccagacccaggtccctacaggaatctggttcctgtggatgaaatccaaggtggtcttggaggttgtggctccagacttgagtccttcatgctggagacaaggagttaccagctgtgctggagcccagggaccagagcagagcccaagaacgcccagaagtgtgagctgatctgccagtcggcggacacgggggacgtggtgttcatgaaccaggtggttcacgatgggacacgctgcagctaccgggacccatacagcgtctgtgcgcgtggcgagtgtgtgcctgtcggctgtgacaaggaggtggggtccatgaaggcggatgacaagtgtggagtctgcgggggtgacaactcccactgcaggactgtgaaggggacgctgggcaaggcctccaagcaggcagtggtgaagaaccaggtcaccggcagcttcatcctcaaccccaagggcaaggaagccacaagccggaccttcaccgccatgggcctggagtgggaggatgcggtggaggatgccaaggaaagcctcaagaccagcgggcccctgcctgaagccattgccatcctggctctccccccaactgagggtggcccccgcagcagcctggcctacaagtacgtcatccatgaggacctgctgccccttatcgggagcaacaatgtgctcctggaggagatggacacctatgagtgggcgctcaagagctgggccccctgcagcaaggcctgtggaggaggcccacggcagcctgcccaccccatagggatccagttcaccaaatacggctgccggcgcagacgagaccaccacatggtgcagcgacacctgtgtgaccacaagaagaggcccaagcccatccgccggcgctgcaaccagcacccgtgctctcagcctgtgtgggtgacggaggagtggggtgcctgcagccggagctgtgggaagctgggggtgcagacacgggggatacagtgcctgctgcccctctccaatggaacccacaaggtcatgccggccaaagcctgtgccggggaccggcctgaggcccgacggccctgtctccgagtgccctgcccagcccagtggaggctgggagcctggtcccagtgctctgccacctgtggagagggcatccagcagcggcagatggtgtgcaggaccaacgccaacagcctcgggcattgcgagggggataggccagacactgtccaggtctgcagcctgcccgcctgtggaggaaatcaccagaactccacggtgagggccgatgtctgggaacttgggacgccagaggggcagtgggtgccacaatctgaacccctacatcccattaacaagatatcatcaacggagccctgcacgggagacaggtctgtcttctgccagatggaagtgctcgatcgctactgctccattcccggctaccaccggctctgctgtgtgtcctgcatcaagaaggcctcgggccccaaccctggcccagaccctggcccaacctcactgccctccttctcgcagtctctaatcactagtgaattcgc

SEQ ID NO: 460569 - DNA, 5379 bp, Homo sapiens
tgcgttgggagtgactgttatttttctccctgctccatggagagagccttgcgccttcccctcccctgctgggggctgccctcctctctcccaggagtttggctgtgggctgctgcgcttgccattggctcagacaccagggccaccagaagctgcctgcagtgtgagcttagagcggtgccagcctcaaggctttccccgtgagtctccatgcaccctcactccaccgccccagcagagtgtattctatcttcattcaggctatagcatagatgactgacagcgctcaagttgttacccttctacgtggcggcatagatgcctttggcctgggagaccttcccaacctgctgggcctggtgggggaccagctgggcgacacagagcggaagcggcggcatgccaagccaggcagctacagcatcgaggtgctgctggtggtggacgactcggtggttcgcttccatggcaaggagcatgtgcagaactatgtcctcaccctcatgaatatcgcctggtgccagctggtgctgtccgtggctggtgacccagctgttatggtagaaaaacttttctccaccctcttatgttcagtactggagggcttctatgtttcctccacacccacagatgagcagggtcgagctccaagagaaagggagcagacatgctcagtgaaactgccagcaggagacttaaggccagcagaggacgtggaagggaaggctgaacaggtctcatgccccagggaactttccaatgatgaaaaactccccactattcagtgcatatatgggtgccaggaaggcccatggctgaagcctgacaccggctgctctgaagtctgcccattcatgaactggggcagctgccagttctgggcactgcggaaagtggcttgggactggggcttggtgatgcacgcggcttctgctgcccacagtttcgtgcttacagcctggctgcctccttggctggcccagaagggggtggacaagcagaggctgagtgtccgcctcatgaacactgttcaggagcttcctggcagaggagtgcaaagggctgcattctttgatgagctgtgcagggcactggcccacagtcctgggcctgaggcctggggtggggcccaagactctgcatttctcacaagctcccaggtgctgctgctgctccaaggtcctggagtatgtctcctggaggagtgcccactgctgcctccccagggccggggtactgtagggcagacattatgccagtggcaactggaacggtacacagggatgttagggcgagtggcctgtggttccctgagccaggtagatgagatttaccacgatgagtccctgggggttcatataaatattgccctcgtccgcttgatcatggttggctaccgacagtccctgagcctgatcgagcgcgggaacccctcacgcagcctggagcaggtgtgtcgctgggcacactcccagcagcgccaggaccccagccacgctgagcaccatgaccacgttgtgttcctcacccggcaggactttgggccctcagggtatgcacccgtcactggcatgtgtcaccccctgaggagctgtgccctcaaccatgaggatggcttctcctcagccttcgtgatagctcatgagaccggccacgtgctcggcatggagcatgacggtcaggggaatggctgtgcagatgagaccagcctgggcagcgtcatggcgcccctggtgcaggctgccttccaccgcttccattggtcccgctgcagcaagctggagctcagccgctacctcccctcctacgactgcctcctcgatgacccctttgatcctgcctggccccagcccccagagctgcctgggatcaactactcaatggatgagcagtgccgctttgactttggcagtggctaccagacctgcttggcagtggttgggggccagggcagtgtccttctgtggcccatgctgaccattcatgaggtgccttctgcccagctggccagtgggcctggtgatgggcccacagacacagtgccagccaccatgcagggatgcagagtgaacacctgtgggggcagtgccatggagaaaggaggggtccctggaggctgccggtacttggagttgagtaaacttgaagcagcagcagcagcccagggtgacctcatgccctctgctctgccccagtggtgcttcaaaggtcactgcatctggaagtcgccggagcagacatatggccaggatggaggctggagctcctggaccaagtttgggtcatgttcgcggtcatgtgggggcggggtgcgatcccgcagccggagctgcaacaacccctccccagcctatggaggccgcctgtgcttagggcccatgttcgagtaccaggtctgcaacagcgaggagtgccctgggacctacgaggacttccgggcccagcagtgtgccaagcgcaactcctactatgtgcaccagaatgccaagcacagctgggtgccctacgagcctgacgatgacccaggtccctacaggaatctggttcctgtggatgaaatccaaggtggtcttggaggttgtggcttccgttgctgcctagagagctgcctgcctgggtcaggatcctgcctgtcctgggttggagctcccccagacccaggtccctacaggaatctggttcctgtggatgaaatccaaggtggtcttggaggttgtggctccagacttgagtccttcatgctggagacaaggagttaccagctgtgctggagcccagggaccagagcagagcccaagaacgcccagaagtgtgagctgatctgccagtcggcggacacgggggacgtggtgttcatgaaccaggtggttcacgatgggacacgctgcagctaccgggacccatacagcgtctgtgcgcgtggcgagtgtgtgcctgtcggctgtgacaaggaggtggggtccatgaaggcggatgacaagtgtggagtctgcgggggtgacaactcccactgcaggactgtgaaggggacgctgggcaaggcctccaagcaggcagtggtgaagaaccaggtcaccggcagcttcatcctcaaccccaagggcaaggaagccacaagccggaccttcaccgccatgggcctggagtgggaggatgcggtggaggatgccaaggaaagcctcaagaccagcgggcccctgcctgaagccattgccatcctggctctccccccaactgagggtggcccccgcagcagcctggcctacaagtacgtcatccatgaggacctgctgccccttatcgggagcaacaatgtgctcctggaggagatggacacctatgagtgggcgctcaagagctgggccccctgcagcaaggcctgtggaggaggcccacggcagcctgcccaccccatagggatccagttcaccaaatacggctgccggcgcagacgagaccaccacatggtgcagcgacacctgtgtgaccacaagaagaggcccaagcccatccgccggcgctgcaaccagcacccgtgctctcagcctgtgtgggtgacggaggagtggggtgcctgcagccggagctgtgggaagctgggggtgcagacacgggggatacagtgcctgctgcccctctccaatggaacccacaaggtcatgccggccaaagcctgtgccggggaccggcctgaggcccgacggccctgtctccgagtgccctgcccagcccagtggaggctgggagcctggtcccagtgctctgccacctgtggagagggcatccagcagcggcagatggtgtgcaggaccaacgccaacagcctcgggcattgcgagggggataggccagacactgtccaggtctgcagcctgcccgcctgtggaggaaatcaccagaactccacggtgagggccgatgtctgggaacttgggacgccagaggggcagtgggtgccacaatctgaacccctacatcccattaacaagatatcatcaacggagccctgcacgggagacaggtctgtcttctgccagatggaagtgctcgatcgctactgctccattcccggctaccaccggctctgctgtgtgtcctgcatcaagaaggcctcgggccccaaccctggcccagaccctggcccaacctcactgccctccttctccactcctggaagccccttaccaggaccccaggaccctgcagatgctgcagagcctcctggaaagccaacgggatcagaggaccatcagcatggccgagccacacagctcccaggagctctggatacaagctccccagggacccagcatccctttgcccctgagacaccaatccctggagcatcctggagcatctcccctaccacccccggggggctgccttggggctggactcagacacctacgccagtccctgaggacaaagggcaacctggagaagacctgagacatcccggcaccagcctccctgctgcctccccgcggggtgggaggaagacaaagatcagggaaagccctaatcggagatacctcagcaagctgcccccggcgggactgaccctctcagggcccctgttggtctcccctgccaagaccaggcccaccagagaagggggctcaggacaccctggaccccaagtcctcagcatccagggatttccaaactggcgctcaccccctgactccaccaggatggcaacttcaattatcactctcagcctggaaggggactctgtgggacacagagggaacacgatttctcaggctgtcccttcaatcattgcccttctccgaagatcgctcctgctggagtcggacatcttcatcttctacctggctcaagctgggccagagtgtgtggttctcccagggcctggccctggagatgacaagggccacccaggccaagtgccccagggcagggtgccagcccctggcctggtgctggagtggggaagacacactcacccacggtgctgtaagggcctgagctgtgctcagctgccggccatgctacctccaagggacagatttaagaggatgtatggaaatgcctggatgtccaggcagaagtctgctgcaggggcagagccctcatggataacctctactagggcagtgcagaagggaaatgtggggttggagtccccacacagagtccttactggggcactgcctagtggagctgtgagaagagtgcgccatcctccagaccccagaatggtagatccactgacagcttgcaccacgctcctggaaaagctgcaggcactcaatgccggcctgtgaaagcagccaagtgtgctgtaactggcagagccacagtggtggacctgcccaatgccttagaagcccacttcttgtctcagtgtagcct

SEQ ID NO: 460570 - DNA, 2564 bp, Homo sapiens
  misc_feature (2)..(2): n is a, c, g, or t
  misc_feature (4)..(6): n is a, c, g, or t
  misc_feature (10)..(10): n is a, c, g, or t
  misc_feature (12)..(12): n is a, c, g, or t
tntnnncctntnaggtctgtgcgttcccgcgtcccccagctccccccgcagccggctcctcagtggtccgctctggttgccaggtgcagattctgttcctaactgaaagctgagtgttctccgcagcttattgtggccccgacaagcctgggtaactgcggccatcgccagagcagccttggcgctatggaggcgcccagggctacccctcagccttactgggggctggtcctggaggagccacgcagggttatggcagcactgactgaaggcaggagaccagattcgaatccttatggattaccatgggaattggtgatatgtgccgctgtcgttggattttttgctgttccctttttcttgtggagaagttttagatcggttaggagtcggctttatgtgggaagagagaaaaagcttgctgtagcactttctggactaattgaagaaaaatgtagactacttgaaaaatttagccttgttcaaaaagagtatgaaagctatgaaatagagtcatctttagacgattccagctttgagaaggaggcaacagaagcacagagtttggaggcaacctgtgaaaagctgagcaggtccaattctgaactggagcatgaaataccctgtctagaaaaggagttaaaagaagagaaatctaaacattctgaacaagatgaggtgatggcggatatttccaaaaggatacagtctctagaagatgagtcaaaatccctcaaatcccatgtagctgaagccaaaatgaccttcaagagatttcaaatgaatgaagaaagaatgaagataggaatacaatatgctttaaatgaaaattctcaacttcaggaaagccagaaacagcttttgcaagaagctgaagcatggaaagaacaagtgagtgaacttaataaacaacagaaaataacatttgaagactccaaagctgctgtgctggaagaagacataacagatgatggtaacttggaattagaaatgaacagtgaatcagaagatggtgcttacgtagataatcctccaaaaggagctttgaagaaactgcttcatgctgctaagttaaatgcttctttaacaaccttagaaggagaaagaaaccaaatttatattcagttatctgaagttgataaaaccaaggaagagcttagagggcatattaaaaatcttcagacggaacaagtatctttgcagttggaaaacacacattttgaaagtgagaatcagaagcttcaacagaaacttaaggtaatgacagaattatatcaagaaaatgaaatgaaactctacaggaaattaatagtagaggaaaataaccggctagagaaagagaaactttctaaagtagatgaaatgatcagccatgctgctgaagagctggagacctgcagaaagcaagcaaacgatcttgaagaagaatttcagagaaaaaaagatccttatgcacttgatgttccaaatacagcatttggcagagagcattcctcatatggtccctcaccattgggtcggccttcatctgaaatgagagcttttctctatcttccatctttgttggagggtccactgagactctcacctttgcttccagggggaggaggaagaggcccaagaggcccagggaatcctctggaccaccagattaccaaggaaagaggagaatcaagctgtgataggtttaccgatcctcacagggctccttctgacactgggttcctgtcacctccatgggaacaggactgtaggatgatgtctcctccaccaggacaatcatatcctgattcagctcttcctccacaaaggcaagacagattttattctaattatgctagacgctctggaccagcagaactcagaagttttaataagcctcctttggataaaatggatgggtcaatgccttcagaaatggaatccagtagaaatgataccaaagataatcttggtaatttaaatgtggctgattcatctctccctgctggaaatgaagtgactggccctggctttgttcctccacctcttgctccaatcagaggtccattgtttccagtggatatgaggggcccgttcatgagaagaggacctccttttcctccacctcctccaggaaccatgtttggagcttctccagattattttccaccaagggatgtcccaggtccaccacgtgcttccatttgcaatgagaaatgtctatccaccgaggggttttcctccttaccttcccctaagacctggatttccccccaccacccccacattctgaagatagagtgagttcccttcagggttgagtctgccttcaaatgagcctgctgctgaagatccagaaccacagcaagaaacctgacaatatttttgctctcttcaaaagtcattttgactgttctcattttcagtgattacacttttgctcaaattgaaacttaatagaattataattctcgggatagtattttgtaaataaggatgatttaaatatgaatcttatgtgtaaattatttccattttattttattctagatagtataactattttaatttggttaactaat

SEQ ID NO: 460571 - DNA, 5009 bp, Homo sapiens
tatgaagagctatgtttgatatgcattggcacaatctcagtatggttagaagctactgtcgggcacaaggtgaagttacaatcagagaagctttacgtgaacttgatctttggggagttggagcagtgtttacattaattgattatgaagacagccaaagtcgaactatgaagctgattaaagactggaaagatatagtaaatcaggttggagataatagatgccttctccaatccttaaaggattctccttattataaaggatttgaagataaagtatcaatttgggaaagaaaacttgcagagttagatgaatacctgcagaatttaaatcatattcagagaaagtgggtgtatttggaacccattttcggccgtggagcattgccaaaagaacagacacgcttcaacagagttgatgaagattttaggatctataacactgttgtcccctacccgtccatccctcccatgggatcatctaagcattggagctggcaggaacttagcagcctgcaacttacctccaggcccttgagcagtcagattttatgcttggcggagcagattaaattcactgaagatgtagaaaatgctattaaagatcatagtcttcatcagattgaaacacaactggtgaataagttagagcaatatactaacattgatacaagttctgaggatccagggaatactgaatcgggcatcctggagcttaaacttaaagccctaattcttgacattatccataatattgatgtggtaaagcagttaaaccaaattcaggttcatacaactgaagactgggcttggaaaaaacaacttagattctatatgaaaagtgatcatacatgttgtgttcaaatggtggattctgaatttcagtatacttatgaatatcagggcatcgatgtgaagtcaatgggacgaatatttgttggtttggtgaagtgtggggcctggggttgttttgatgaatttaataggctggaagaatctgtactgtcagcagtttctatgcaaatccagacaattcaagatgctttgaagaatcatagaactgtatgtgaactgcttggcaaggaggtagaagtaaattctaattctggaatttttatcactatgaatcctgctggaaaaggttatggaggaagacaaaaactgcctgataatcttaaacagcttttcaggcccgtagctatgtctcatccagacaatgagcttattgcagaagttattctctattcggaaggctttaaagacgctaaagtattgagcagaaaattggtagctattttcaatctatctagggaacttttgacacctcagcaacattatgattggggtttgagagctttgaagacagttctgagaggaagtggaaatctccttagacagctaaacaaaagtggcactacacagaatgctaatgaaagtcatattgtggtacaagcactgaggcttaataccatgtcaaagtttacgtttactgattgcacccggtttgatgcactgataaaagatgtctttccgggaattgaattgaaagaagtggaatatgatgaactaagtgctgcattaaagcaggtctttgaagaggccaattatgaaattatacccaatcagatcaaaaaggctttagaattgtatgaacagttatgccagaggatgggagttgttattgttggtccaagtggtgctggaaaatcaacgctttggagaatgttaagggctgcgctttgtaaaactggcaaagtagtgaaacaatatactatgaatcccaaagctatgcctcgatatcaattattaggccatattgacatggacacaagagaatggtctgatggtgttttgacaaatagtgctcgtcaagtggttcgggaacctcaagatgtcagctcatggataatctgtgatggtgatattgaccctgaatggatagaatctctgaattctgttctggatgataatcgactgctgactatgcccagtggagaaaggattcagtttggcccaaatgttaactttgtatttgaaactcatgatttaagttgtgcatcaccagccacaatatctagaatgggaatgatctttcttaggggacttggtggaaatctgaatatgaagtcacgtttggaatttaccaaagaggtttttcattgggcacgagaatctcctccagactttcacaaacctatggatacctactatgactctactaggggtcgattagcaacatatgtgcttaagaagccagaagacttgactgctgatgatttcagtaacggcttaactcttccagtcattcagactcctgacatgcaacgaggtctagattatttcaaaccatggttaagttctgatactaaacagccctttattctggtaggaccagaaggatgtggcaaagggatgctgctcaggtacgcattttcacaactccggtccactcaaattgctacagttcactgtagtgcacaaaccacttctcgacatctcctgcagaaactgagccagacttgcatggtaatcagtactaatactggtcgtgtatacagaccaaaagactgtgaaagacttgttctgtacttaaaagatatcaacctacctaaacttgataaatgggggaccagtactttggtagcattcctacaacaggtgcgagccaaatttacagttgatgattatagtcactatttctttactccttgcattcttacccaatgggttcttggcttatttagatatgatttagaaggaggatcctcaaaccatccactagattatgtgttagaaattgtagcatatgaggcacggcgcttatttcgtgacaaaattgttggtgcaaaggaacttcatttatttgacatcattttaacatcagtgtttcaaggagattggggctcagacatattagacaatatgtcagttgatcctgattttctaaaatcatttttattaatccatgaatcttgtaaagcatatggtgctacaccaagccgatacatgacctttttacatgtgtattctgccattagtagtagcaagaaaaaggaattattaaaaagacaaagtcatttgcaggctggtgtatctaaactaaatgaagctaaagctcttgtggatgaactgaacagaaaagctggagaacaaagtgtgttacttaaaacgaagcaagatgaagcagatgctgcccttcaaatgatcacagtgtcaatgcaggatgctagtgagcaaaaaacagaacttgaaagactgaagcacagaatagcagaagaagttgttaaaattgaagaaagaaaaaataaaattgatgatgaattaaaagaagtacaacctttagtcaatgaagctaaactagcagttggaaacattaagcccgaatcactttcagaaattcgctcactacgcatgccacctgatgtaattagagatattcttgaaggagttttaaggttgatgggtatctttgatacatcttggaatgctaagcgtgccagtactgcagctgcacctttggctgcctgggtgaaagccaatattcagtattcccatgtcttggaacgaattcatcctttggaaactgaacaggcaggattagaatcgaatctgaagaaaactgaagacagaaaaaggaaactagaggagcttcttaattctgttggtcaaaaggtatcagaactcaaagaaaaatttcagagcaggacttcagaagctgccaaacttgaggctgaagtaagcaaggcacaagaaacaatcaaagctgcagaagtcttaattaatcagcttgacagagaacataagagatggaatgcacagtgtcctggtttgggtgataaattatatgatctaatattggtcaactcagtggataatggaaagtataataaggctgttagaaactatggagaaggtagtcgagtgtgcccatttcttatagatccttcttcccaagctacagagtggttaaaaacacatttgaaagactcacgtttagaagttatcaatcagcaggatagtaactttatcacagctcttgaattagcagtacgttttgggaaaacccttattatacaagagatggatggtgtagaacctgttctttatccattattgagacgagatctggttgctcaaggaccacgttatgtggtacaaataggtgacaaaattattgactacaatgaagaattccgcctctttttgtcaacaagaaacccaaatccttttattccaccggatgcagcttccattgttactgaggttaactttactacaacaagaagtggattacgagggcagcttttagctttaaccattcagcatgagaaacctgatttagaagaacagaaaacaaaactattacaacaggaagaagataagaaaatacagctagccaagctcgaagaatctcttctagagacacttgccacatctcaaggcaatattttggaaaataaggatttgattgagtctttgaatcagacaaaagcaagcagtgcacttattcaagagtcacttaaagaatcttacaaactccaaatttcccttgatcaagaacgggatgcctatctccccctggctgagagtgccagcaagatgtacttcattatttctgatttgtccaaaattaataacatgtaccgttttagtttggctgcttttctccgacttttccaacgagctctacaaaacaaacaggagcactgcagctggcatctggtgcgtgcccctctaggacgaagcttccagaggaaagaacaggcagcaatctttgctgttctgcagactctgctggtgatacccaggcaaacagggtcaggagtggacctcctgcaaagtccagcagacctgcagcagaggggcctgactgttagaaggaaaactaacaaacagaaaggaatagcatcaacatcaacaaaaaggacatctatacaaaaaccccatccgaaggtcaccaagatcaaagaccaaaggtagataaatccacgaagatgaggaaaaaccagc

SEQ ID NO: 460572 - DNA, 502 bp, Homo sapiens
tcggattttgggaaaaacggcccgccagtgtggtggaattcctgcgggcaagctcagcctcggtgagtcttggtggccttgacagcccccacttaacacactgtgctgattaagagagacaggagggcaagtttttcccttttttaaagaaatcatcctcgacatggactacctgccttgaagcatgatctatctagttccacttacctcctccccgacgcccccattctgactcttctccagagtggaggtctgagaagaaaaaaagaaatgccgcatttcatctccttgtttcacacccaggagtacttctactctcaacagttggagtctttgcattgtgaacaaaagtcaggttgtgtgggagcaaagccagctgctcccagtgcagacccaggagcagagtgcagaggagaatgagtcagagttgtgtcttcaaaaattacgtaattgcgatttgctaagagtttactttctgtttgggaaattggaaaagagaaag

SEQ ID NO: 460573 - DNA, 1194 bp, Homo sapiens
catagatacatatgtgaagatttattgtattgttcactatcaaagaacaaagcttctggtacctgccctttggacagctgcgggcaagctcagcctcgcttgtccataaagcctgccttgctccaaagcatctgactgtaaagactggtcacctatacctgtgatttgtgggcctgaagaaaaccatccatccttgcaaatgtcttctgctgagatgcctcacacagagactgtctctcctcttccttcctccatggatctgcctattcaggacagccatgattcttccaccagtcccaaaggcaaacaacccactactgcagagaagagtgccacaaaaaaggaagacaaggtcccggtcaagaaacagaagaccagaactgtgttctcttccacccagctgtgtgtactcaatgatagatttcagagacagaaatacctcagcctccagcagatgcaagaactttccaacatcctgaacctcagctacaaacaggtgaagacctggttccagaaccagagaatgaaatctaagaggtggcagaaaaacaactggctgaagaatagcaatggtgtgacgcagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccagtgacttggaggctgccttggaagctgctggggaaggccttaatgatttttcttgtatggaaactacgtgttctggtttccatgatgcctatccagtcaatctcatggagggtgggtcccagcctcatgcggccgccgggctattgggaggtgggtggtcgcggccgcagcgccaagtcgggctggcgggctcagtgctcgctgggggcagggcggcgaactggaggaagagggtggacgttggtgagaaccgcagtttcagccacgccagtgcagcgaaggcccccgatcaaaaagacagatttgttactagatgattcatcggtgccattctttgggcagatagggcagttgtgaaaatgaatcaaggcaatttaaa

SEQ ID NO: 460574 - DNA, 1549 bp, Homo sapiens
ttcaaaggcattgttctccataaaataacttgttcaaacccaaagaacggtgcatttcagagaaggagatgcatatgcgatctaagagctttgcccctggtgggactctgcctgttgcattgccccacgtagcactggacaaggtgccatcccctgctatgcagcaggttctggagcctgccgtcaagacaggatgcagccccacagcgggagcacgctgtcaagctaccattccaaatgttttccgaatctgtttcagaatctatgataacttgccggaagttaaaaagaaaaaagaagaacaaaggaaaagggtgatcttacaaagtaacagactccgtgccgaagtcttcaaaaagagaggcctgatacaagcaagtttgtttacatccctggggaatcttttacatcaaacttttgggatccaaatccatctccttttaaatttcaatctcagcacctgccagttatgcaaatgccaaaatgtgggtcatcatatagtatatttgaaacctttctgaacatgtacaccacccaatgctagaggctgacttggaaaccgtgagtcagcaaatgcttgctccgatgtaacagggctctttgaatgaactatttctgaaacagccaattgtgggagagcagttgagactttgatgtctgaggttctcccatttcaacacttggtataaaaattgcaggcaaggggcctggtctctgactgcatcaaatgaccaacggtctgagtatgaggcacatcaggggcagaaccagagaagagaaagtacggtgatgtggctgcccaacaggaggtcagctcacccagacagcttcctccagctctgaaacagatcgactgagcaccagatgaagttggcatggatgggagatgtgatgtacaagagaaaagcaaaaattacttgagttatctccccgaagtcaaaagtaatgggacacgcagaccctcctgaaattctgagcagaaattgctgctacatttgaatcagattctaagagatcatcaacattagaaggtgcacatcataattcaaatctctgaagaggaagaaggaagatattgacttcagtcttcatttagtcctgttatgggacttccagacactgaaaaaactcatccctacagccggctggaggatattgtcctggaaggggcagctttcacacatggtttgaattcaattagccagctcctctgagagccactagagtaccatttaggacattgcttcttgaattctcatttgcagccttgcaaataattttcaaaggtcattagaccataaggagttttcattacccttcattcatgtcaacagcaaacacttactgattgagcgtccacttggtgccctatgctaggtgcttccaggtgcatccaaaaagggatgcagcacaaaaaattaaaatgactagaagcagcaacacatggaaggtaaaaatctttctaataagagcaatggaagaaacatttctacaaatgttaagttgtaagtcaaatgtttttaaaaagaaagaaatgacaaatttgatt

SEQ ID NO: 460575 - DNA, 825 bp, Homo sapiens
gtactgtgaagcggcactctttagagatgcactatgtgttgttttgtttggttttgtttgtgggcactttctaaaatgggatttaaagtccaggggccataattaggcccaccacaaatgatgttattattgtctttaatgtatggccttaaatacatcataagaaggttcacagtgacagtttactcattgctgcgagcttgtggacaccattgtctgctttaaaacaatgctctggctttgctctttgaagacaagacctgaaaaatcagctgtatgtattttcgtagatcatcaacattagaaggtgcacatcataattcaaatctctgaagaggaagaaggaagatattgacttcagtcttcatttagtcctgttatgggacttccagacactgaaaaaactcatccctacagccggctggaggatattgtcctggaaggggcagctttcacacatggtttgaattcaattagccagctcctctgagagccactagagtaccatttaggacattgcttcttgaattctcatttgcagccttgcaaataattttcaaaggtcattagaccataaggagttttcattacccttcattcatgtcaacagcaaacacttactgattgagcgtccacttggtgccctatgctaggtgcttccaggtgcatccaaaaagggatgcagcacaaaaaattaaaatgactagaagcagcaacacatggaaggtaaaaatctttctaataagagcaatggaagaaacatttctacaaatgttaagttgtaagtcaaatgtttttaaaaagaaagaaatgacaaatttgatt

SEQ ID NO: 460576 - DNA, 1208 bp, Homo sapiens
caaacacatagtatcatggggttatgaaaacttgttgcctgccccagatagcaacactggctccagttctgaaaatcaagggaatccagtggaagctgctgctgttgcctcttcggaccatctcttccctgtccagggccttacttcatggaaacaccacaggtggagtccagcaggaaaatggattagatctctccattcactcaataaaatgtccaagatttcatactatattttcaattaaagaggagtttcagactttatgttgctccaatttatggatatctactctcttgtactttatatccaaatttgtagatctatttgaagaattcagagaatctatggaagatggctcagcttgctgtgaagcaaagaaaccagggaccttctccagaacctctgaagttgatgttaggtccagctagtgtttgtcctctaaaaaaaatacttaactgttgatcagttgttctgctgttggcagctgccttctcagatgggctccgtgctaaacaactctctgctgcttcactacagtcttgctaaggtcttattagtggttgagtcaaacattacaagaaggaggggtttcattcctgtgaagcattcctgtataagagccttcctctctgggatggcctctgttgtcggtcacagttccttcagcttgtgagatggattccttttagtagctactctgaggtgaaaccacttctttttgatcgtccggcacagcccttctttacatcagccatttatttcaaggtaacaaaaactttagatttaaccactgttgctagtggtacacaattccaaactgacatttgaatcaaagtataaatgaatagtatttttaaagtctattgaagtattttcacattttcagtgtgtttttttttgggcctgattttcaagagtaaccatagttttaccattaggaaaaaaaaaaccctaaacattaaaaaactccttggaatgccatctgtattcctccattatgtcatctttcatacaacaatcagctgagtttaatctacaaaataggtctcctggtacctaagactcagggaagactaatggattgaaatgactaaggtcacagagcaaagtataactacctgtgcttagctctcaaaatgatattttattaactaagcgtggaattaggtaactacttgttataaaacgtagtttatagaaatctattt

SEQ ID NO: 460577 - DNA, 648 bp, Homo sapiens
cagggcagagtccttcttacaagaggggtttcattcctgtgaagcattcctgtataagagccttcctctctgggatggcctctgttgtcggtcacagttccttcagcttgtgagatggattccttttagtagctactctgaggtgaaaccacttctttttgatcgtccggcacagcccttctttacatcagccatttatttcaaggtaacaaaaactttagatttaaccactgttgctagtggtacacaattccaaactgacatttgaatcaaagtataaatgaatagtatttttaaagtctattgaagtattttcacattttcagtgtgtttttttttgggcctgattttcaagagtaaccatagttttaccattaggaaaaaaaaaaccctaaacattaaaaaactccttggaatgccatctgtattcctccattatgtcatctttcatacaacaatcagctgagtttaatctacaaaataggtctcctggtacctaagactcagggaagactaatggattgaaatgactaaggtcacagagcaaagtataactacctgtgcttagctctcaaaatgatattttattaactaagcgtggaattaggtaactacttgttataaaacgtagtttatagaaatctattt

SEQ ID NO: 460578 - DNA, 1140 bp, Homo sapiens
gctgtgaggactgccagcacgctgtcacctctcactatgaggactggcttccatggaggtgaagaactgctgcatggtgacagagttcatccttttgggaatcccacacacagaggggctggagatgacactttttgtcttattcttgcccttctatgcctgcactctactgggaaatgtgtctatccttgttgctgttatgtcttctgctcgccttcacacacctatgtatttcttcctgggaaacttgtctgtgtttgacatgggtttctcctcagtgacttgtcccaaaatgctgctctaccttatggggctgagccgactcatctcctacaaagactgtgtctgccagcttttcttcttccatttcctcgggagcattgagtgcttcttgtttacggtgatggcctatgaccgcttcactgccatctgttatcctctgcgatacacagtcatcatgaacccaaggatctgtgtggccctggctgtgggcacatggctgttagggtgcattcattccagtatcttgacctccctcaccttcaccttgccatactgtggtcccaatgaagtggatcacttcttctgtgacattccagcactgttgcccttggcctgtgctgacacatccttagcccagagggtgagcttcaccaacgttggcctcatatctcttgtctgctttctgctaattcttttatcctacactagaatcacaatatctatcttaagcattcgtacaactgagggccgtcgccgtgccttctccacctgcagtgctcacctcattgccatcctctgtgcctatgggcccatcatcactgtctacctgcagcccacacccaaccccatgctgggaaccgtggtacaaattctcatgaatctggtaggaccaatgctgaaccctttgatctataccttgaggaataaggaagtaaaaacagccctgaaaacaatattgcacaggacaggccatgttcctgagagttagtaagagcagataaatgggtgcatggctctggaattccttttgctttgacctaagaaatttcattctggaatcttcatatgtgacaatgacttggaattttcagcactgtgctgaatgatatggaccattatgctatatataatacatta

SEQ ID NO: 460579 - DNA, 930 bp, Homo sapiens
cttagacaaagcgcatgttggtggagaagatgggacatgaagcggtggaacttggccatggagaagcaaacatcaccggcctggaggagaacaccttgatcgccagcctttgtgacctgctggagaggatatggagccatggcttgcaggtcaagcaggggaagtcggctttgtggtcacatttaattcaatttcaggacagagaagagaaacaagagcaccttgcagaatcaccagttgccctcggaccagaaagaagaaaatctgactcaggagttatgttgccaacgctcagggtctctcttattcaggacatgaggcatattcaaaacatgagtgagatcaagactgatgttggacgagctcgggcgtggataagactgtctctagaaaagaagctcttgtcccagcatcttaagcagttgctttctaaccaaccactcaccaagaagctttataagcgatatgcttttctacgttgcgaagaagaaagagagcagtttctttaccaccttctttctctcaatgctgtggactatttctgcttcaccagtgtgttcaccactatcatgattccgtataggtcagtgatcatcccaatcaaaaagctgagcaatgcaataatcacatcaaacccttggatctgtgtatcaggagagctgggagacacaggagtaatgcagattcccaaaaacctcctcgaaatgacctttgaggtaggttcagctaatacctttcctagaagaatgtatcacgtgtagttttacagatgattctgtctggctttttcatttttccttgaatcaaataaaatagaggaacactcaaagcgtgcaggatcatttttgtgattatatgtctaaagttgtcttaagcagcttatatactaatttgttttgcattttcattgttaagctctatttttcactt

SEQ ID NO: 460580 - DNA, 536 bp, Homo sapiens
cttagacaaagcgcatgttggtggagaagatgggacatgaagcggtggaacttggccatggagaagcaaacatcaccggcctggaggagaacaccttgatcgccagcctttgtgacctgctggagaggatatggagccatggcttgcaggtcaagcaggggaagtcggctttgtggtcacatttaattcaatttcaggacagagaagagaaacaagagcaccttgcagaatcaccagttgccctcggaccagaaagaagaaaatctgactcaggagttatgttgccaacgctcagggtctctcttattcaggacatgaggcatattcaaaacatgagtgagatcaagactgatgttggacgagctcgggcgtggataagactgtctctagaaaagaagctcttgtcccagcatcttaagcagttgctttctaaccaaccactcaccaatgattccgtataggtcagtgatcatcccaatcaaaaagctgagcaatgcaataatcactatcgatccgaaatctggcccgaggtacta

SEQ ID NO: 460581 - DNA, 1931 bp, Homo sapiens
gatttgtcctcttgctccttcctgctaggacagcagggcttctcgtacacatgctgtagcgggcactgccttggcaggaggatttggggcttccacatatcctgttctcaagattgtagcatctcagtactctagagcccagtacctgacatcaaggatgtctggagcttccttttaaggaaagaaaagatcagcaaacttgcctgttcccgtttacacttccaccaccagttcgtgagagttcctgttctgcatcctcaacactagtattaagtgagagttcctgttctgcatcctcaacgctagtattaagtgcactggcctttagtctgttaaaaagcatacaatggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagcctctaaccctttgcagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctggtggaagcctggaagaaggagttgaaggagctagcttcccgggtggccttcctcaccaaggaggatgaactgaagaagaaagaggggactgaggagttccgagcagaggcacctagcacagcagctcaaaagctggcaaatgcagggcaccatcagaaaccaggctataagtgggcagcaatgggaaaggcaccaggcctctctgggacagacctgggggcagctgagctgggaattaaggtaggcggtgggcccttggtgcaggatgctgttttcaaatctctgatgggtgtggggaggagcagcagggaggacctacctgggagggagaacgagaaccacccgcgggcatccagcgatcgaccctgcattactgagttccaggaggaagagcttttgctgcagaaggagcagaaggaggagcctctgcgggagcagggggcaaagtactcagcagagactgggaggctcatccccgcttccacccgggctgtcggccgccgcagatctcaccagggccagcagagtcagtcttccagcagacatgaaggagtccaggccttcctccttcaggatcaggagctgctggtcctggagctcctgtgtcagatcctggaaacagacttgctaagcgcaatccagttctggctgctctacgctccgcccaaggaaaaagacctcgctctgggactcctgcagacagcagtggctcagctccttccccagcccctagtctccatccctacagaaaagctcctaagccagcttccagaagtgcatgaacctcctcaagagaagcaagagccaccctgcagtcaatccccgaagaaaacgaagatatcaccttttacaaaaagcgaaaaaccagagtacattggagaagctcaagtcctccagatgcattcaagccagaacacagagaagaagacatcgaagccgagggcagagagctgaggggccctaacacttgcacctgccttgctcaagagcagccccaagggttcaggggtgtttctgtctccaccaccttcacagcagtacctgattccctaccgtgaaaactcttactaaataaaaccgtcttccctgagagaggacagttctgctttcctagcagtgggaggcctgtgcttggttgggg

SEQ ID NO: 460582 - DNA, 497 bp, Homo sapiens
atctcattgatatttgttacttggatgttgaaagaagagagattggattccattcgctccattcctctcaggttggattccctcctcggtcaccagcagagctgagagcaggagctgggcttgactcagaccttcccctcagcactcacacatccacctgcagctcccaggtgggggccccaccttcccggtcctctcctgcctgctgtctctcctcccactagagtacattggagaagctcaagtcctccagatgcattcaagccagaacacagagaagaagacatcgaagccgagggcagagagctgaggggccctaacacttgcacctgccttgctcaagagcagccccaagggttcaggggtgtttctgtctccaccaccttcacagcagtacctgattccctaccgtgaaaactcttactaaataaaaccgtcttccctgagagaggacagttctgctttcctagcagtgggaggcctgtgcttggttgggg

SEQ ID NO: 460583 - DNA, 480 bp, Homo sapiens
  misc_feature (43)..(43): n is a, c, g, or t
  misc_feature (87)..(87): n is a, c, g, or t
  misc_feature (89)..(89): n is a, c, g, or t
atcaccttttacaaaaagcgaaaaaccagcacccacaatgtgngaatcttttgggggggggggggggaattttcccacgtttgaagngnaaaaggaaaaaaattttttttccaaagacaagttcctgctgtcacggaacttacatcccagcaaggaggaatacagacaacaaattaaaacacctggggaggagtggagacagatactagtacattggagaagctcaagtcctccagatgcattcaagccagaacacagagaagaagacatcgaagccgagggcagagagctgaggggccctaacacttgcacctgccttgctcaagagcagccccaagggttcaggggtgtttctgtctccaccaccttcacagcagtacctgattccctaccgtgaaaactcttactaaataaaaccgtcttccctgagagaggacagttctgctttcctagcagtgggaggcctgtgcttggttgggg

SEQ ID NO: 460584 - DNA, 737 bp, Homo sapiens
aaatcttagtgccctctgcgaatgtttatttagtttccattatgttttccccttgtttctatgatcaacaaaaggcaaaacagagaacgctaagcctggctgaagaggcgaagacccttctctccagcctgtgctcaggaacagacggtagcctccgttacgcaaagacggaacttcagcagatttgttatggaacccagcaccaggctagaacttctgctggtcagtcttcagtgcaggggtcataccacagggaacagcactcaacttcctccttcaaactgtgtcctgaacgacaggaccttcaagcctcaggatatacatgggaggaaataaaacttcttgattcctcctgtggctgggggaaccatagagagatcagtcccttgcaactgtccctggggacacttactgagctcctggactgccaagtgctgctggctccccatctgaatactggaaccaaattcaagctggtttgtcttttactgagaagcctttgaattctttgaatatgttctgactggtgtctagccagtgggagatgtgattacagaaattgatgggcctgtggcacagactgctttctgaaaacacagggttgtgtattttgaaagtgattccataaatgcttatttcacctgactccagttttctgtatgtgaaagcagtggctaatgtgtcaaatgaggacaaccaagccatcaaggtctttcctctggaaggtcacagaagaa

SEQ ID NO: 460585 - DNA, 1433 bp, Homo sapiens
cagccagagctccagctgcgcctcttcctcctgttcttaggaatctgtgtggtcacagtgaacagccagagctccagctgcgcctcttcctcctgttcttaggaatctatgtggtcacagtggtgggcaacttgagcatgatcacactgattgggctcagttctcacctgcatacccccatgtactatttcctcagtggtctgtccttcattgatatctgccattccactatcattacccccaaaatgctggtgaactttgtgacagagaagaacatcatctcctaccctgaatgcatgactcagctttacttcttcctcatttttgctattgcagagtgtcacatgttggctgtaacggcatatgaccgctatgttgccatctgcagccccttgctgtacaatgtcatcatgtcctatcaccactgcttctggctcacagtgggagtttacattttaggcatccttggatctacaattcacaccggctttatgttgagactctttttgtgcaagactaatgtgattaaccattatttttgtgatctcttccctctcttggggctctcctgctccagcacctacatcaatgaattactggttctggtcttgagtgcatttaacatcctgacgcctgccttaaccatccttgcttcttacatctttatcattgccagcatcctccgcattcgctccactgagggcaggtccaaagccttcagcacttgcagctcccacatcttggctgttgctgttttctttgggtctgcagcattcatgtacctgcagccatcatctgtcagctccatggaccaggggaaagtgtcctctgtgttttatactattgttgtgcccatgctgaacccccaatctatagcctaagaaataaggatgtcaaatttgccctgaagaaaaatctggacagcaaagcatgttcatgaatccaattattgccatgttgtcatatcaaaacaggctttcagtttgattagatatgtaatatgttagatttattgtgcaaatttatcaaaatatagtgatgctcttttattaaaagacacagccttcaatattccaaacaccgcatatgaaagaagttttcttcccttttgattcccttttgatataagacaacgcacgctaattatcctattacctttgaatatttccaagttattcacagcttctgtgtccctttcattttgtctatgtccctccttacaaaggacattaataataaaaacaaaactttaaatataatgtataatatatttggaattttactttgacacatgaagtgatttttaaaatcatgtgtttactgcttgacataataagggactgcatttataattcattatcccttattttatgactgcctttcacaccctcctagcatgaagggttgttgaattttgtcaaaggccttttctg

SEQ ID NO: 460586 - DNA, 514 bp, Homo sapiens
cttaaagggaagggatggttgctgtcttgctcttcttcatttttcctgcagatatctaatgtatattcacttgaaaatggaagggatgcagataaaagagaggagggcgcagagcggtttggtcgttcgttggaccagtgtcggttcttcgctcgcgactgcggctcttcctcgggcagcggaagcagcgcggaggtcggagaagtggcctaaaacttcggcgttgggtgaaagaaaatggcccgaaccaagcagactgctcgtaaatccaccggtgggaaagccccccgcaaacagctggccacgaaagctgccaggaaaagcaccccctctacctgcggggtgaagcctcatcgctacaggcctgggaccgtggcgcttcgagagattcgtcgttatcagaagtcgaccgagctgctcatccggaagctgcccttccagaggttggtgagggagatcgcgcaggatttcaaaaccgcccagtataccccggatccgcccgtatggtccgcct

SEQ ID NO: 460587 - DNA, 1633 bp, Homo sapiens
cttaaagggaagggatggttgctgtcttgctcttcttcatttttcctgcagatatctaatgtatattcacttgaaaatggaagggatgcagataaaagagaggagggcgcagagcggtttggtcgttcgttggaccagtgtcggttcttcgctcgcgactgcggctcttcctcgggcagcggaagcagcgcggaggtcggagaagtggcctaaaacttcggcgttgggtgaaagaaaatggcccgaaccaagcagactgctcgtaaatccaccggtgggaaagccccccgcaaacagctggccacgaaagctgccaggaaaagcaccccctctacctgcggggtgaagcctcatcgctacaggcctgggaccgtggcgcttcgagagattcgtcgttatcagaagtcgaccgagctgctcatccggaagctgcccttccagaggttggtgagggagatcgcgcaggatttcaacactgacctgaggtttcagagcgcagccgtcggtgcgctgcaggaggctagcgaagcgtacctggtgggtctgttggaagatactaacctgtgtgccatccacgctaagagagtcaccatcatgcccaaagacatccagttggctcgccggatacggggagagagagcttaagtgaaggcagtttttatggcattttgtagtaaattctgtaaaatactttggtttaattggtgactttttttgtaagaaattgtttatatgttgcatttgtacttaagtcattccatctttcactcaggatgaatgcgaaaagtgactgtttacagacctcagtgatgtcagcactgttgctcaggagtgacaagttgttaatatgcaaaacggatgcgtgatatttcttgcttctcatgatgcatgtttctgtatgttaatgacttgttgggtagctattaaggtactagaattgataaatgtgtacaacagggtccttttgcaataaaactggttatgacttgatccaagtgtttaacaattggggctgttaagtctgaccatacatcactgtgatagaatgtaggctttttcaagggtgaagatacaaaccttaaccacagtgtaacttatagtttcctttaaaaaaaaaaaattaaacctggcagctatagaatacaatatgtgcatttataatagctattttatatattgtagtgtcaacattttcaaattaaatgttttacattcacaagtggtggggagtcttgtcattaaggtgtgtgtaatttagagtccagttggttttcttctgactgcacttgttctcatagtagtaaaatgctatgtgcatttataccttgcataaatcctcattctaccacatgttaactaaccctctagctgataatggaaacactaactgggggattttatttataagggctctagaaaaaaatatgagttattcacaccagcatcatctgttaactaatattctgaactagtgcagcttttcattgtgttgtgtggttggtctcataactaggttgagttttctcctctgctaagaggaaacagtactgaagttctttttcttgtggcatttgtattataaaaacttggtgtaggggaggagcacaaagctctagcccactgaacctctgcc

SEQ ID NO: 460588 - DNA, 1464 bp, Homo sapiens
tcctcctcctcctcctcttcttcttcttcttcttcttctcctccttcttcttctttctccttctccttctcctcctccttctccttcttcacacttgtctgcctcataggccagccttgcctgatttatttaactgcaagttagaaactgggagagaaccaacttggagcttttttggtctgggaaagaaaatccaaaccatgcttctctagggcctcctgacctggctaagcaccttggagggaaccctggccacgagggatccaagcaccgctctggtttcccagaagcctgtggatgactctcatctggcggtggacctcagatggggctcagcagtgaaagaggggaagacaaaaatctggcgagcgagctgcccgggccgagactggccacttcaaacagcccttcaaacaaaaggagacgacgaaaagaaagccccacctgtctccagtgtttgctaaaataataataaatagatttcgtttaataaataattacaagagattgtaaagtggagtgctttggaaaacatctaccgcgggagtccgtgcagccagccgtcacctgctcctaaggcgaacaactttattgttaagccaccccccaactagttcgccctgataaactctccctcattttcacaatgactgtttactcatagttagcacaatattacctttgccgtgataaacccggaggggggagacctggcccctggcccctggacacacctgtcccagaagctgacacatggatttggcaccaagcaggcctccccgcgggggccctgcccccatcccccctccctgctcagggccgcctcccctaggcgtccgcagctcgcgcgcggcgcctggaaacaaagtgtccacattatcctcgccggcggctgagaccaggaaaatcaaccctagtgctcagagcattgcaggggatcatttgatgttaccaccatgcagtgtggctaatgagctaaagactttgacaccagtgggaatagcaataattatggtggcagatgtgaaggagggtagactgttcagccggtcttggcacctgactattgaggatgcaagtaggagtagaaaagatgggagaagaagttggaagcttgtattatttatccagggaaatgccatgtctggcacaccaattattagggggacttgtcagtttgctgaaacccccgattataatgggcataactatgaagaaaattataacaaatgtgagggcagtgacaataacattataagtctgatcatctcctgatagggtccctggttgacccagttctgcttggattagaagacttaaggcagtatttactatcccagctcaggagaactggtttctggctggaatcaacaaaagggagacactggtggagattaaagggtaggatgaagagagaaaccagaatatttcttctctttcccttctgcctaaggcaacatctct

SEQ ID NO: 460589 - DNA, 3014 bp, Homo sapiens
gaaagaaagttagcttctaactctctaggctgttatctgagaaaactggtcatgatgtcaaacgtggaggaaacaaccaataggcctagtgggatgctctctatttatcagcacagttactggaatccaaacaaagaaactttccagaatgacaaccgtgctctgccactgaactgtaggacttcccatgcagcgcgtaagccatgcaggcttattactcacaccacactcacctggacccagagacctccaggcactgaggactgcgtctcccggaagtatttccctgagaaattgcagaggacctcagtcctgcaactcacacagaggctgttcttcgtggccggaaccggaccccacgccctctggggcacatccctgagtgcgagcactcttctctcgccctcctcccacccaggcaccgtcccaactgggcactgccttgctatgccccacatctcccacaagggggagccgccggagggcagctggggctgcggaattttggaagcgcagaagttttctcctcctgtcctgtaactggttttcactcactcaactgagagatttctttgttgcaatgatggggtctaagataacacttctggaggctgcaggcgagaaacacagctgatatcatcttttattgtgtgttgttatttgcctagcattataaattaaggaggaatagtaacaaagagcttgaagacatgcacagctcacaggccccgggtggaggctggcgacatcagacagacagaaccaagacatctgaggggcaaccaggaggtgcgtgtggctgcagagcacacaggtaggtacccgcaagaggacagtcgtgacggggggaggagcggatggagcattcacaaaaggtggtcagcagagattaaaggggaaaggcagtgcagaggagttgggagatggagggagagaagagggaggagtcccaaaggagcgcaaaagaaaaaaatgtttgcagggtgtgatacaaaaggctgaccacggagtgggagagggagggtttggaaagtgaatcagagacataagagggtttgaagttggttccaactcggccaccccagaaacttcacaaggcaggagaggatgggagattgacacaaaaggctcagttgcacaagaaaattcaaaggttctttcaacaaactcatttaattgttgctgccccttagctagtgctgagtcactctcaaacttcacagcattccacgacagctcatccttcttgactttcctttttttttcccttttcctttttccttttttaagttctcttaatattttttattcccaacagacttgtctttggacaaaattgagaagaactcataaacttggcttcctcgcttctgctcctcagacccctgcaaacatgacttaccttggaaactataagaaaggatggccttatgtgaggacactcatcatcctggcgttaatgtgcttctcttctatttggcatttgagtccaacactacctgatctcagtccttctttttagaatcaatatttccatagcaagtgtagcatcatcttaaatggggaatcccactttttttttttaaagctagagatggcagtttggtgggattggccaaaaataatttgaagaaagaatgcactaagggtgaaaatgttatgtttataaaaatattatgaaagctaaatgtgatgcacttgaaaaatgtggcaggatatttcactgtatattcatgaaatctgtatctaaactatatcaataaatactattcaagagaatataaaaatttcttccatgtatgcatttctgttcatctagctcattgcttaaccacagaaggttataataataataataaaaacaaacaaaataaatgtttgttagatggatatttatattacaatgtaaataacttattatttatattttatttatgttatgcccataaggaaaatacaatagtcctctgttcaatatttactgggtgtctttagtgtgtcaggcactggactaagtgccaggatgagtgagatgtggtcccttctcccatggaaggtccagagtgggctgcaagtatcatgttggttctgagtcagtcagccatgcttggtgaatcacaaaccactgtgggtggagccttgaagtggctctttgtgggaggatgcagaggaggaagatattttcctcattcatgaggctctcacagtccataggctagtgaacaaataagtacatgaaatgcataatatatgcctagcaaaaagaaacagtggagtatagtacaaatgacttgggatacttttagagataaaacaatgagattttctacctgatgtgaaatctccctgacttgttcagctaatatgtaatttatttaacaactattttttgtgtacttctgtatgcccgaaagtatgccagggatgggcacatggcagtgaacaagaaatgtgtgagactgcgtctaaggaaggtgcaggccaagatgtctaactcagaggtgaaaatgagaaacattcttattaagacgtagagccttttcttggtgactctaagaaacgcttctgtatctgaagacaaaaggaaaagttaatttggttttggattttgccttctaaaacctttggggtttattgggtgttactatcacttgccattttttgtcctctacacttaaaatatgctatacagctcccttcaactcagccatctgtgttcttggcttttaattttcataaaaatggctggacacattcttcttatttcataaatacccaaggccaaagagagatattttattggcatttttcagtaatctttccctaacattgtttttcatatctgttccaaagcctttatattattctacctttcttatgtgtgtgtgttgtgttgtgtgtgtgtgagagagaatatatttgttatattatttgttatagttattatgttaatatatttattataattatgatacaaatgtattagaaattaaaatggtatgttttaatcattt

SEQ ID NO: 460590 - DNA, 838 bp, Homo sapiens
tgatgtattcgttcagaaacacaaagtgtgaatagtactcttatcatcaggaatactgtatgagttcagtgatctttaaacagctcagaagtaatacttgaacttcatttgagtagcacaaagtttacatagccccttttaaatgttaattcgttccatttaagttttccattttcagatgcaactgggtatttttcctcttggaaatagtacgtactttgctttggtatgtagcaaaaggcttccatttctggaagggttttcttgttcttaaacaaggtcagccaggtaccagattctaaaagaacaaattgtcccccacccctcaagtggccttctgactgcacgagaatgtgctactaccctctgtagtctcccctaacacgagaggtcagtgaaattgatggaggaagtgcaaggcttgcttcccctcacccttaaagcttaaagcagttgtaagattttcagtccagcacatacagtcccagtgcccagcacaccggaagtttgtatactggcctcttatcttgtcttcaaatgtgcaggaaatttgaaactgtcatctggaataggttccatctcttatgtgtgttagatcaaaccaaagaagcccccagccatgcccaaatgctgcttcaaaagcctgccttccagtccttacaaaaaccttgcaggattaaatgtgttaacttttttatttttgtacagtttctaagtgatttttgctagtgatgttaaaatgaattaagtttatttgaggggtgtgagcacctcctccatttaaataaactggtgactttccttttattttttaaaagtggaaacccgttgtgtgcct

SEQ ID NO: 460591 - DNA, 2195 bp, Homo sapiens
ggattgcacgcatgtatgcctttagcagctggatgtctcgtcgacgcggccgcgtcgacgctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaaaagtcgacgcggccgcgtcgacgtatttttcctcttggaaatagtacgtactttgctttggtatgtagcaaaaggcttccatttctggaagggttttcttgttcttaaacaaggtcagccaggtaccagattctaaaagaacaaattgtcccccacccctcaagtggccttctgactgcacgagaatgtgctactaccctctgtagtctcccctaacacgagaggtcagtgaaattgatggaggaagtgcaaggcttgcttcccctcacccttaaagcttaaagcagttgtaagattttcagtccagcacatacagtcccagtgcccagcacaccggaagtttgtatactggcctcttatcttgtcttcaaatgtgcaggaaatttgaaactgtcatctggaataggttccatctcttatgtgtgttagatcaaaccaaagaagcccccagccatgcccaaatgctgcttcaaaagcctgccttccagtccttacaaaaaccttgcaggattaaatgtgttaacttttttatttttgtacagtttctaagtgatttttgctagtgatgttaaaatgaattaagtttatttgaggggtgtgagcacctcctccatttaaataaactggtgactttccttttattttttaaaagtggaaacccgttgtgtgcct

SEQ ID NO: 460592 - DNA, 2523 bp, Homo sapiens
tcctcagggctctggcgccaagttcagagccgcgcgctgggcgcttggcggtggcggccgcgtctgcacctcctccctgcgcgccgcctgacagcctgggagagaagcgccctcagagagacatgttgggccgcggttctcttcatccacccatccctccgttcatgacatattgctccattatcttcttgggctggctgctaggacaagtcaactcaggggaggcagcagggtgcgggccttggcccgcagccctagccggggccggggccagggctggtgcccggggcctcgctgtgaggtaggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctgaggacaggatggcaggagcgcccatggctgctgctgtacagcctgctgaggtgactgttgaagttggtgaggacctccacatgcaccacgttcgtgaccgggagatgcctgaaggtgaggaggtgataggtgccatctaccctcgtgtgaccttggagatacctcatcatatcacacaaagagatgcagatagatctttgagcatacctgatgaacagttacactcatttgcggtttccaccgtgcacattacgaagaacagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggtgtgctcacctattattcaagcttaggtgattatatgaagtatattcataaaaaagagattgaccttcagacatctaccatcaaagtcccaggaaagtggccatccctagccacattggcctgcacacccatctccagctctaaaagcgatggcctatccaaggacatggacaccgggctgggtgactccatatgcttcagccccagtatctccagcaccaccatccccaagctcaacccgcccccctctcctcatgccaataaaaagaaacacctaaagaagaaaagcaccaacaactttatgattgtgtctgccactggccaaacgtggcactttgaagccacgacatatgaggagcgggatgcatgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcacccgcctttcccgtgtgcgatctctggagctggatgactggccagttgagctcaggaaggttatgtcatctattggcaatgacctagccaacagcatctgggaagggagcagccaggggcggacaaaacccacagagctctttctggccccactaccctgcactgagctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacaagtgtgtgtagtatctgttttatttgactgcagtctccttggtgcaaaaacaaaatgggaaaaataaggataactcagaatttcaaaaggaaatcacaaattcagctaataatagcattttcagtacttttcgtaaactaagtaaatacacaaaatgttgatttttctgaccataagacgtattttatgtccttttgccaaggtggatttgttagtctcaggccctcctggccacattgcccaagtcacacaggcttctgtattatgtatttagataaaatgtgtgaaaatatatttgaaataaagttcataaatatgcattgattttttacacatggcacct

SEQ ID NO: 460593 - DNA, 2577 bp, Homo sapiens
tcctcagggctctggcgccaagttcagagccgcgcgctgggcgcttggcggtggcggccgcgtctgcacctcctccctgcgcgccgcctgacagcctgggagagaagcgccctcagagagacatgttgggccgcggttctcttcatccacccatccctccgttcatgacatattgctccattatcttcttgggctggctgctaggacaagtcaactcaggggaggcagcagggtgcgggccttggcccgcagccctagccggggccggggccagggctggtgcccggggcctcgctgtgaggtaggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctgaggacaggatggcaggagcgcccatggctgctgctgtacagcctgctgaggtgactgttgaagttggtgaggacctccacatgcaccacgttcgtgaccgggagatgcctgaaggtgaggaggtgataggtgccatctaccctcgtgtgaccttggagatacctcatcatatcacacaaagagatgcagatagatctttgagcatacctgatgaacagttacactcatttgcggtttccaccgtgcacattacgaagaacagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggtgtgctcacctattattcaagcttaggtgattatatgaagtatattcataaaaaagagattgaccttcagacatctaccatcaaagtcccaggaaagtggccatccctagccacattggcctgcacacccatctccagctctaaaagcgatggcctatccaaggacatggacaccgggctgggtgactccatatgcttcagccccagtatctccagcaccaccatccccaagctcaacccgcccccctctcctcatgccaataaaaagaaacacctaaagaagaaaagcaccaacaactttatgattgtgtctgccactggccaaacgtggcactttgaagccacgacatatgaggagcgggatgcatgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcacccgcctttcccgtgtgcgatctctggagctggatgactggccagttgagctcaggaaggttatgtcatctattggcaatgacctagccaacagcatctgggaagggagcagccaggggcggacaaaacccacagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacaagtgtgtgtagtatctgttttatttgactgcagtctccttggtgcaaaaacaaaatgggaaaaataaggataactcagaatttcaaaaggaaatcacaaattcagctaataatagcattttcagtacttttcgtaaactaagtaaatacacaaaatgttgatttttctgaccataagacgtattttatgtccttttgccaaggtggatttgttagtctcaggccctcctggccacattgcccaagtcacacaggcttctgtattatgtatttagataaaatgtgtgaaaatatatttgaaataaagttcataaatatgcattgattttttacacatggcacct

SEQ ID NO: 460594 - DNA, 2683 bp, Homo sapiens
cggctgggaggaatcggtcctccactgtcccagccggccccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggtgagagagcccatttctgcttcctccactcttcttaggggagctgggccacttcgggtccccgctgacccgccttctccccgcaccgccggacagggacccaggctcttgttgatgctgcgtctcagctccggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaaggtgtcaagaagctcagaatgggctcagaatctgaggtggtaagtccaaagttttcattcttcatgtttttattattttaaatttcagctaccaaatatatttgagacaagactcaggatgagctgtctgatatttaaatattaagcaattccatttaagtgctggttcctctaggcactgaaataaaatcattttttgataaatatagaagtttccagtcatgaaaattattggcctattttaatgaatttagtgtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcatcgtattgtgtatattcacctaatgcccattgtgtattgatattgcattcttgaattttgaacactgaatatctttttgaaagattatacttctttacctctttgtgctttagaaattattttccttcaagtgttcaagtctaatgaagaatgaagataacattttatcacttctgtccttaaagatttcagacatggtgaaactgaataaagcatgtcatttgctcctagatagattcattctatctagttgtggggatggagaaatctttaatggtatattttcggttattgccttatttttgatacagtattctgtcagtaatttattagacctggcagctttgggtgagcttagatttttcaccttcagtgttacattgtgtttgcttttaaaaactgcttttgaatggagttgtaaatacaatttttctatgaagatgtttggtttatttacctttttcttaagtttttaatgagaactttgagaaattatcacagggaattcccatgtagttcttttaatgggaagaatttgtaaatttaattgcactgagatattttggtcgttaccttgcaagtttctgtataaaacatagatacctgagttttaacacactgcaagtttatactaaggataatctgtgaaggattgtgaggatttaataactaagtcctgactcaaattatgttaccaataaatgctacttaaatgtaaagtccttgatttattttttcccctcagtcctgtttagtgttgaaattcttcaaaggaggtgagcctttactttaaggtatgtagtagaataatataggtatctgaaaaagaacttggttcatgacatccactcattcatttatgcacttagcaaatattcattgattgccaaatacgcatcagacactgagctaggtgctaggtactagtcagtcaacactaaacctgttttgtaaatttgatgctagtattatactggactttctcaaaatgaagtacacctatatatgcatatagtatatgagcatgtgtatttgtacaaaagcccttcaaaaggagttcagcttttataaacaccaaaacactctctgcctgtaaaatgtttttgctgaaatttgtatcatt

SEQ ID NO: 460595 - DNA, 651 bp, Homo sapiens
  misc_feature (27)..(27): n is a, c, g, or t
  misc_feature (48)..(48): n is a, c, g, or t
cgcctgagcggccgcaggggagagagntgagtctaggaaaagcactcngttgtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcat

SEQ ID NO: 460596 - DNA, 609 bp, Homo sapiens
actaactctgttagaaagctctttaacggaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcat

SEQ ID NO: 460597 - DNA, 550 bp, Homo sapiens
  misc_feature (42)..(43): n is a, c, g, or t
  misc_feature (47)..(47): n is a, c, g, or t
atgtaagtaaatcttttacaaatgtgcgaacaacacagaaannctgnttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcat

SEQ ID NO: 460598 - DNA, 511 bp, Homo sapiens
ctttcaacaaagatgaaattactttaaacgtgctctgtctggtattataggatgaagaagttccagtttcaaatgtaataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcat

SEQ ID NO: 460599 - DNA, 373 bp, Homo sapiens
actaactctgttagaaagctctttaacggaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatc

SEQ ID NO: 460600 - DNA, 1234 bp, Homo sapiens
cggctgggaggaatcggtcctccactgtcccagccggccccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcat

SEQ ID NO: 460601 - DNA, 1266 bp, Homo sapiens
aagcagtggtatcaacgcagagtgcccattacggccggggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatatagagacggggtttcatcgtgttggccaggctggtctccaactcttgacctcaagtgatccacctgccttggactcccaaagtgctgggattacaggtgcagatgctaatttcagtgtctggattaaaaggtgtcaagaagctcagaatggggtcaagaaatctgagagtgtaggattcatcagtccaaaactcgggtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcat

SEQ ID NO: 460602 - DNA, 1335 bp, Homo sapiens
cggctgggaggaatcggtcctccactgtcccagccggccccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatatagagacggggtttcatcgtgttggccaggctggtctccaactcttgacctcaagtgatccacctgccttggactcccaaagtgctgggattacaggccagatgctaatttcagtgtctggcattacacaggtgtccaagaaagctcaggaatgggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcat

SEQ ID NO: 460603 - DNA, 2388 bp, Homo sapiens
aagcagtggtatcaacgcagagtgcccattacggccggggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatatagagacggggtttcatcgtgttggccaggctggtctccaactcttgacctcaagtgatccacctgccttggactcccaaagtgctgggattacaggtgcagatgctaatttcagtgtctggattaaaaggtgtcaagaagctcagaatggggtcaagaaatctgagagtgtaggattcatcagtccaaaactcgggtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcatcgtattgtgtatattcacctaatgcccattgtgtattgatattgcattcttgaattttgaacactgaatatctttttgaaagattatacttctttacctctttgtgctttagaaattattttccttcaagtgttcaagtctaatgaagaatgaagataacattttatcacttctgtccttaaagatttcagacatggtgaaactgaataaagcatgtcatttgctcctagatagattcattctatctagttgtggggatggagaaatctttaatggtatattttcggttattgccttatttttgatacagtattctgtcagtaatttattagacctggcagctttgggtgagcttagatttttcaccttcagtgttacattgtgtttgcttttaaaaactgcttttgaatggagttgtaaatacaatttttctatgaagatgtttggtttatttacctttttcttaagtttttaatgagaactttgagaaattatcacagggaattcccatgtagttcttttaatgggaagaatttgtaaatttaattgcactgagatattttggtcgttaccttgcaagtttctgtataaaacatagatacctgagttttaacacactgcaagtttatactaaggataatctgtgaaggattgtgaggatttaataactaagtcctgactcaaattatgttaccaataaatgctacttaaatgtaaagtccttgatttattttttcccctcagtcctgtttagtgttgaaattcttcaaaggaggtgagcctttactttaaggtatgtagtagaataatataggtatctgaaaaagaacttggttcatgacatccactcattcatttatgcacttagcaaatattcattgattgccaaatacgcatcagacactgagctaggtgctaggtactagtcagtcaacactaaacctgttttgtaaatttgatgctagtattatactggactttctcaaaatgaagtacacctatatatgcatatagtatatgagcatgtgtatttgtacaaaagcccttcaaaaggagttcagcttttataaacaccaaaacactctctgcctgtaaaatgtttttgctgaaatttgtatcatt

SEQ ID NO: 460604 - DNA, 1094 bp, Homo sapiens
cggctgggaggaatcggtcctccactgtcccagccggccccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatatagagacggggtttcatcgtgttggccaggctggtctccaactcttgacctcaagtgatccacctgccttggactcccaaagtgctgggattacaggtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatc

SEQ ID NO: 460605 - DNA, 998 bp, Homo sapiens
cggctgggaggaatcggtcctccactgtcccagccggccccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatc

SEQ ID NO: 460606 - DNA, 1343 bp, Homo sapiens
cccccccccgcggggggcgagcccgctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcatcgtattgtgtatattcacctaatgcccattgtgtattgatattgcattcttgaattttgaacactgaatatctttttgaaagattatacttctttacctctttgtgctttagaaattattttccttcaagtgttcaagtctaatgaagaatgaagataacattttatcacttctgtccttaaagatttcagacatggtgaaactgaataaagcatgtcatttgctcctagatagattcattctatctagttgtggggatggagaaatctttaatggtatattttcggttattgccttatttttgatacagtattctgtcagtaatttattagacctggcagctttgggtgagcttagatttttcaccttcagtgttacattgtgtttgcttttaaaaactgcttttgaatggagttgtaaatacaatttttctatgaagatgtttggtttatttacctttttcttaagtttttaatgagaactttgagaaattatcacagggaattcccatgtagttcttttaatgggaagaatttgtaaatttaattgcactgagatattttggtcgttaccttgcaagtttctgtataaaacatagatacctgagttttaacacactgcaagtttatactaaggataatctgtgaaggattgtgaggatttaataactaagtcctgactcaaattatgttaccaataaatgctacttaaatgtaaagtccttgatttattttttcccctcagtcctgtttagtgttgaaattcttcaaaggaggtgagcctttactttaaggtatgtagtagaataatataggtatctgaaaaagaacttggttcatgacatccactcattcatttatgcacttagcaaatattcattgattgccaaatacgcatcagacactgagctaggtgctaggtactagtcagtcaacactaaacctgttttgtaaatttgatgctagtattatactggactttctcaaaatgaagtacacctatatatgcatatagtatatgagcatgtgtatttgtacaaaagcccttcaaaaggagttcagcttttataaacaccaaaacactctctgcctgtaaaatgtttttgctgaaatttgtatcatt

SEQ ID NO: 460607 - DNA, 850 bp, Homo sapiens
gtatattcagtagatggtaaataaatgaccaattcttcagtgagacactgactttctatacctgcatttatgtaccttgatttttaaaaatttttggataaacttgcatgtgtttggcacaaagagagcacaaagtagaggcccttcaagttctcttcagctggtacaagaagagattattttgactggtctttacggtcttcagcaaaagagattataataatcattttttttgggagctaataatattttcaattgaaggtagtttttccacatgcacatctatgctcattagcaaaggatgtagtgcacctccctgactactttaggatttccttttcagattttatggaacttgttaacctctggaatgcctaagtttaaataaaaatattgttttgagtttatattgagctatatattttatctgtataatctattatatatgtattgcatagagtttatattgagctgtatataatagccaatatttggggctctatgcttggaacattttaagaaaaatattctattttgattatatggtccaggaattaatctatttttatttttcattgcagatggagtcgggtggtacagttttgagtaccaactggtctgatgtaggtaaaaggaaagttgaaatcaatcctcctgatgatatggaatggaaaaagtactaaataaattaatttgctctcatcgtattgtgtatattcacctaatgcccattgtgtattgatattgcattcttgaattttgaacactgaatatctttttgaaagattatacttctttacctctttgtgctttagaaattattttccttcaagtgttcaagtctaatgaa

SEQ ID NO: 460608 - DNA, 659 bp, Homo sapiens
ggacgcgttgggctcagattctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcat

SEQ ID NO: 460609 - DNA, 553 bp, Homo sapiens
gcttcgagttatgagctcacaatgtgacgaaaaaaaaaaaaaaacttttgttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcat

SEQ ID NO: 460610 - DNA, 548 bp, Homo sapiens
gtgtcataaccttattttacccagaccacacccaaaaaaaccctgttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcat

SEQ ID NO: 460611 - DNA, 1330 bp, Homo sapiens
cggctgggaggaatcggtcctccactgtcccagccggccccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatatagagacggggtttcatcgtgttggccaggctggtctccaactcttgacctcaagtgatccacctgccttggactcccaaagtgctgggattacaggtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcat

SEQ ID NO: 460612 - DNA, 1464 bp, Homo sapiens
cggctgggaggaatcggtcctccactgtcccagccggccccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgggaaaaactgaataccttgagtaaaattacatagaaaatgttaatgagacaaggaggtgaattttgtgacacagctgtattcattgaagagctttaagaaggaagctaaatgttaagccaaaaggaagttgctgttgctgatgcaaagaagtctctagaactcaatccaaataattccactgctatgctgagaaaaggaatatgtgaataccatgaaaaaaactatgctgctgccctagaaacttttacagaaggacaaaaattagatatagagacggggtttcatcgtgttggccaggctggtctccaactcttgacctcaagtgatccacctgccttggactcccaaagtgctgggattacaggtgcagatgctaatttcagtgtctggattaaaaggtgtcaagaagctcagaatggggtcaagaaatctgagagtgtaggattcatcagtccaaaactcgggtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcat

SEQ ID NO: 460613 - DNA, 1362 bp, Homo sapiens
cggctgggaggaatcggtcctccactgtcccagccggccccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgggaaaaactgaataccttgagtaaaattacatagaaaatgttaatgagacaaggaggtgaattttgtgacacagctgtattcattgaagagctttaagaaggaagctaaatgttaagccaaaaggaagttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcat

SEQ ID NO: 460614 - DNA, 1363 bp, Homo sapiens
cggctgggaggaatcggtcctccactgtcccagccggccccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatatagagacggggtttcatcgtgttggccaggctggtctccaactcttgacctcaagtgatccacctgccttggactcccaaagtgctgggattacaggtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcataaaaacaagaaaaagatggcctcgttggcctca

SEQ ID NO: 460615 - DNA, 1030 bp, Homo sapiens
aagcagtggtatcaacgcagagtgcccattacggccggggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatatagagacggggtttcatcgtgttggccaggctggtctccaactcttgacctcaagtgatccacctgccttggactcccaaagtgctgggattacaggtgcagatgctaatttcagtgtctggattaaaaggtgtcaagaagctcagaatggggtcaagaaatctgagagtgtaggattcatcagtccaaaactcgggtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatc

SEQ ID NO: 460616 - DNA, 2186 bp, Homo sapiens
gaggagagccacgtgggtcgagctggggcgcagctcgcatgggggagtctatcccgctggccgccccggtcccggtggaacaggcggtgctggagacgttcttctctcacctgggtatcttctcttacgacaaggctaaggacaatgtggagaaggaacgagaggccaacaagagcgcgtgaggaggtcacgcctcgggtcgtgtacgcttgcgtggccgagccctttgatgcgccacgctgcgcctgctgcgcacgagaatacggtcgtattcgacacgcagctcagcgctatcgcatgcgcggtcagcaaacctagtggggccagtctttcttcagcaggaaggattccatccgcaccatctatacttcattgcataatgagctgaagaaggtggtgactggccgtggtgccctgggtgggactgctcctcacgtggaagaactcctttcccacctgtcagagcagctctgcttctttgttcaggctcggatggagatagcagacttctatgagaagatgtacaccctcagcacacagaagttcatcaatgctgaagagctcgttggccttttggatgccatcatgaaaaaatacagctccagatttcaccacccaatcctcagtcctttggaaagcagtttccagctggaagttgacgtcctgtgtcatctcctgaaagcccaggcccaggtctcagagtggaagttcctcccatctctggttaatttacacagtgcgcacaccaaactgcagacgtggggccagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggatccaaaggttagcaggtgatttgcgtggaggggtttcaagactagaaactgttcttaattgccctaatgatctacggtggtctgtgaatagagtttacatccattcatgcctctttcagaactaaattaaagacaaatcctccctgtgttgcacactttataagcaattaaggccaattgaattaagtttccaaagagtaatctaggaagtggtcatgggctaccatgtgtctccatggtacagcaaagtagtttcagtattttcccctattttgctatatttcttgtagattgaatatttattgggctttttttttcccatatgtttttctgttgttctaaacattgtgttctactgcaattccaaacagcctctctgtttccctccttcttggaagagtaatagggatgagatattaaatggcctttttagaattaagaactatatgttttctgtctcataaattagcaaatgaatatggagttagtagatttatgattctgatctacaaattaacatttttgatgccaaaattagggtcttggggtcctgaccgcaaaggagggaggagggacaattgacatctaagggcactatattctttcttcctccttctgttccttaagttataggaggaaaggattagcaacctctcctttcattaatcaacaaaaaagtctttaattgtattacgtgctgcgggcttgctgatgcataagatggtggttgtgacttacgtttatcacccatatgtattgattttataggaaggtga

SEQ ID NO: 460617 - DNA, 2585 bp, Homo sapiens
gaggagagccacgtgggtcgagctggggcgcagctcgcatgggggagtctatcccgctggccgccccggtcccggtggaacaggcggtgctggagacgttcttctctcacctgggtatcttctcttacgacaaggctaaggacaatgtggagaaggaacgagaggccaacaagagcgcggggggcagctggctgtcgctgctggcggccttggcgcacctggccgcggccgagaaggtctatcacagcctcacctacctggggcagaaactagggggccagtctttcttcagcaggaaggattccatccgcaccatctatacttcattgcataatgagctgaagaaggtggtgactggccgtggtgccctgggtgggactgctcctcacgtggaagaactcctttcccacctgtcagagcagctctgcttctttgttcaggctcggatggagatagcagacttctatgagaagatgtacaccctcagcacacagaagttcatcaatgctgaagagctcgttggccttttggatgccatcatgaaaaaatacagctccagatttcaccacccaatcctcagtcctttggaaagcagtttccagctggaagttgacgtcctgtgtcatctcctgaaagcccaggcccaggtctcagagtggaagttcctcccatctctggttaatttacacagtgcgcacaccaaactgcagacgtggggccagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggatccaaaggttagcaggtgatttgcgtggaggggtttcaagactagaaactgttcttaattgccctaatgatctacggtggtctgtgaatagagtttacatccattcatgcctctttcagaactaaattaaagacaaatcctccctgtgttgcacactttataagcaattaaggccaattgaattaagtttccaaagagtaatctaggaagtggtcatgggctaccatgtgtctccatggtacagcaaagtagtttcagtattttcccctattttgctatatttcttgtagattgaatatttattgggctttttttttcccatatgtttttctgttgttctaaacattgtgttctactgcaattccaaacagcctctctgtttccctccttcttggaagagtaatagggatgagatattaaatggcctttttagaattaagaactatatgttttctgtctcataaattagcaaatgaatatggagttagtagatttatgattctgatctacaaattaacatttttgatgccaaaattagggtcttggtaagaaatttctatcagttattgaaactgaaagtgagtcagattggtagcatgacgtaaggttttaacagttcagaagatcctcatggcagctttaatagccatgggttcttttggggtaatgtacacacctaactgcatttgttttgacttctttaatgtttgaatgtttcactctgttgtaaagtcagcataagccatcatgtgggctttcttcattcttcagcatattatccgcttcgctttctgtttatcacttttctgctgaaatgtacatgtttggctctactccttggttatttttaggcttaaaagcatgcagtcggtttttcagccacttttagatactcatgcaacatagcctacttttataaaatcaaaatgaaggtcttcatacgctgtacttgctaaaaatcaactgtgcgcttgaaagacctcttcatagttgagtaatcacctcagtacttaagcacttctgaacttgggtttcatgcctgccccccacaaattatgtttagaagcagcactgcatcttagcacatgctgccttatttctttccttcggcaggtgttcatgggaagtaggtggatcagtgaaggcataatgggctgtggagaccttcacttctagattattgattcaaaataaaaagaagccacaaagagtaattgagtt

SEQ ID NO: 460618 - DNA, 1805 bp, Homo sapiens
gaggagagccacgtgggtcgagctggggcgcagctcgcatgggggagtctatcccgctggccgccccggtcccggtggaacaggcggtgctggagacgttcttctctcacctgggtatcttctcttacgacaaggctaaggacaatgtggagaaggaacgagaggccaacaagagcgcggggggcagctggctgtcgctgctggcggccttggcgcacctggccgcggccgagaaggtctatcacagcctcacctacctggggcagaaactagggggccagtctttcttcagcaggaaggattccatccgcaccatctatacttcattgcataatgagctgaagaaggtggtgactggccgtggtgccctgggtgggactgctcctcacgtggaagaactcctttcccacctgtcagagcagctctgcttctttgttcaggctcggatggagatagcagacttctatgagaagatgtacaccctcagcacacagaagttcatcaatgctgaagagctcgttggccttttggatgccatcatgaaaaaatacagctccagatttcaccacccaatcctcagtcctttggaaagcagtttccagctggaagttgacgtcctgtgtcatctcctgaaagcccaggcccaggtctcagagtggaagttcctcccatctctggttaatttacacagtgcgcacaccaaactgcagacgtggggccagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggatccaaaggttagcaggtgatttgcgtggaggggtttcaagactagaaactgttcttaattgccctaatgatctacggtggtctgtgaatagagtttacatccattcatgcctctttcagaactaaattaaagacaaatcctccctgtgttgcacactttataagcaattaaggccaattgaattaagtttccaaagagtaatctaggaagtggtcatgggctaccatgtgtctccatggtacagcaaagtagtttcagtattttcccctattttgctatatttcttgtagattgaatatttattgggctttttttttcccatatgtttttctgttgttctaaacattgtgttctactgcaattccaaacagcctctctgtttccctccttcttggaagagtaatagggatgagatattaaatggcctttttagaattaaga

SEQ ID NO: 460619 - DNA, 2140 bp, Homo sapiens
gaggagagccacgtgggtcgagctggggcgcagctcgcatgggggagtctatcccgctggccgccccggtcccggtggaacaggcggtgctggagacgttcttctctcacctgggtatcttctcttacgacaaggctaaggacaatgtggagaaggaacgagaggccaacaagagcgcggggggcagctggctgtcgctgctggcggccttggcgcacctggccgcggccgagaaggtctatcacagcctcacctacctggggcagaaactagggggccagtctttcttcagcaggaaggattccatccgcaccatctatacttcattgcataatgagctgaagaaggtggtgactggccgtggtgccctgggtgggactgctcctcacgtggaagaactcctttcccacctgtcagagcagctctgcttctttgttcaggctcggatggagatagcagacttctatgagaagatgtacaccctcagcacacagaagttcatcaatgctgaagagctcgttggccttttggatgccatcatgaaaaaatacagctccagatttcaccacccaatcctcagtcctttggaaagcagtttccagctggaagttgacgtcctgtgtcatctcctgaaagcccaggcccaggtctcagagtggaagttcctcccatctctggttaatttacacagtgcgcacaccaaactgcagacgtggggccagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggatccaaaggttagcaggtgatttgcgtggaggggtttcaagactagaaactgttcttaattgccctaatgatctacggtggtctgtgaatagagtttacatccattcatgcctctttcagaactaaattaaagacaaatcctccctgtgttgcacactttataagcaattaaggccaattgaattaagtttccaaagagtaatctaggaagtggtcatgggctaccatgtgtctccatggtacagcaaagtagtttcagtattttcccctattttgctatatttcttgtagattgaatatttattgggctttttttttcccatatgtttttctgttgttctaaacattgtgttctactgcaattccaaacagcctctctgtttccctccttcttggaagagtaatagggatgagatattaaatggcctttttagaattaagaactatatgttttctgtctcataaattagcaaatgaatatggagttagtagatttatgattctgatctacaaattaacatttttgatgccaaaattagggtcttggggtcctgaccgcaaaggagggaggagggacaattgacatctaagggcactatattctttcttcctccttctgttccttaagttataggaggaaaggattagcaacctctcctttcattaatcaacaaaaaagtctttaattgtattacgtgctgcgggcttgctgatgcataagatggtggttgtgacttacgtttatcacccatatgtattgattttataggaaggtga

SEQ ID NO: 460620 - DNA, 1453 bp, Homo sapiens
aacctacggctaggtacgaggcctgggtgtgacagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggatccaaaggttagcaggtgatttgcgtggaggggtttcaagactagaaactgttcttaattgccctaatgatctacggtggtctgtgaatagagtttacatccattcatgcctctttcagaactaaattaaagacaaatcctccctgtgttgcacactttataagcaattaaggccaattgaattaagtttccaaagagtaatctaggaagtggtcatgggctaccatgtgtctccatggtacagcaaagtagtttcagtattttcccctattttgctatatttcttgtagattgaatatttattgggctttttttttcccatatgtttttctgttgttctaaacattgtgttctactgcaattccaaacagcctctctgtttccctccttcttggaagagtaatagggatgagatattaaatggcctttttagaattaagaactatatgttttctgtctcataaattagcaaatgaatatggagttagtagatttatgattctgatctacaaattaacatttttgatgccaaaattagggtcttggggtcctgaccgcaaaggagggaggagggacaattgacatctaagggcactatattctttcttcctccttctgttccttaagttataggaggaaaggattagcaacctctcctttcattaatcaacaaaaaagtctttaattgtattacgtgctgcgggcttgctgatgcataagatggtggttgtgacttacgtttatcacccatatgtattgattttataggaaggtga

SEQ ID NO: 460621 - DNA, 1075 bp, Homo sapiens
aatcctgcataaattggagacatgggcaaggaaaactgcaccactgtggctgagttcattctccttggactatcagatgtccctgagttgagagtctgcctcttcctgctgttccttctcatctatggagtcacgttgttagccaatctgggcatgactgcactgattcaggtcagctctcggctccacacccccgtgtactttttcctcagccacttgtcctttgtagatttctgctactcctcaataattgtgccaaagatgttggctaatatctttaacaaggacaaagccatctccttcctagggtgcatggtgcaattctacttgttttgcacatgtggagtcactgaggtcttcctgctggccgtgatggcctatgaccgctttgtggccatctgtaaccccctgctgtacatggtgaccatgtctcagaagctgcgtgtggagctgacctcttgctgctacttctgtgggacggtgtgttctctgattcactcgtccttagctcttaggatcctcttctatagatctaatgtgattaaccacttcttctgtgatctaccccctctcctaagtcttgcttgctctgatgtcactgtgaatgagacactgctgttcctggtggccactttgaatgagagtgttaccatcatgatcatcctcacctcctacctgctaattctcaccactatcctgaagatacactctgcagagagcaggcacaaagctttctccacctgtgcctcccacctcacagccatcactgtctcccatggaacaatcctttacatttattgcaggccgagttcaggcaacagtggagatgttgacaaagtggccaccgtgttctacacagttgtgattcccatgctgaaccccctgatctacagcctgagaaataaggatgtgaacaaagctctcagaaaagtgatgggctccaaaattcactcctagggaagattttattcacagaattcaggatccccaagttgtggcaagtgaagaaagcggacacaattggagaaagtggttattttaccaaggctttgactggaagggtatgcttcccttt

SEQ ID NO: 460622 - DNA, 2426 bp, Homo sapiens
tgcacgcatgcacgcacacacggacctcccacccacccatcagaagcgtatcagaggcctctgcctcccgccaggattcccggctgcaggacacagcccagcaggagaagcttttccctccattctttcaaggaatctcgctctgttacccaggctggagtgaagtggcccaatctcggcttaccacaacctctgcctcccaggttcaagcgattctcctgcctcagcctcccaagtagctgagattacagagagatatatgcccaggatggggctgaataaaaagctaataataatagccaccacctgtggagagcttctcttggaccacgcattctgctaagtccttctcttgtatgaggaccagttgtgcccagagaaccttctctgtctcctctaaccatgggataaaaggagatttccacaagagcggctcagggacgcagcccatctcttaagaaggaggctctgagagggacaagaccatggatgcagcacatggccacaaggcagtttcaagatgcccatgtcaggcagaggatggctcagtggtctctaacccacctaacatttcatgaactttactcctggtcccgctcccaaattagacactggagataatggatcactatactgcactgaagactcggaggggttgagccgctggagccacgcaaattcagacacctcttccgccccaggtcactctactcgcccacgctgcctgccacacccatccggttgtgcgggacactccccgcgtttcttcagcgattcttatcgggctccctccttgttcaataaaggtgaagggtcctctgcagacagaggcaccctgagctcctgggatctggggcagcagcctcagggctgtcctggatttgaacggcaagtacagaattgcacccatcctctcaaggctcgtcaggactgtactgggcacggccctggcctcctcactcactgcccacagcagccctcccaggggactgcactggtggaggaggggcagacccagtctgccctcggatgggacgcagggattcaaagtccatttttccatctgaaacactgactgcatcacacgttacctttaactggaaaaagacaacatgcactttgcaatgttctgcgttaagatgaatacatgatgaacagtgacagcttaactgtctggttgaccttgaagaaaaaaagacaaccattctgttttaatgtagtcaaataaacatcaagtggcttgcaagtaaaaagcaggaaaaggcagcactttgtgaaaaaggaggtttgggatttgtaaacgttttaacgagtcatctgggaaaacccgaggtgtgtctcctgtgcaaaagactcacatccggaattacaaaggttttgcatttagcacagaagtgatgcgtcgaaacacccgattgtttaaattttaatgacaaacaaaaaacgtgctttaataagatttcactttcatttccctgagtagctatgttctggggcctgtgaatcttcttggagcattaaatgcatttgtcaatttggggggtagcctttcaattaatatgaagtcaaaataaaaggacactcacaggtcctttctttcccaggtgggggttcttcctggtgttgtactattgagaactgaattgacaggtgtgtggacatccctggtcattgtcttctgctgtctaaccacgtcgtctttcccataggctttccatctactgagaaaggggagaaggaagagaatgaaatggaaaatgagtgattggtcttatgtaaacccttctaggcaaaacaggaaccagagggggtctgatattttggatcaaatgagttgctggttttatttagagatcctgcttagaattaatgcgtccatgctgttggagaagagagcaaagtagtgacaacatcaggctcattgttcattcattcattcattcatacattgagcattcctaggggctgaggagtcaagagccattaaattttatccagtaatcttcccttatctgcggattcgcctttggcagttccagtagcctgtggtcaactgatgtcccaaaataggtgtcatttctgagcagggaaggtgtgatctggggccagaatgaatggccctggtgacttcttacctgattcatcccacaccagtcagaaggggctgtgaaggcagcagcgaaggagccacacatggacgtggaatgggcacgctgaccatcatggtcacgactgcaagaaagcagggctgcgtgggttaattggctgtgtctgagggtcacccctgcacaaggaggatgatgacgactgccctgtgcaaccctgggtcatctcaggggagagccattcccaggttcacagcaagcactcttttactcagatgggccacctgcatcaggccccaaggaagcacttattagtagaag

SEQ ID NO: 460623 - DNA, 591 bp, Homo sapiens
tccctcatcatgcattgtcaacaatacataaaagctgaaaggcgcctcacactcgggctcacgctccgcaagtagccaacatgcaagaagagacagaggggcttccagcatggtgcctgacacctggagacacccactacttactgtgtgggtgaatgaagaaaatgcgtacctggctccagaatggcccattgctggttggcatggggttccgttgcttagaggtgagagggtgagtatgggctccactggaagacaatagggcatagatgtggttcggccacatatttcatcaaggtgcacctgtgacttctgcagcatctaatttgagaaattgataaaatggctaaacagtgtatattatggtagtcggagagatgagttggttataaccccggctctttcttgcagggctgcgtgggttaattggctgtgtctgagggtcacccctgcacaaggaggatgatgacgactgccctgtgcaaccctgggtcatctcaggggagagccattcccaggttcacagcaagcactcttttactcagatgggccacctgcatcaggccccaaggaagcacttattagtagaag

SEQ ID NO: 460624 - DNA, 1517 bp, Homo sapiens
ccagccagtgtccacatgctgctgagtctccctgtgagagctcagctgttccctgactggcagaggcagaaggctgtccagaacaacccgtacccgtctgccttcctgcagggagaacaggacaccgtcggcgttttggaccaggtctctcccccgccgcctcgtcctttctgggagccagcccctcccccttccagtctccatctgcccccacccaggctctggggcgcccacggcctgcgagaggagcccgagtttgtgacggcaagagctggggagagcgtggtcctgcgatgcgacgtgatccacccagtgacgggacagcccccaccctatgtcgtagagtggttcaagttcggggtccccatccctatcttcatcaagtttggctactacccgccgcacgtggaccctgagtatgcaggccgggccagtcttcatgataaggcatctctgcggctggaacaagttcgctctgaggaccagggctggtatgagtgcaaagtgctcatgctggaccagcagtatgacaccttccacaatggcagctgggtccacctcaccatcaacgagacctggctagggaggggagttcgtcacgtgcaggtgggaagtggagtagggtcctccagccagagtggacaagcgtgctcggaagcccagagcgaggagagcggcgcattcagggaacacgggtaggctgttcatagggaaatgctgggcgggaaagctggggatggtgcaccatctgctccaggcttgagaaccagggctgataataaaagacgcttttccataatcaaggcacctacctgcgcacaggcagaacagaaccaacccttctgcggtgagagatctcctttctcctcttctgcctttctcttcttcccaagttcgaggctccttccagcataaaaatttccgttactgaaggaaggaatccaagcacctgcattacgttgctttcaaactagaatgtttaatgtcaggcattttctgacggggatcacctttggaaaatgaaaggccagtgaacaattagaattacaaattgtctcattttccttcggtgttttctttgaagaccagttgggtggaaacagacccaattatttctttatcacatataaaataccccaaaagcctgagccaagccttcctttaggttggtgaattacatggaggagagggcagcctatttctaacctgcactattaattacagggctcttgtaaaaaagaattaagcctggaaatgcagctggcaagctgacatctagttccgtaaataattgacagtcaagccattattttcctgaaaactagaaattgttcaacgtactttcctgattagcacctaaataataaagtaattatgtaattagtaagtaatttgtcacttcaggatgtaaatttaatttattatcttttcttttaagcttggcaccagaggtaatagaggcagtatctgtgttcactgtatttcaaggggcaggccgggcaggcaggggctgtgtc

SEQ ID NO: 460625 - DNA, 1415 bp, Homo sapiens
tgaagctcagctcatcatgctcctgcccctcatagtcatacagggcccggactcgcacttccgtccccgaggtgtcgacgcggccgcgtcgacacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaattaatgcagttcatgggctttaggtacttcagttatgaagtaggcttttcatggggagagattgggattatgctctctgttgtttaagaaactgtttgattttagagtctatttctatgagatagtttaccaaataaatgttccttataagaaaaaaaaaaaaaaaaaaaaaaaaaaaaaaaagtcgacgcggccgcgtcgactc

SEQ ID NO: 460626 - DNA, 1430 bp, Homo sapiens
cttcagtcaacgagtggataaagaaaatgtggtttattcatactactcacccataaaaaggaacgaaataatggcattggcagcaacctggatggaggtggagaccataattcttagtgaaaataaaagcaggcagaggaacttggaaggactagactggctgagtcttccagcctacatctttttcctgtgtgggatgctttctgccttccaacatcatactccaagttcttcagattttggactcttggaccttcgatacagactggagtctgaagtctgcactattggcttccctacatttgaggttttgggactcagactggcttcctggcttctcaccttgcagatcgcctattgtgggacttcacctggtgattgtcagagacccattggtaaagattccctcaaaatcttgtcctcactttcacaccttttgcctggatccagcctgtgggcagaacacacctgtggctggagaagagccacagcagaagagttaattactcacattggcatcacaattttccaaactgtgacacatgtgtccttgtagaaacctctgagacactaaaggctgccaccgccatcattgtcaaacctcacaccattcattatcccttcacttcagaaaagcagcagcaggcttagggaggtgaattgctttattagtcttggtatcaatagatggtgaggatgggcttgaaatccaggacccctttccttctccctattttcatctctcctgttccccatgcccatttgggttttggtgtagaaccttcttatttagaattgattctctttcacatttgaaatctatggaaaggtgaagcaactcttcctccatggctgcctctcaagtggctgtgtggggaggaaggccacgttctgcttccctgcactttctccttaggcatggcaaagatgtttgatctcaggacgaagatcatgatcggcatcggaagcagcttactggttgccgcgatggtgctcctaagtgttgtgttctgtctttacttcaaagtagctaaggcactaaaagctgcaaaggaccctgatgctgtggctgtaaaaaatcacaacccagacaaggtgtgttgggccacgaacagccaggccaaagccaccaccatggagtcttgtccatctctccagtgctgtgaaggttgtagaatgcatgccagttctgattccctgccaccttgctgttgtgacataaatgagggcctctgacttgggaaagctgggcacaaaaatcttcatgagcaatatttctttcttaatagaatgttttattattcaagtcaagttctagagtgtttacatactattatataatgtacagtgttattttctgtacttctgaataaatgtgcaatattggaaataatcctctgcctccagtatttttgttagttataaacatc

SEQ ID NO: 460627 - DNA, 1374 bp, Homo sapiens
tttgtgaaatgagggggcggagggagcagcgccgaggccccttccggctctgcagtgcctcgaattctaggctgctggtgcgtcttttcctgaggggaaacggggagaaagtgcagcctcaggtgctggcctttcccgggaagagctcccagccgccttccgccggccccacgcctccgcccagctcccgcccaccgccctcccctccgcggcgcaggaggccggcctggctccaggatgaagcggaggttgccgcggcgctggccggttacggcttcataaatcccagttccacgggggagggcccagcacggcccagcacccagacgctgaggagaagtggggcttttccgtgcgagagtgtgggcgtgccgggcgcacgtccgggaaggggtgctgagggccgccctgctcggaggagacccgcccctgcaccgcccctcctcccgctcccctcccgggccctctggttgggtggagaagagtcgagaagagtggagaagagtcgagaagagtggagaagagtcgagaagagtcgagaagagtggacaaggcgaaccgtctgcagcgaggcggggctggggggcgcggggaggacggggttcaggccggtgtcgctctcaaggggcagccctggtgtcacccccaccccctcccacgctgaagccttccggccgagctgtggcatccacgcaaatggggccgcctcggcacctccaggccagaatttaaatgttatcagcggcaattgatctgctcgggactgaggtttcgggtcctctgcggaattgggaggagcgtggatggtgaaggagctgctgcactgtggcacgggcttggccggggctgcctggctctgagcaggctcgtgggacggccctgtaaggaccccactgcaagaagggcacagaagcacctgagttggcgtctcagcagggacccccccaggaaatgcccttctacagctggtactcaagctctttacacacttagccatcgctatacacagtccacgcttgtgcacccacacccacaagcttatgctcacgtgcacttttttttttttttggaaacggattttcgctcttgtcgcccaggctggagtgcaagggcgccatctcagctcactgcaacctccgcctccggggttcaaaaaattctcctccctcagcctctaaagtaacgtgggattacaggcgcgcgccaccacaccgggctacatgctgggcatagaacgcaaagatggaggcttgccaagctggggccggcaggacacaaagtcctgacctacagtgaccgccacggctggggtccacaagtgatgggtacaggcatgaccaacgacgcgcctcaagggcgattcggatcggggtc

SEQ ID NO: 460628 - DNA, 3042 bp, Homo sapiens
gcagcacagttgagtctccagccttgactcttctcaagagcctgtgactttcctccctggacaaaggcatcatgagttgtcagatctcttgcaaatctcgaggaagaggaggaggtggaggaggattccggggcttcagcagcggctcagctgtggtgtctggtggaagccggagatcaacttccagcttctcctgcttgagccgccatggtggtggtggcgggggcttcggtggaggcggctttggcagtcggagtcttgttggccttggagggaccaagagcatctccattagtgtggctggaggaggtggtggctttggcgccgctggtggatttggtggcagaggaggtggttttggaggcggcagcagctttggaggtggcagcggcttcagtggtggtggtttcggtggaggcggctttggtggaggccgctttggaggttttgggggccctggtggtgttggaggtttagggggtcctggtggctttgggcctggaggataccctggtggcatccacgaagtctctgtcaaccagagcctcctgcagcctctcaacgtgaaagttgacccagagatccagaatgtgaaggcccaagagcgtgagcagatcaaaactctcaacaacaaatttgcctccttcattgacaaggtgcggttcttggagcagcagaaccaggtgttacagaccaaatgggagctgctacaacaaatgaatgttggcacccgccccatcaacctggagcccatcttccaggggtatatcgacagcctcaagagatatctggatgggctcactgcagaaagaacatcacagaattcagagctgaataacatgcaggatcttgtggaggattataagaagaagtatgaggatgaaatcaataagcgcacagctgctgagaatgattttgtgacgcttaaaaaggacgtggacaatgcctacatgataaaggtggagttgcagtccaaggtggacctgctgaaccaggaaattgagtttctgaaagttctctatgatgcggagatatcccagatacatcagagtgtcactgacaccaacgtcatcctctccatggacaacagccgcaacctggacttggatagcatcatcgccgaggtcaaggcccagtatgaggagatcgcccagaggagcaaggaagaagcggaggccctgtaccacagcaaggcaagtagagggaatgtaggaagagccacagctccctgccatgagctgggttgcacccccagctggaaagtgtacagtaagtatgaggagctccaggtgactgtcgggagacatggagacagcctgaaagagatcaagatagagatcagcgagctgaaccgcgtgatccagaggctgcagggggagatcgcacatgtgaagaagcagtgtaagaatgtgcaagatgccatcgcagatgccgagcagcgtggggagcatgccctcaaggatgccaggaacaagttgaatgacctggaggaggccctgcagcaggccaaggaggacttggcgcggctgctgcgtgactaccaggagctgatgaacgtgaagctggccctagatgtggagatcgccacctaccgcaaactgctggagggcgaggagtgcagcatcttgggtgacttaatctggctgaagcaattggaaggggaaaagctaccccaggccatcagcaagccagcatgacaaacagggagtggctttcttcaggaggttgctctgtccctgtctagaggcaatgcctcctatgcccagcttgatgtctggagacctcagcagcaatgtgactgtgtctgtgacaagcagcaccatttcatcaaatgtggcatccaaggctgcctttggaggttctggaggtagagggtccagttccggaggaggatacagctctggaagcagcagttatggctctggaggccgacagtctggctccagaggcggtagtggaggaggaggttctatctctggaggaggatatggctctggcggtggttctggaggaagatacggatctggtggtggctctaagggagggtccatctctggaggaggatatggctctggaggtggaaaacacagctctggaggtggctctagaggaggctccagctctggaggaggatatggctctggaggtgggggttctagctctgtaaagggtagctcaggtgaagcttttggttccagcgtgaccttctcttttagataaagatgagcccccaccaccaccgactctcccaacccagactctcccactccagaatgtagaagcctgtctctgtacctctaactggcagcaagttaaatttttgtcatttatctctgatggcactttgagggaaaagaatgtccacatacagtttttgaaagatcttctctccaaaccagttagttagagccagtgacgcctctgtgttctggggcggaatctgtgctgtctaggtttgtgcttctagccatgcccattcccgcccccaccatgcctctttgcattgcccattttccagatgtgtattctgttgaggacccaggcccatccagggatttcatctctaagcctggcagtgctggggggaaatgtgtttctgtgtatatagctcctcttgtccactctgctttcggaagtgctgtggtctgggggtcttcataataaacctcatttgcaattcatatcatgtgctgtctgcgtgatgtcaaaccttggtggaagtgggcagccatggacaagggaggtttgggcattaaggaggggctcctggaagatggaagaagaaacaccttccatcttgttttataaggccagcattaatggaagaaactaaagaacaaatccctcatggatatatatatatatatatatatatatatatatatatatattcaaaaattatcagcaagatatgagcaaattcaatctagaaagatataaaaaggataatacatcatgaccatgtgtttaaaaatattgtttaaaaatagtgaggtatatgtttaaaatgtatcccagaaataaaaagcttgctcaacattc

SEQ ID NO: 460629 - DNA, 1369 bp, Homo sapiens
  misc_feature (19)..(19): n is a, c, g, or t
  misc_feature (44)..(44): n is a, c, g, or t
gcccgcaggctgctgctgnagtttggggtgctcttctgcaccancctccttttgctctgggtgtctgtcttcctctatggctccttctactattcctatatgccgacagtcagccacctcagccctgtgcatttctactacaggaccgactgtgattcctccaccacctgactcctctcccctcgtttttccttcaataaactattttgtgtcagcttcttccttgactctgaaatgggttcagggccatttgaacaccctgtgtcccccatgcatctctcactttccgccattagaggggagctggtggattcccgctgcatcaaggcctacccactgcccttggcccctcaagactttgaagaagaggaggcagatgagactgagacggcgtggccgcctttgccggctgtcccctgcgactacgaccactgccgacacctgcaggtgccctgcaaggagctacagagggtcgggccggcggcctgcctgtgcccaggactctccagccccgcccagccgcccgacccgccgcgcatgggagaagtgcgcattgcggccgaagagggccgcgcagtggtccactggtgtgcccccttctccccggtcctccactactggctgctgctttgggacggcagcgaggctgcgcagaaggggcccccgctgaacgctacggtccgcagagccgaactgaaggggctgaagccagggggcatttatgtcgtttgcgtagtggccgctaacgaggccggggcaagccgcgtgccccaggctggaggagagggcctcgagggggccgacatccctgccttcgggccttgcagccgccttgcggtgccgcccaacccccgcactctggtccacgcggccgtcggggtgggcacggccctggccctgctaagctgtgccgccctggtgtggcacttctgcctgcgcgatcgctggggctgcccgcgccgagccgccgcccgagccgcaggggcgctctgaaaggggcctgggggcatctcgggcacagacagccccacctggggcgctcagcctggcccccgggaaagaggaaaacccgctgcctccagggagggctggacggcgagctgggagccagccccaggctccagggccacggcggagtcatggttctcaggactgagcgcttgtttaggtccggtacttggcgctttgtttcctggctgaggtctgggaaggaatagaaaggggcccccaatttttttttaagcggccagataataaataatgtaacctttgcggtttaagaggataaaatggaggatattattatgtgggtatttatatgacctttgtaaccatttaaaaatgtaaaaacgacctgacttagtaatgc

SEQ ID NO: 460630 - DNA, 2054 bp, Homo sapiens
catggggatctggcatgcacctgtccccagcctctgcttcccacccccggcaggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttcttccttgactctgaaatgggttcagggccatttgaacaccctgtgtcccccatgcatctctcactttccgccattagaggggagctggtggattcccgctgcatcaaggcctacccactgcccttggcccctcaagactttgaagaagaggaggcagatgagactgagacggcgtggccgcctttgccggctgtcccctgcgactacgaccactgccgacacctgcaggtgccctgcaaggagctacagagggtcgggccggcggcctgcctgtgcccaggactctccagccccgcccagccgcccgacccgccgcgcatgggagaagtgcgcattgcggccgaagagggccgcgcagtggtccactggtgtgcccccttctccccggtcctccactactggctgctgctttgggacggcagcgaggctgcgcagaaggggcccccgctgaacgctacggtccgcagagccgaactgaaggggctgaagccagggggcatttatgtcgtttgcgtagtggccgctaacgaggccggggcaagccgcgtgccccaggctggaggagagggcctcgagggggccgacatccctgccttcgggccttgcagccgccttgcggtgccgcccaacccccgcactctggtccacgcggccgtcggggtgggcacggccctggccctgctaagctgtgccgccctggtgtggcacttctgcctgcgcgatcgctggggctgcccgcgccgagccgccgcccgagccgcaggggcgctctgaaaggggcctgggggcatctcgggcacagacagccccacctggggcgctcagcctggcccccgggaaagaggaaaacccgctgcctccagggagggctggacggcgagctgggagccagccccaggctccagggccacggcggagtcatggttctcaggactgagcgcttgtttaggtccggtacttggcgctttgtttcctggctgaggtctgggaaggaatagaaaggggcccccaatttttttttaagcggccagataataaataatgtaacctttgcggtttaagaggataaaatggaggatattattatgtgggtatttatatgacctttgtaaccatttaaaaatgtaaaaacgacctgacttagtaatgc

SEQ ID NO: 460631 - DNA, 1837 bp, Homo sapiens
ggaagaaaatcttagtcccctgccctggacactttcgccagtcaagggcagaaggtggctaaacaataggacgccgcaggtagggggacaggttgatgaaagccccgctgtgtcccgtgatttgtgacagatatctgttttcttcctcattccaatgcatcatcttggattttggaatatttgcattatacttatcagttgagcatcacaaattcaaaaatccaaaatctgaaatgctccaaataagaatttcctttcagcctcatggcaaggatgcaattgaaataaagaaggaaacagatacctgtcacaagtcactggatacagctgagcttctatcaacacaactcaagtgtgtgcatctggtacctgtcaagttagagaaattggttgttgtacaacatgacctcataatcaaaatattgtatcagagtgcctgctgctcatttgattcagtttggagatcatttggttccatggacaacctctattggtgttatatctggggaagtgcttgccttggtcctggacttgataccactaaagctgataatgagaacagagtagggttctattagactttcggggaagagcagcttctgggctcatgtagggccctgcactttcattctgggggcactgacaaatacaaacagaattcagagcattaggaagacaagcagggccttcagtaggcataaggtgatgaggttcatgccgttggatcccacgggtgccctggggaagagatggttgggaagtctgagaggaagcaggagagctttcggagcacatggatgccgtccagaatggagatggttgtggctcggaagaaaaagaaatcacccagctcggagtcaggatacatttggaggtccaggccgccgagtttgctggtggggaagataggcaccagaaaggaaagaggacatccagggcaatttcttctgccccccagccaatccgtacattgtccagaggccaagcctactgctgttagaaaacatatttagaaatcacttggttcttccttgcctgaacatcatctatttagttagcttgtgttgtttagatgtgcttcagatctcaaaaaaataaattatgttatttgaaagcttgctctctgcttgtttacactattaatttagagtccagaggaatctctaaatttgcctctagaaaccacataatcacctaataatacctttcctgactccactttctgacacaaagtgacttttgaaacgcttccatcttccctttctatttaatgtactgcactccactcttttttcctttcgttttttctacagtccgtcatggagtatttgtttaccaaatgttacttttcttggatccaatctatttttgaagagcgcaaaagcaaacaactgtttgaagctgtcaagcttcattttatttatgcatgaataacacaaataacttgaaaatgacctagtctgtttttctcagatttagatagaaaaactgcttccggccaatgtttatgccaatttgttcatgccaagtttccagtttcggtgccaaccggtttttacagccaagttgtaaaccttcggtaaacatggcttataatgaaaagtgcaacacagcctgaaccctggcaccaggggacggatgtaaatttattctaagaacaaaattctaacaggaacaggaggggagctaggctggctacaaagtgttcccaccgtaatatggaaaatgtacagatgatgatatatttgattactaagatcccattaggccaatttaggcactttatgtatttcctttgctctggacgctgagtggtttcatgctcaatttgaagcaa

SEQ ID NO: 460632 - DNA, 1356 bp, Homo sapiens
aaagtagtgatgtaaggtagaatatagaacaaaaaaaaaggttggtcttgcctctgtcatccaggctggcgcgatctcggctcactttgacctctgcctcctgggttcaagcgattctcctgtcacagcctcctgagcagctgggattacaggcaggcaccaccatgctgagctaatttttgtatttttagtagagaccaggtttcgccatgttgcccaggctactctcgaactcctggcctcatgtgatccgcccacctcagcctcccaaagtgctgggattacaggcgtgagccactgcaaccagctggaacaatcttgatattagggtgaacaagtgatttcatagctttctctgaaggaggaaacactgggagcatccacccgagaatcaacactgtggatcattctggggagttaatagttttgagatgtgtcccaagataattgttagcttgaattaccacgtggatggaaccatgctgatcctaagagccaggccaagcctactgctgttagaaaacatatttagaaatcacttggttcttccttgcctgaacatcatctatttagttagcttgtgttgtttagatgtgcttcagatctcaaaaaaataaattatgttatttgaaagcttgctctctgcttgtttacactattaatttagagtccagaggaatctctaaatttgcctctagaaaccacataatcacctaataatacctttcctgactccactttctgacacaaagtgacttttgaaacgcttccatcttccctttctatttaatgtactgcactccactcttttttcctttcgttttttctacagtccgtcatggagtatttgtttaccaaatgttacttttcttggatccaatctatttttgaagagcgcaaaagcaaacaactgtttgaagctgtcaagcttcattttatttatgcatgaataacacaaataacttgaaaatgacctagtctgtttttctcagatttagatagaaaaactgcttccggccaatgtttatgccaatttgttcatgccaagtttccagtttcggtgccaaccggtttttacagccaagttgtaaaccttcggtaaacatggcttataatgaaaagtgcaacacagcctgaaccctggcaccaggggacggatgtaaatttattctaagaacaaaattctaacaggaacaggaggggagctaggctggctacaaagtgttcccaccgtaatatggaaaatgtacagatgatgatatatttgattactaagatcccattaggccaatttaggcactttatgtatttcctttgctctggacgctgagtggtttcatgctcaatttgaagcaa

SEQ ID NO: 460633 - DNA, 1452 bp, Homo sapiens
aaatagaggacaagatccattttgccaagaacaaccatatggatttaactgctgctaacaaccgttaggaaggaacatcaataaaaagcaagcctgtgagacaactccttccccaaggggcgcttgttacagagcgcgggccccagcaggcctggtccatcctccacattctttcctctctgacttatttttactttctgtttgaattggcttggttttattttgccctaaactgtgtctgtagtcatcccccgacagagttttgagagtgaaagtccgatctgcccacgcttcacagaactcaatgcggagccttctcaggagtcacttgacgtcaaggctgacttttaaatttgccaaaaaggcattctttggggagcggtcggcaccatcactttccctctttagagagctgctactggctgctggaattcaaaacccacaaattgcatttctaaacttaattcgatacatagatgagcggaaagatcagacattgatgctattgttttcaaccaagatgttttactatatcatttatattttgtttttttcttcccccagtttttaaactttttgtttgtttgttttacaggccaagcctactgctgttagaaaacatatttagaaatcacttggttcttccttgcctgaacatcatctatttagttagcttgtgttgtttagatgtgcttcagatctcaaaaaaataaattatgttatttgaaagcttgctctctgcttgtttacactattaatttagagtccagaggaatctctaaatttgcctctagaaaccacataatcacctaataatacctttcctgactccactttctgacacaaagtgacttttgaaacgcttccatcttccctttctatttaatgtactgcactccactcttttttcctttcgttttttctacagtccgtcatggagtatttgtttaccaaatgttacttttcttggatccaatctatttttgaagagcgcaaaagcaaacaactgtttgaagctgtcaagcttcattttatttatgcatgaataacacaaataacttgaaaatgacctagtctgtttttctcagatttagatagaaaaactgcttccggccaatgtttatgccaatttgttcatgccaagtttccagtttcggtgccaaccggtttttacagccaagttgtaaaccttcggtaaacatggcttataatgaaaagtgcaacacagcctgaaccctggcaccaggggacggatgtaaatttattctaagaacaaaattctaacaggaacaggaggggagctaggctggctacaaagtgttcccaccgtaatatggaaaatgtacagatgatgatatatttgattactaagatcccattaggccaatttaggcactttatgtatttcctttgctctggacgctgagtggtttcatgctcaatttgaagcaa

SEQ ID NO: 460634 - DNA, 1580 bp, Homo sapiens
gcaggcatcatagatggtattacaggcggctggtctctcctctctcagccaactatgagaactatttgggattgaaggagataagctacagcaagtcgttacttgtcctgaatgcacgaccttctttctttgagcaagaggacaaacctggatggagtccattgcccaggctggagtgtagtggcacgatctcggctcactgcgacctccacctcccgggttcaagtgattctcctgcctcagccttctgagtagctgagactacagggtcttgcctctgtcatccaggctggcgcgatctcggctcactttgacctctgcctcctgggttcaagcgattctcctgtcacagcctcctgagcagctgggattacaggcaggcaccaccatgctgagctaatttttgtatttttagtagagaccaggtttcgccatgttgcccaggctactctcgaactcctggcctcatgtgatccgcccacctcagcctcccaaagtgctgggattacaggcgtgagccactgcaaccagctggaacaatcttgatattagggtgaacaagtgatttcatagctttctctgaaggaggaaacactgggagcatccacccgagaatcaacactgtggatcattctggggagttaatagttttgagatgtgtcccaagataattgttagcttgaattaccacgtggatggaaccatgctgatcctaagagccaggccaagcctactgctgttagaaaacatatttagaaatcacttggttcttccttgcctgaacatcatctatttagttagcttgtgttgtttagatgtgcttcagatctcaaaaaaataaattatgttatttgaaagcttgctctctgcttgtttacactattaatttagagtccagaggaatctctaaatttgcctctagaaaccacataatcacctaataatacctttcctgactccactttctgacacaaagtgacttttgaaacgcttccatcttccctttctatttaatgtactgcactccactcttttttcctttcgttttttctacagtccgtcatggagtatttgtttaccaaatgttacttttcttggatccaatctatttttgaagagcgcaaaagcaaacaactgtttgaagctgtcaagcttcattttatttatgcatgaataacacaaataacttgaaaatgacctagtctgtttttctcagatttagatagaaaaactgcttccggccaatgtttatgccaatttgttcatgccaagtttccagtttcggtgccaaccggtttttacagccaagttgtaaaccttcggtaaacatggcttataatgaaaagtgcaacacagcctgaaccctggcaccaggggacggatgtaaatttattctaagaacaaaattctaacaggaacaggaggggagctaggctggctacaaagtgttcccaccgtaatatggaaaatgtacagatgatgatatatttgattactaagatcccattaggccaatttaggcactttatgtatttcctttgctctggacgctgagtggtttcatgctcaatttgaagcaa

SEQ ID NO: 460635 - DNA, 551 bp, Homo sapiens
ggtgacgggcaacacagctgtgcggagatgggaaccctacctgagtccagcccttctgtggttctgttaacattgatcagtttagcaatcagtacttactccattttaagagtcttccaagaggacgcgcaggagtcagcgctccggggaaagaagatgagaaacaccaggtggaccaccctggccaggctgctgggaacaagcctacgtgcacagctgccggaggagaggcggaaaagctgccagcaggaccccgtctcctgttggcggtggctccgcacaggcttcctcttgtcaagctctgctgcttccagccacaagactgctgttcctgtccttgacctcaaagcctgtgaaacgatgatggagcccagttctgctcctccttggagtgcccgctttgtgctgattctcttccagagtcgacatctgaataaccgtcagtgagcctgccttgctctgttatagggtctcagggcacctgctcacgttgacaatgatattagtgaaacggcagagcctcaccggactgccagaaaaggacaggccac

SEQ ID NO: 460636 - DNA, 2523 bp, Homo sapiens
ctgactatattttggttcctcccactacttcagagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaaagccgtcccaggacttcaggggcttcctacctacagaatttattaagagttccccctgatcccacctccacagaatcatttcttctgaagggccccccttccatgagtgaattcatccaagggcaccggctcagcaaggaaaaaaggttaaccgtggctccaccagagaaaattattcttgcaaataaaaatcatccttttaaggaatccctgcatgaaaggaggtcaacttgccccagtgccatgagctcagcactacaacctggtgcaggacttcgaagtaatagaaagcgaggctgcaaaggtggacagggacctgaagacagagggccaggttagtgagagcagacttaccacgggcatagcttagcagttttaagaataggatcagattttcatttgataaaatcaccctgatgacaaggtggagagtggattagatgtgggtaacatc

SEQ ID NO: 460637 - DNA, 619 bp, Homo sapiens
ctgacctcgtgatctgcccgcctcggcctcccaaagtgctggggttacaggcgtgagccaccgcgcccggccaagaatgactttgtaaatcagtgttgacattcaggacctttttcatttcgtgttaaagactgatcaccctgggaaaatcaaggcagtccagccaaaccccaactcccaatcaaatgcagtttgtatcgaaccccacgactgcccagcacctttgggaagcccattgctttctatgcagacgcagagctcccagaaagcacaggtggatgtgctcagcttgccttgtgacgtgaatgcctgaaaacagaacaggactaaaaattcactgtctcagagcctgcagcttgggagtctgagttctcagggacaagaagagaagagttcccagtgtggcaaggaccaggcggaccagccttaggccgggctctggttcctcccctctctgtggattccctttgatcctcccctcctgccccactttgcagcctccacagcttagctgctaaatcactggggattaagacgctaggggccggaggggagggcaactcgtcctgggacagaaagggctcctttcctgggaggggtgagaggaagctggggttct

SEQ ID NO: 460638 - DNA, 2459 bp, Homo sapiens
gcggccgcccatgtccagctcaggctgggccagagctccgaagaggactcacaggcagttggggggacagaaggtggggccagagacaagtgcccccatgggcaaagagtaggtgagacggggcagggaaggtagggctggggcctgcctctcagctctgatcccccagaaactcccttaggaaggaaatagagtttctcatccctgtgtttctgaggggaaaaggagacagagaaaggttgggcaggctgacttgggtcacgtaccaatacctaacgtttatgaagtgcttgtcagacactgttttaagctctgtagatgtcaaaggaccccatgacgtaggtattattattccctttgacagttgaagagatgaaggcgcagaggcatgaactcccgtagccagagagtgtgagctggactctacctggagcagcctcggtgcagagcccatgcccccaaccatgtccgtggtcgaggcccagcccagacagggcacaaaggggctgaggaagaggaagtaagatgccagggttgccatgcaggagggcaaccccaagtgagatgggcatcgtggcctagggcccatcttccggaagagctcatcagaacttcggacacactgcatgggcctagacccagggctcgttgagctcctccctcggattggcttcgaattttaggtgaatcctctctagcagccacattcacccttgcaagcctgcactttgtcatcttctgaaaaggtgcaggaacatgatgcccagctgactcccagggagcgggagccccagaggccagcggagcacagccgcagcaggcagatctgttgggaaaccacgggagtataggagcagggctgggggcacctgagggactgtggagcctgaattattgaaacgcttagagtaaagcagatttagatttcacaaagacagaggtgaaggtgggtgaagacggagggaaggatttaaagggaaagagaaagaggaaagataagaatgaggggatcctctagaccgggagagagggagaaaggagagcgagctcggattgccatctgcctaggtgcagtgtggggcaggcggggagcggagctcggactgccgtctgcctaggtgcaacgtggggcaggcagggagcggacagcactcttcaaggctctagaacgctggtgggttcctggaccttgactctgtgtgacaggactgtgtatgcaacccagtgtcaagagcagaaatgcgcaaatgctgcctatgaccagtgcctcagtgatgcggcacgcctgggaaagggcacccacagcctctctttccacacagcacacatgctgtgcactcacgcacagcagcacgtgcctgcatgcacacactcttagaagcctgcgtgagagagaacacgagccttcgttactccagacaccaaagcaagctctgagctgcatcatccctcaagtctgcagtttaggcatggctcagaggccccagccaaggcggccaaaacccagccatgtgttgctccttaagccatgtcttctgctgagagtctgcgtcagcccagaggaggggccctcggtctcccttgcctgccgggaggccctgtggttcctggtgtccagtgggctcagcgtcacgtcctggaaggagccactacccgcctactgccccactgcattccactccacacacatttggggatccagcgctctgtgcaaggcactccatgtcatcatgatgaaggaggaccagccggatccatctgctcccactcaaggggggaccacccttcaagagaccctcacccagcccatcagtgcccaagagaggcaggcatccaactgcaccatctccctctccttccccatgcagctccctctgaatgatgatcagtgaggccctgcaagacagcctcccgaggccgagccaccgagctacaggacgaagatgatctttctgggctcctgatgtccagaccctgtcttgtctttcagcatgttcagaatacctgtggctgctgtgggcagagaggaggtaccggggaagtcctggcagacttatctatcggcagagagactgagtctccatgccaccccaattccccctgcccttttgactgagctctgaacacaagttagaggagctgggggaaagctccaagcagtcaatacatcaaccagtgagcacgtgacatgtcctgtctcgtgctcagcgctggggaggacatccccacaaatatcacagctcaaattcactggttgggaaggcaagactcacaggcagagaagagtcaaaaaactattaaagaggcccctggcatagtctgaggagccctggatagaggtaagaccagagttctatccccaggcctcaggcctgaagcaggtccctgtacttccaaaagctccagctacaccaagttatagacaacttctcatggcctggattgtggatggcagtggc

SEQ ID NO: 460639 - DNA, 2369 bp, Homo sapiens
ctgacctcgtgatctgcccgcctcggcctcccaaagtgctggggttacaggcgtgagccaccgcgcccggccaagaatgactttgtaaatcagtgttgacattcaggacctttttcatttcgtgttaaagactgatcaccctgggaaaatcaaggcagtccagccaaaccccaactcccaatcaaatgcagtttgtatcgaaccccacgactgcccagcacctttgggaagcccattgctttctatgcagacgcagagctcccagaaagcacagttgaagagatgaaggcgcagaggcatgaactcccgtagccagagagtgtgagctggactctacctggagcagcctcggtgcagagcccatgcccccaaccatgtccgtggtcgaggcccagcccagacagggcacaaaggggctgaggaagaggaagtaagatgccagggttgccatgcaggagggcaaccccaagtgagatgggcatcgtggcctagggcccatcttccggaagagctcatcagaacttcggacacactgcatgggcctagacccagggctcgttgagctcctccctcggattggcttcgaattttaggtgaatcctctctagcagccacattcacccttgcaagcctgcactttgtcatcttctgaaaaggtgcaggaacatgatgcccagctgactcccagggagcgggagccccagaggccagcggagcacagccgcagcaggcagatctgttgggaaaccacgggagtataggagcagggctgggggcacctgagggactgtggagcctgaattattgaaacgcttagagtaaagcagatttagatttcacaaagacagaggtgaaggtgggtgaagacggagggaaggatttaaagggaaagagaaagaggaaagataagaatgaggggatcctctagaccgggagagagggagaaaggagagcgagctcggattgccatctgcctaggtgcagtgtggggcaggcggggagcggagctcggactgccgtctgcctaggtgcaacgtggggcaggcagggagcggacagcactcttcaaggctctagaacgctggtgggttcctggaccttgactctgtgtgacaggactgtgtatgcaacccagtgtcaagagcagaaatgcgcaaatgctgcctatgaccagtgcctcagtgatgcggcacgcctgggaaagggcacccacagcctctctttccacacagcacacatgctgtgcactcacgcacagcagcacgtgcctgcatgcacacactcttagaagcctgcgtgagagagaacacgagccttcgttactccagacaccaaagcaagctctgagctgcatcatccctcaagtctgcagtttaggcatggctcagaggccccagccaaggcggccaaaacccagccatgtgttgctccttaagccatgtcttctgctgagagtctgcgtcagcccagaggaggggccctcggtctcccttgcctgccgggaggccctgtggttcctggtgtccagtgggctcagcgtcacgtcctggaaggagccactacccgcctactgccccactgcattccactccacacacatttggggatccagcgctctgtgcaaggcactccatgtcatcatgatgaaggaggaccagccggatccatctgctcccactcaaggggggaccacccttcaagagaccctcacccagcccatcagtgcccaagagaggcaggcatccaactgcaccatctccctctccttccccatgcagctccctctgaatgatgatcagtgaggccctgcaagacagcctcccgaggccgagccaccgagctacaggacgaagatgatctttctgggctcctgatgtccagaccctgtcttgtctttcagcatgttcagaatacctgtggctgctgtgggcagagaggaggtaccggggaagtcctggcagacttatctatcggcagagagactgagtctccatgccaccccaattccccctgcccttttgactgagctctgaacacaagttagaggagctgggggaaagctccaagcagtcaatacatcaaccagtgagcacgtgacatgtcctgtctcgtgctcagcgctggggaggacatccccacaaatatcacagctcaaattcactggttgggaaggcaagactcacaggcagagaagagtcaaaaaactattaaagaggcccctggcatagtctgaggagccctggatagaggtaagaccagagttctatccccaggcctcaggcctgaagcaggtccctgtacttccaaaagctccagctacaccaagttatagacaacttctcatggcctggattgtggatggcagtggc

SEQ ID NO: 460640 - DNA, 1571 bp, Homo sapiens
gagaaaaatctgaaggagacgaaaatgtttcaggagaaagaagacaaggagcgcttggctgggctgaaaacgcaaggggaggataggacctttgccgagggcaggacgacttacagtgacacgaggaaggcacgagtgagggaagaagagattgtggtggacaggcctggggcctgcaaagctgacattctggtagcagcgtttggagtcacagaagggaagttattggaggtaaagaggcccatgggccctggcgggactcatggagagcctggaaagaagctctacctcatgaacaccaacctttgcatctggcacgctcctttttcaaaggcatgtcatagcgtccttttccagcgttgcctgaagacacaaactactgatggctgcatccacatgactgacttcaaacacagcacgctgcaggagaaaagccggatacgcgcgtggaaagtgggtggctccaccaccctgctgttcaggttttctttctgaaagttcttttggctttattatggaatagaggttacagaaaggcaaaagctttggccgtagcgggtgggaagatcttccttaccctggaggaggaagtagggtctccgtaatgtatgtgtggtactcagggctcccggcagcccgaagccagagtgtgtcctcaccctgccccgggtcagccctgtgacctggagggagcaactgaaaagctctgggcctcggattcctcatctgtgaaatggggatgctaacagtgctacctcctctggttggtttgtggcagaggacacatgaggcaacctgtgtaaaatgcttggagggtggccagtgtggttaccatggagattgactggtaccgtcttccacatcctgtgttgactaagcgcgcacaccagaatacagttccaaacgattatcaaacatgaatacaattcagaaaataaacatgcagcaaaacttgccataaagattgcatgaaactatcactttaagaaaaatacattaaaaattaccttaaataccgaaaagtacttttgtaagtaaggatcagtccaataaatttaacctgtatttgaatcagtgtaaaacaacttggtttataattttgtcttcatcgagtgggggtgacttttgtagcttctgtcactgctgcctggagtatagaattaaacacctttttgcagaaaaagcctccagctgttttttttttttttttttttttttttactctcagataatatggggtgatttttaaaagacctgagacacacaaaatgctaccttttgtaatgctttaggaggaggtcttcagaaagtatgaaccaaacgcaaaataaaagatttttttttttaaacgttataagcactgcacacggatgaactctgccaggctggtgggattctttctgattagatgactgaattttatttttggattttccccttttgctgtatcctttttatttcttaaaaaaggaaaaagggttagctgcctgctagtgcacagttctgccttttacagagaaatctgaaatccaggccagggagaaaaagatgcttttatccctccagtgttc

SEQ ID NO: 460641 - DNA, 6508 bp, Homo sapiens
ggtgtgagttctgacttggttggtttccacatgaaaggcgtgttactctctctaggaatcgggtaatcctgggaggggcagtcctgtcagtgtcaacaaggccttaagatgcctaaaatcaaaaatacttaataaaaagacgtgcttaatacatcattctaggcaacataaccaggagccaatgtctttcctctgtctttgcctttcagttgctaggatcattttcctttctcctcttcctcattaatgtgacagcctctgcagttaaactctgagctctgggtctaaccaattgcctcggcctaattttcacttctgggagttgttttggaaagaggtttctgttgaatatcttgaggcagagctgaattaaacagctctttggagtccaggtggcaaagaaccttggggaaagtggcagtcagtgactgaggaaaagacccctcctgttccagttactttaagccatcaaacatatgccgttgcctcccaggagaatgaggtcacatggcaggaattttaggagagccacatttattctttgaagaccatcttagaaacatttccagtgtcatgttggttcttttcatccaccctctccagtgctgtgcttgtcacagaatcttgccttgccagtgcacatttattcccatggaacctcttgttcttttacttgtagaaacttcagaagcaccatttttattttcttttctctctagaaagttcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtgaaaactggagcattttttgagctattccttgaatatgtgcttttttgtcttgaagaaatggtgtatcaattgattctgtcaccgtcaggttagaatgagcacttccatttaagaaatcctttcatgtcttcttctctttcacatgtaggacctggaacagtttgaaagatatacctccatgttgccaaaatagatccatggtgaaaaatacagggacagttgaggctattgtattaacttatttaatttagtttataaatctctagctgcataaatgatgtctgttcttttaaaacaaaagaaaaaggacaaattgttggtgttcagatttccgatttataaagaaaagataacttgtttttgtagaaatactcctaagaatgtcttaagtatatagcaattatgtatatatagtattaaatatatatattatacatgcttttaggttcacattcatctctaatttattttttaaatataaagcatggtttatcgtggaattgagcaatgttctaaactgaagaaatgttttggtgatttatgttttgctgattggcatttgagggtattgatatttttataataagcggtaatttatgtggcatgggatatatttgtgaattccaacagtacttttaaagtaccattttttgtttctgtgcctatttaaaacagtgcctctcttagaaggtgctattaatataagatgagggttcagttaatgcttcagtcttgattattctaagattaaagtgcattttggtcactgggacagtcaaagtcatacaggttattttaccgtttacaatcctataattattgcagtagttaacatcagcatgtacaaacattttcaccaaaacccaaactttatgagacacctgaccttttacagaactaggatatgtggaaaccacatttatcgtaatgtttttcttttccgtaagataatcgagcatggttaaataaggtctctatataatgaacacttaagataactgtatgggccttttcctttgtcggaatgaaacaaaatccacatgtgataacctatgtttggggtgggggctggtcacatgattccttgtcatgaaggctgctcttcactcttttgtacttgtgattaaaatctcacactaagtttactatttaacttaatcctttttctcaaattaaacctttttttatactgtcataccccaaacattgtcactttttaatgtaccagtctgctagaaatctacaagaatgatcccactatctttagtatgtaaggattacaccttagatatagaatagaatttgagactgccacacatttattcaggccttgttactttaagaaatatcttattttttccaccccaaaggagcaagtgaaccaattattgctgacataataggttcccttcctccataaaaggattatcagccatgatcattaacattaaaccaaatagatggagccaaaaagagataaaagtagcttcttaggccctattaaatcagggaaagactagaagaaaatttacattgcttctcttttttaatggccagcggggtatgtgtgtgatgtatactcagagtggttttttggaaaattaaactgtagctatagatgatgctttggttttcttaatctcaagaaaagagaagcaatggaaatacagaatgattaactggggaagaggacttttgtaagtgtgactagaacaatggtaatgtatgggccaatgggaagatttataagtcagattatttttgaaaactatttttaaaagcaagaagactacactttccctaccaaaacagaagtaacatggacacacttaagttttggctcaataaatatcaatgttatttaacttagatcattgaaagaatactcatgtaaagataatgtttattatcatgctcttaacagtcattatctttaattttttaaatgagaagcattaatactagaagagaatttctggttatccggtcaccatattcactttccaccccacattcttcagctaaacgcaaagagaagcagtgaaacagccttacccgcttctctcttattaaagaatcactgatgtttttactcaatgaaaggtaaagtaatacccttagccatttattaaacaattcaaccaagagacctcaaagtgtgattgatgataagaataatcaatgccttttcccttccaacatacttgagcagtcatgacaacctaaaaatatcattggttgctttcccattaaaaccaacgttccctgtgggtcttaattctttattttcactcatttggtgctttccaagtcatcttttctttaaagtgcccttcctccaaactttaaaaagtacttccttgacaaaatttctattcattataaaacatttcaatattttaagcttaaattttgcttttgctgaaagcctaccatttggcgtgttaagtatgaaatatagtgcagacttttatcttggttttaagtggggctcaataaaaaacaccagccacttttgtaataatggcatcacagtgtcatcatgtatgcaagcaataaaactctttagggtatggttttatactgaaaatttaatatgaaggccccttcccacaagaatatagataattattaactttctagatgtgatacggtaattcgaattgcagagtataaggaagggaaatgggaaggggcatcattccttggattttaaataacaagaacatttttactttaacaaagaaaatggatagaaaaagcacattttgttttccctgaagtttaatttgacatcaggtttgtgtacttatcttcactaggtgacttaacttaccccaatttttttaaaaattattaaactttttacagaaactaaccttttaaatgtaccctttccccatatatatatacgcacacgtttggattttttttttttaagaacacttgttctagttataaatatataaagaaaacgataaagtttgtggtactgcagggttgttaaagattctttgatgccttctaaaaacttttgtcaaaaatacttttgagttcacaattctgttttacttttccttgtccttactttttggaaacagggtggttgcttttatttgttttctggttatattcaaagccttaagttcttaatctgagcatattgtctgtgataaatttctgatgatctttctggactagatacaacctgagtagcaagcaccaaccggagcaagtaaacttctagggaacaagcgtcttgggttttataggtatctttgctataatgcagaatagattaatgaagatttcctatatcatatgatatttgtgttagtgggtctaagattaagcacatgatatttataagctaaaattaactcaaaagtcaagaatgtcttaatgttttcattcttaaattttgtattctccaagaatgtattagtatatgaactgtggccaaccagttcctattcttcagactgtattgacatctgtagtggatcatgttgcttcttcattcttaccaattttattagaatcaaacttcttgttatttgcatactattatctactatagattctcagctttagaaaatgactatgatacataaagaccactaggtcaacttaaaaaaccctttctgtgaatttatacatgtatgtatatatgtaaaaacactgttgatttgcaattctgtctttccatagaaatgaactttttctatcgaaattgtttaacttaaatattttaacataaattatttacatggatctttatgtataattcatccttatatataccccttaatcacgtagtcatgagaagataactttgctttctttacagaaagggcagagaggaataagataagaaactgaaacaagcaagaatgaagagagatgtgggggagagactgctggtctccagaccacagcaatgtgttttaagataagatgaaatattttaactgcagaagggatataaaatctatgtaattacatgctgatgggatccattgcacccaggtttttgaccttggcctgtaaatgctagactatgatatcttgttattctttttctcctttgggcttttaaaaaataatttcattctcagatcattttctgtactgtttactgaggcaaaaaaaaaaaaaatctgaagtcaatcatggtcttctactttctggactgagcatttggcagaatgcagtatcttttcctgtattttgacatgaaatagcacatggcttctacaagatagttttaacttgttggggtcaccgggagttatatgatggtcaaccccttttcccaaaattcattgtggtagttttagtggaaaacgtaaatcaagaaatctcatatcatactttaataaataaataccaaatacatagtgacatataggtttgggaagaaactagtctgtggggaccattataagagaatcacattatatattacacagtatatggatattggaatgtatcacttgtggggggttctcttcattagcaaaacagtcatgtctgtctgtatataagacttttttttttttaaccaaactagcatttcattttgtgagtgacaattgacattttaaaataagcat

SEQ ID NO: 460642 - DNA, 829 bp, Homo sapiens
ggatcaacacagtggctgaacactgggaaggaactggtacttggagtctggacatctgaaacttggtgaaattcatcttagcttctgggattggctcctactcaacatgcaagcactaatcctctaacatgcagagacagagtctcactctgttgccaggctggagtgcaatgatgccatctcgactcgccgcaacctccacctcccgggttccagtgattttcctgcatcagcctcccaagtagctgggactacaggcacgtgccaccacgcccagctaatttttgtatttttagtggggacagagtttcaccatgttggccaagatggtcttgatctcttgaccttgtgatccacccacctcagcttcccaaagtgctgggattacaggcatgagccactgcgcccagcccatacataagaattttaagtccagcatgctaccataatataaaaaacatctaggaaagagaatcagatattttcgttgagtgcttacaatgtatgaatcctttagcatcattatctcatttaatttgcaagcaatttttaagataggcatcatggaacacctacaacatgcaaagcagttttcattcatgacttcatttaatcttcccaatgaatttatgaagaaagtattattttggcaaatacacacatgacaacactaaaactcaaattagagaattttctaaagatcaaacaagtttaaagtgccaaatttaggattccaactatttctctgtgtcaggcctttgagcccaagctaagccatcatatcccctgtgacctgcacgtacacatccagatggccagttcctgcctt

SEQ ID NO: 460643 - DNA, 1407 bp, Homo sapiens
taaagtcccttttggctaagaacgggtttgacaccacgggctatgctgttcgtattcatcagccttgttctctttgctgcaccaatcaatttcttggttgctgtctctgtttcacttttaggggcacttttgggtggagcagagcctccttctgtcagctctgaaggttcagatgtgttggtcctttctcccttcagcccacctgaatgttctattggaaacccattgtcccctattccttacccatctagtcccacactatacccaccactccctgaggaactcagcccagcaagtactacttgtagtggagcctcctatcaacctccaaagggaaacctttgtccacttagagaggtgacaaatggggaagaagtcactgtgagagtacatgttcccttttctatgtctgatttggctgtatataaagaggagtttggtcatttctctgaagacccgggaaaattcatagataagtttgagaaattaactctgacgtatagtttaacttggcaggatctgcatgttttattgtctctgtgttgtacagtggaagagaaacaacacattttgggggcagctaggacccatgcacacgaggtattggcttgcaacccaaaccatgatatatatcaggcaggaggtgaaattcatcttagcttctgggattggctcctactcaacatgcaagcactaatcctctaacatgcagagacagagtctcactctgttgccaggctggagtgcaatgatgccatctcgactcgccgcaacctccacctcccgggttccagtgattttcctgcatcagcctcccaagtagctgggactacaggcacgtgccaccacgcccagctaatttttgtatttttagtggggacagagtttcaccatgttggccaagatggtcttgatctcttgaccttgtgatccacccacctcagcttcccaaagtgctgggattacaggcatgagccactgcgcccagcccatacataagaattttaagtccagcatgctaccataatataaaaaacatctaggaaagagaatcagatattttcgttgagtgcttacaatgtatgaatcctttagcatcattatctcatttaatttgcaagcaatttttaagataggcatcatggaacacctacaacatgcaaagcagttttcattcatgacttcatttaatcttcccaatgaatttatgaagaaagtattattttggcaaatacacacatgacaacactaaaactcaaattagagaattttctaaagatcaaacaagtttaaagtgccaaatttaggattccaactatttctctgtgtcaggcctttgagcccaagctaagccatcatatcccctgtgacctgcacgtacacatccagatggccagttcctgcctt

SEQ ID NO: 460644 - DNA, 6357 bp, Homo sapiens
agtagacacctccagcggggccgtcctacccaaggggcactgtggggactgtctgcagccaccccagctcatacctctctgcctccccgctctcaaggagggtctgccgcatgtgatgaaagtgtctactctcagggaaagctcagccatggcttccccactgccccgggagatggaggaggagctggtgcctactggctctgagccaggtgacactcgggccaaaccccctgtcaagcccaaaccccgggccctgcctgccaagccagccctgcctgccaaacccagcctgctggtgcctgttgggcctcggcctccccggggtcccctggctgagttgccttctgccaggaagatgaacatgctggcaggaccccagccctatggtggcagcaagcgcccccttccctttgcaccaaggcctgcggttgaggcctccactggaggagaagccacccaagagactgggaaagaggaggctgggaaagaggagccaccccctttgacacccccagctcgatgtgcagccccagggggtgtacggaaggcccctgcccctttccgcccagcctcagagcgcttcgcggccaccacggtggaagagatcctggccaagatggagcagcctcggaaggaggtccttgccagccccgaccgcctgtggggttcccgcctcacctttaaccacgatggcagctcgcgatatggccccaggacctatggcacgaccactgctcccagggatgaggatggcagcaccctcttcaggggatggtcccaggaggggccagtaaagtctccagcagagtgccgggaagagcacagcaagacccctgaggagaggagccttccttccgacctggccttcaacggggacctggctaaggcagccagctcggagctacctgctgatatttccaagccctggattccctcaagtccagccccctcctcagagaatggaggccctgccagcccaggcctccccgcagaagcctcaggctcaggccctggctctccccatcttcacccgcctgataagagttctccctgccactcacagcttctggaagcccagactcctgaagcttcccaggcttctccctgccccgctgtgactccatcagctccaagtgcagccctgcctgacgagggctcccgccacacccccagcccggggctccctgccgagggggctccagaggcccccagacccagcagcccaccccctgaggtcttggagccccatagcctggatcagccccctgccacctcaccccggcccctgatcgaggtgggtgagttgctggatctcactcggacgtttccatctggcggggaggaggaggccaagggtgacgcacacctccgccccaccagcctggttcagcgccgattctctgaaggtgtgctccagtcacccagtcaggaccaggagaagctggggggctcgctggctgccctgccccaaggccaggggagccagttggccctggatcgtccctttggggcagagtccaactggagcttatcacagtccttcgaatggaccttccccacgaggccctcgggtctgggcgtgtggcggctggactccccgcctccctcccccatcactgaagccagtgaggccgccgaggctgctgaggctggcaacttggccgtttccagcagggaagaaggagtgtctcagcaggggcaaggggctgggtcagctccaagtgggtcaggaagttcctgggtgcagggggatgatccaagcatgtccctcacccagaagggcgatggggagagtcaacctcaattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccagggagctgggggttggtgagacaagtgggccagagacccagggtgaagattactcctcgtcttccttggagccacaccctgcagaccctggaatggagacaggagaagccctcagcttcggagcaagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccatgtatcggagccgtgccaacttggggcgcaagcgtgggcaccgggccccggtcattcggcctgggggtaccttgggcctgtcggaggcagcagactcggatgcacacctgttccaggactctacagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattcctgtggggtccctgggtgaggagacggctggagccccaccatgccccaggctgcagcctctgtcccctccacctctgaggagcgtctggggaggcacatttatgcactttgtatcaccctccgaactccccccacaccttcccttccctggatttcatcactagtggttgaaggttttgtcccttcctctcctccttccctctccctctctgcttcctcctccagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaattggtgctgtccaggtggtggtacgtggtcatggctgcccatttcctcttccaaggctgtggttggaaaatgctgattcccactctgccccaccaggggctcactctgacactggatgtgtcacttcccttttactgacatcactgagaagggtatattgtttacaataggctgatcaagaattcagacaccctctaaatcttagtagtttaacacaaaaaggtttatatttcatccatgacacagtccagggtgggctggtgataggggcactctgcaccttgatgtcattgagagcccaggctctttccctgttgtggctcggccatcttcagggcttggagtcttctgccccatctaatggagaaagggggaatcttttgtgggagatactctgagtccattcaggctgctgtaacaaaatactgtagacttggatggcttataaacaacagacgcctatttctcacagttctggaggccaggaagctgaagaacaaagcactgacagattcagtgtctgatcaactactagcattttgaaagccaatactcttttttagaatagatttagatttacagaaaagctgaaatgatggt

SEQ ID NO: 460645 - DNA, 5543 bp, Homo sapiens
tcctcgcgcttgggcagtgggaagtccaggggtttgtcgttctggtgacttcccccacctggctcagccctgcttcctgcatgtctccttcccttccaataaggctaacaaaactttccctagctaagccgacctttccctcccgccttgggcccttggccacctgctgggacggtgaatgggagagtctcagaattgaaccttgaaaacttgctgggggcaccagacagaagagaagggaggagggcaccttgctgcttgtgattgtggaatcaagggctccagctgaagctgaaaggggacttagcaatggggacctcatgccatgttgttttataaattcagtcccaaaaattcaaggtctcttttgctgttaaggtgacactatattaagaaatgtcgatttattgaagagtcagagaagtgaagaggtcagaaaggtaccactagagttggcaaaagccacaggcatgaatttgtaaatgctgctggctttcagcaggctgaagccatcctctcttgtgactgatgggggttcagagctcctcaggccttactcttcttttgtaaaatccagcccagagccatctcctagtattcatagcctgttttctggagcctggacttctgccagagtgtcacctcttaccggcagccccaacacctctcccttgttgaacatcctgtggcagcttcccccagaaccgggaaggaggaccactctctgtggcaccctggactacctgcccccgccccccgcccaagatgattggaggtcagatgcatggtgagaagaaagctccacatcaataaacatgacactctgaagtgaaagtagccacaagaattgtgctacttatactggttcgtaatctggaggcaaggttccgctgcagctgccccctcagcctgggccaggcatggtttcttcccaggagacaaatccagagtgtggctgtggggaaagtgaccactttgccctgactcgatcggttaaggagctgtgcaataaccttcccagtacctgattattacacctgacctgacacctcacccccctccccgcttattacacctgaccagggacaaaagttttcagaatcacagactctctagaaccccactgtgtgttagttttattctttgtcttcaaactacccacatttaaatacaaagatacctcatagaagtgagtgatgtggtgctcggctgcagtggacatcatgtttctgttagatgggtctaacagcgtcgggaaagggagctttgaaaggtccaagcactttgccatcacagtctgtgacggtctggacatcagccccgagaggatcctcatcatcgtcactgatgggaagtcccagggggatgtggcactgccatccaagcagctgaaggaaaggggtgtcactgtgtttgctgtgggggtcaggtttcccaggtgggaggagctgcatgcactggccagcgagcctagagggcagcacgtgctgttggctgagcaggtggaggatgccaccaacggcctcttcagcaccctcagcagctcggccatctgctccagcgccacgccagactgcagggtcgaggctcacccctgtgagcacaggacgctggagatggtccgggagttcgctggcaatgccccatgctggagaggatcgcggcggacccttgcggtgctggctgcacactgtcccttctacagggaagaccctgccctagaggagcacctgattggcctgcccctgtgtgggcagcccagggtgaggccatcccaggagctgctgccaacccagagtggggctttctgcccccagatgaggaaccgctcctgtgacagcagggcacatggccccggagacgcaggagaggcgaggcggttaatgggcatctctctgataggcccctgtgactcgcagccctgccagaatggaggcacatgtgttccagaaggactggacggctaccagtgcctctgcccgctggcctttggaggggaggctaactgtggtagtttctctgcaccatctccctcctgggagatgttcggcatctcgggtgggacagctcgcatgccgcatgaccatggcttgacagtgggtgttgctgtgatccccgcagccctgaagctgagcctggaatgcagggtcgacctcctcttcctgctggacagctctgcgggcaccactctggacggcttcctgcgggccaaagtcttcgtgaagcggtttgtgcgggccgtgctgagcgaggactctcgggcccgagtgggtgtggccacatacagcagggagctgctggtggcggtgcctgtgggggagtaccaggatgtgcctgacctggtctggagcctcgatggcattcccttccgtggtggccccaccctgacgggcagtgccttgcggcaggcggcagagcgtggcttcgggagcgccaccaggacaggccaggaccggccacgtagagtggtggttttgctcactgagtcacactccgaggatgaggttgcgggcccagcgcgtcacgcaagggcgcgagagctgctcctgctgggtgtaggcagtgaggccgtgcgggcagagctggaggagatcacaggcagcccaaagcatgtgatggtctactcggatcctcaggatctgttcaaccaaatccctgagctgcaggggaagctgtgcagccggcagcggccagggtgccggacacaagccctggacctcgtcttcatgttggacacctctgcctcagtagggcccgagaattttgctcagatgcagagctttgtgagaagctgtgccctccagtttgaggtgaaccctgacgtgacacaggtcggcctggtggtgtatggcagccaggtgcagactgccttcgggctggacaccaaacccacccgggctgcgatgctgcgggccattagccaggccccctacctaggtggggtgggctcagccggcaccgccctgctgcacatctatgacaaagtgatgaccgtccagaggggtgcccggcctggtgtccccaaagctgtggtggtgctcacaggcgggagaggcgcagaggatgcagccgttcctgcccagaagctgaggaacaatggcatctctgtcttggtcgtgggcgtggggcctgtcctaagtgagggtctgcggaggcttgcaggtccccgggattccctgatccacgtggcagcttacgccgacctgcggtaccaccaggacgtgctcattgagtggctgtgtggagaagccaagcagccagtcaacctctgcaaacccagcccgtgcatgaatgagggcagctgcgtcctgcagaatgggagctaccgctgcaagtgtcgggatggctgggagggcccccactgcgagaaccgattcttgagacgcccctgaggcacatggctcccgtgcaggagggcagcagccgtacccctcccagcaactacagagaaggcctgggcactgaaatggtgcctaccttctggaatgtctgtgccccaggtccttagaatgtctgcttcccgccgtggccaggaccactattctcactgagggaggaggatgtcccaactgcagccatgctgcttagagacaagaaagcagctgatgtcacccacaaacgatgttgttgaaaagttttgatgtgtaagtaaatacccactttctgtacctgctgtgccttgttgaggctatgtcatctgccacctttcccttgaggataaacaaggggtcctgaagacttaaatttagcggcctgacgttcctttgcacacaatcaatgctcgccagaatgttgttgacacagtaatgcccagcagaggcctttactagagcatcctttggacggcgaaggccacggcctttcaagatggaaagcagcagcttttccacttccccagagacattctggatgcatttgcattgagtctgaaagggggcttgagggacgtttgtgacttctggcgactgccttttgtgtgtggaagagacttggaaaggtctcagactgaaatgtgaccaattaaccagcttgtttgatgatgggggaggggctgagtgtgcaatgggcccaggtctggaggggccacgtaaaatcgttctgagtcgtgagcagtgtccacctgaagggtcttcctttcaaaagaggctgcggccagagactgtggctcatgcctgtaatcccagcactttggaggctgaggcaggtggatcacccgaggtcaggagtttgagaccagcctggccaacgtggtgaaagtttgtctttactaaaaatacaaaagcaaactgtgggctctcgacttacatagtaagggcctttactgtttctttgtaggaaatgggtttctcgcctttgaaacattttttccccttttgtagtgacagtgccactaaatagttcagcttttgtcagtcccccaggaaagtgctatcctatggcctaactagccaagccttttttctttcatttaaaagaaattagctttaatttttacctttaattacttattcaaataagacagaaatatattttccttgcaataattaaaacattgcatataggccataaatttccttattttctctgaacgatcctgattccagtcatcttgttgaataccctagttctaataattgactcttgcttttctagagaaatatttccaaatgatgctagttttgtctcttcctttcaaagttgtataccacttctttttcttgtcattttgcattgcctgggacctccagaataatgtttcatgaagtagcatgtatccatatctggttcttgactttttcatcataataattgttttctatgggttacttatcagtttaagaatgcttaattcctagatgaactaagagtgtttattacatgttgagatttatggtatgctttttcttcctcaagataatgcattttttgtattatctgttaatgtgataggttatccatttgtgtattttcaatcattgaacaacccttgatttttttggataaactctatttggtcattatgcatcattctataaaccctgctgaatttttcatttgccaacatcttatttcagattcttttaatctgtgtccaacaatgagatttgttttcttttgcaatttgttttgaatttttggtatcagagctatactaaccttataatggaaaatacatatttctcaaacttttacactgatatattcatagtatttttttataatttgaaaaatcttgtcagtatctgtattaaggcctccatttcagttctgctatttcatattgccttaggttgtctatttgtctctttaatgaacccgattttgattttgtcatttttaaaataaacacatttatgctataaacttccttaattactacttaggcaaccttcccagtattggtatgtttcttttttcccaagaattctttaggagtatatttaacttctgggaggagtactgatttttcattcacttatatatgatcaatttctgcagatgtttcctgtgtctttggtatgttgttaactgtacaactaaaa

SEQ ID NO: 460646 - DNA, 5464 bp, Homo sapiens
ttgaggatccccgcgttaatccgagctaacaaaactttccctagctaagccgacctttccctcccgccttgggcccttggccacctgctgggacggtgaatgggagagtctcagaattgaaccttgaaaacttgctgggggcaccagacagaagagaagggaggagggcaccttgctgcttgtgattgtggaatcaagggctccagctgaagctgaaaggggacttagcaatggggacctcatgccatgttgttttataaattcagtcccaaaaattcaaggtctcttttgctgttaaggtgacactatattaagaaatgtcgatttattgaagagtcagagaagtgaagaggtcagaaaggtaccactagagttggcaaaagccacaggcatgaatttgtaaatgctgctggctttcagcaggctgaagccatcctctcttgtgactgatgggggttcagagctcctcaggccttactcttcttttgtaaaatccagcccagagccatctcctagtattcatagcctgttttctggagcctggacttctgccagagtgtcacctcttaccggcagccccaacacctctcccttgttgaacatcctgtggcagcttcccccagaaccgggaaggaggaccactctctgtggcaccctggactacctgcccccgccccccgcccaagatgattggaggtcagatgcatggtgagaagaaagctccacatcaataaacatgacactctgaagtgaaagtagccacaagaattgtgctacttatactggttcgtaatctggaggcaaggttccgctgcagctgccccctcagcctgggccaggcatggtttcttcccaggagacaaatccagagtgtggctgtggggaaagtgaccactttgccctgactcgatcggttaaggagctgtgcaataaccttcccagtacctgattattacacctgacctgacacctcacccccctccccgcttattacacctgaccagggacaaaagttttcagaatcacagactctctagaaccccactgtgtgttagttttattctttgtcttcaaactacccacatttaaatacaaagatacctcatagaagtgagtgatgtggtgctcggctgcagtggacatcatgtttctgttagatgggtctaacagcgtcgggaaagggagctttgaaaggtccaagcactttgccatcacagtctgtgacggtctggacatcagccccgagaggatcctcatcatcgtcactgatgggaagtcccagggggatgtggcactgccatccaagcagctgaaggaaaggggtgtcactgtgtttgctgtgggggtcaggtttcccaggtgggaggagctgcatgcactggccagcgagcctagagggcagcacgtgctgttggctgagcaggtggaggatgccaccaacggcctcttcagcaccctcagcagctcggccatctgctccagcgccacgccagactgcagggtcgaggctcacccctgtgagcacaggacgctggagatggtccgggagttcgctggcaatgccccatgctggagaggatcgcggcggacccttgcggtgctggctgcacactgtcccttctacagggaagaccctgccctagaggagcacctgattggcctgcccctgtgtgggcagcccagggtgaggccatcccaggagctgctgccaacccagagtggggctttctgcccccagatgaggaaccgctcctgtgacagcagggcacatggccccggagacgcaggagaggcgaggcggttaatgggcatctctctgataggcccctgtgactcgcagccctgccagaatggaggcacatgtgttccagaaggactggacggctaccagtgcctctgcccgctggcctttggaggggaggctaactgtggtagtttctctgcaccatctccctcctgggagatgttcggcatctcgggtgggacagctcgcatgccgcatgaccatggcttgacagtgggtgttgctgtgatccccgcagccctgaagctgagcctggaatgcagggtcgacctcctcttcctgctggacagctctgcgggcaccactctggacggcttcctgcgggccaaagtcttcgtgaagcggtttgtgcgggccgtgctgagcgaggactctcgggcccgagtgggtgtggccacatacagcagggagctgctggtggcggtgcctgtgggggagtaccaggatgtgcctgacctggtctggagcctcgatggcattcccttccgtggtggccccaccctgacgggcagtgccttgcggcaggcggcagagcgtggcttcgggagcgccaccaggacaggccaggaccggccacgtagagtggtggttttgctcactgagtcacactccgaggatgaggttgcgggcccagcgcgtcacgcaagggcgcgagagctgctcctgctgggtgtaggcagtgaggccgtgcgggcagagctggaggagatcacaggcagcccaaagcatgtgatggtctactcggatcctcaggatctgttcaaccaaatccctgagctgcaggggaagctgtgcagccggcagcggccagggtgccggacacaagccctggacctcgtcttcatgttggacacctctgcctcagtagggcccgagaattttgctcagatgcagagctttgtgagaagctgtgccctccagtttgaggtgaaccctgacgtgacacaggtcggcctggtggtgtatggcagccaggtgcagactgccttcgggctggacaccaaacccacccgggctgcgatgctgcgggccattagccaggccccctacctaggtggggtgggctcagccggcaccgccctgctgcacatctatgacaaagtgatgaccgtccagaggggtgcccggcctggtgtccccaaagctgtggtggtgctcacaggcgggagaggcgcagaggatgcagccgttcctgcccagaagctgaggaacaatggcatctctgtcttggtcgtgggcgtggggcctgtcctaagtgagggtctgcggaggcttgcaggtccccgggattccctgatccacgtggcagcttacgccgacctgcggtaccaccaggacgtgctcattgagtggctgtgtggagaagccaagcagccagtcaacctctgcaaacccagcccgtgcatgaatgagggcagctgcgtcctgcagaatgggagctaccgctgcaagtgtcgggatggctgggagggcccccactgcgagaaccgattcttgagacgcccctgaggcacatggctcccgtgcaggagggcagcagccgtacccctcccagcaactacagagaaggcctgggcactgaaatggtgcctaccttctggaatgtctgtgccccaggtccttagaatgtctgcttcccgccgtggccaggaccactattctcactgagggaggaggatgtcccaactgcagccatgctgcttagagacaagaaagcagctgatgtcacccacaaacgatgttgttgaaaagttttgatgtgtaagtaaatacccactttctgtacctgctgtgccttgttgaggctatgtcatctgccacctttcccttgaggataaacaaggggtcctgaagacttaaatttagcggcctgacgttcctttgcacacaatcaatgctcgccagaatgttgttgacacagtaatgcccagcagaggcctttactagagcatcctttggacggcgaaggccacggcctttcaagatggaaagcagcagcttttccacttccccagagacattctggatgcatttgcattgagtctgaaagggggcttgagggacgtttgtgacttctggcgactgccttttgtgtgtggaagagacttggaaaggtctcagactgaaatgtgaccaattaaccagcttgtttgatgatgggggaggggctgagtgtgcaatgggcccaggtctggaggggccacgtaaaatcgttctgagtcgtgagcagtgtccacctgaagggtcttcctttcaaaagaggctgcggccagagactgtggctcatgcctgtaatcccagcactttggaggctgaggcaggtggatcacccgaggtcaggagtttgagaccagcctggccaacgtggtgaaagtttgtctttactaaaaatacaaaagcaaactgtgggctctcgacttacatagtaagggcctttactgtttctttgtaggaaatgggtttctcgcctttgaaacattttttccccttttgtagtgacagtgccactaaatagttcagcttttgtcagtcccccaggaaagtgctatcctatggcctaactagccaagccttttttctttcatttaaaagaaattagctttaatttttacctttaattacttattcaaataagacagaaatatattttccttgcaataattaaaacattgcatataggccataaatttccttattttctctgaacgatcctgattccagtcatcttgttgaataccctagttctaataattgactcttgcttttctagagaaatatttccaaatgatgctagttttgtctcttcctttcaaagttgtataccacttctttttcttgtcattttgcattgcctgggacctccagaataatgtttcatgaagtagcatgtatccatatctggttcttgactttttcatcataataattgttttctatgggttacttatcagtttaagaatgcttaattcctagatgaactaagagtgtttattacatgttgagatttatggtatgctttttcttcctcaagataatgcattttttgtattatctgttaatgtgataggttatccatttgtgtattttcaatcattgaacaacccttgatttttttggataaactctatttggtcattatgcatcattctataaaccctgctgaatttttcatttgccaacatcttatttcagattcttttaatctgtgtccaacaatgagatttgttttcttttgcaatttgttttgaatttttggtatcagagctatactaaccttataatggaaaatacatatttctcaaacttttacactgatatattcatagtatttttttataatttgaaaaatcttgtcagtatctgtattaaggcctccatttcagttctgctatttcatattgccttaggttgtctatttgtctctttaatgaacccgattttgattttgtcatttttaaaataaacacatttatgctataaacttccttaattactacttaggcaaccttcccagtattggtatgtttcttttttcccaagaattctttaggagtatatttaacttctgggaggagtactgatttttcattcacttatatatgatcaatttctgcagatgtttcctgtgtctttggtatgttgttaactgtacaactaaaa

SEQ ID NO: 460647 - DNA, 4377 bp, Homo sapiens
ggattagagagaaaaatgtggtcagcgcttaatatggagggcacagtgggtgtgctgctttctcttttccatccctctgtcaacttcattctcttttgggggcaaacaagactcagatctaaacagagtttatggtttgttttgcattttgtatttattaatatttatgccgactttgaaggtgctgaccagaaggcatcagtaacacacacacgcacacgcacacacaccacacaccatgtctgtttggtttgattctgagcctgagatcctggaaatatttcagctgttgttaagaggctggagttaggacccaggaaggacacagcagtggggatataaatagaaaaggagaacagaacaaagtttgaggagagagacttacatcactcactccccctccacccagagagcaggacggaggtgtgaacttgagccagaccagaaggagctcgagagcggccgcaggacaagcccgaggagcaggcgggcgctccaggggaaaaccacgcacaaaaccttcttcagagaaaagggaagctccaaacctgactgagacaaacggaggctcttgaaataaaaagaaaataccgcaggacaaacagcctcccgtccccgggcgcaggtcgcggtcacagtggtgacctgggattgctttcccaggactgcgagtcgggtttgggtttctcctccctgcattccacagctgctctggtcatcgcaacgtgtttattgatcactgaagaatctcaagttttgagacgaggaagaaacacccattaggtctccaagacagctgtgtttcacaaactttaaggagacagaaattttctcccctggaacctgtgaaaatgtcccttttccaaggaagtgaaggttaagaggtcccgttctcacagaccctcaggaatttcacttggctccgagctttgacctccgagagagccatggaaaagctgctgcggctgtgctgctggtactcctggctgctgctattttattacaactttcaggtgcgtggcgtctactccagatcgcaggaccatccaggatttcaggtgttggcgtctgcttcccattactggccactggagaatgtggatgggatccatgaacttcaggatacaactggagcgtcccgaacccacaagctcactgtgcttccttcccgtaatgctacttttgtgtattccaatgattctgcctactcaaatctctctgcaactgtagatattgtggaagggaaggtcaacaaaggcatttacctgaaagaggaaaagggagtcacgcttctctattacggcaggtacaacagctcctgcatcagcaagccagagcagtgtggccctgaagatttccagtttttcttgataaatctctcctgacttctctggctggctggagctaagtcgcggtggccctggacttccgtctccagttcccctcagtccccaccagacttctcgactcttcaataatcttcaggtcgaacagagcctgtccgcagcatgagctctggggccagaaggcgtgggttccacttccggttccgacctgtttgtggggatcttgggcaaccactgcttccctttgaaaagcctcatctgtaaaagcctctctgctgcttgtctgcctgccttcattctaggagctactgtgggtcctgtcttttggcaaatggtgccttctggggacatgttcttaaggtcacttgctgctaatggggcaagctttggaggacattggagagaaaaaggctgtttggatccctggccattcttgaatgttaagcttagaaaacacagtctgttccctcaatactcaggattctgtctttcaactcccctgaccagtgagcacacagggtttgctgcaccttcacttgaatactgaacaagggccattcacgactcctagagaaatcatttcccctacattgaacctatagtcaatactgactggacactcaagcatgttgctaggaggtagatctcatgtgaagtctgtgaccataataaagttaaatgaaagggaactgattgcataaaatccaaaaaaggtcatttccagcatcaaggtgcagattattaggtaattcttccttgcttactctcatttctacctctgatttattgctgtgtcggttaagatgatgttatttgatataacaagtaaaaacacagacaacggcagaaaaagaagcccattccgctattggactcctctgacttttagtgtgttatttctgatattgggctaaattccgtctcgagtaacttcggcccattgcttctagttccagctctcctgtgaatggctttggcagctcctgggaaaggcagcctccccgattagcccctcagcttcaccttcctccctctgtgaatgtttcctttgctttttcctcacatgcattaagaacttcttctgcttataaaccccagagaggctgctgaggtcccgaggcagcagctggagcatctccgcacggccatttccctcttctcagctttgagttgactttttccccctttgcatttgtttcctaaatttaaaacgctgtcaacaatttgctaagatacttgcaggtggagttttaggatagaaatttccagaggggcctgggggacacgggcctggcagggatctagctactctcttactcaggcgatctggggggtaaggagtgactgccccttaaggcagggccagcattttccagttttcctcagcctgcaggactctctgctgtctgtcgctgtgactgaaggtggtggccattccccaggatggcctgcgtgtggctttgttagaggagcagggaaaggggaaagggaagaatttcttattcccatggggaaagtgggtgtcctacagccccagtcatttcaggaagcgattagagtggggctttggggtgggggtgtggagtgagaattttaaaggctcgatatgcaaacgagtgtctcctcctggccacaccaggcacagggcccatgaggcagccgggaaacgggctctgagtcttgcgtgaaagcgtatgggacgcgcatcctcgtggctctttgggaaacgtggtgggccacaggctggtccgggtgccagaacggccatcagaccctgtccctgccttgctccagctctgttctcaaggctgctttcctggtgtgggagcagcatccgctcagaagctccaagttctggttttgtcagatttttccttgttgtattgatggcccaactccatgaggcaaagttccttaaaaggctaatatggaaggcacattgtgaatttgttatgactctatgaagacgtgaattgatacttaaatataagctgttgctcaggtagaagtcattgttttgtgcgttgagttaactaaatgaaaagcttggttaccggcaccatggatggccttcgatctacccttacctaacaccacatggaatttttttatttttatttttcttcctgaacagaaagacatttggccaagacaggctcattttgaattgagtgaaagaaattttaaaatgcagcaaagtttttggaaaaaattaacttccatgaatcctactgggaatttgtttcataacaaaaatttcacaacgcactgtgctgacttccttgtgaaacgggttgtttctgagtgtgcagggaagtggcgggaggcttgggggtttgtcctggcttctgtacccctcagcgcccaaggcagggaagtggcgggaggctcggggggttgtcctggcttctgtacccctcagcgcccaaggcaggtgttgcaggaagcccgttcatgaggtgggtgtgggtggtgccagccaggtctggggacaccagcgtcagctgccccaggcctctgtgcaacccccacagtcgcacccttttgcggtaacccacattactgggcactcgggaaggctgttttctttcccaggagccctaaggacagatgccgcagggcttggagttgtaccccgtagcctctcagaggtccagaaaggtccaggcctcttccaatttttttgaggttcttcttctcttaaaaaataaaatggggaaattccataccagggttataaaatgtatgctgtgtttttcctgaatcctgcgagggctttgaactcacaaaggtatagttgtcttgatatattgtcacaagacatttgaaggacttctaacagatatgttaattcataaggcatcacagaaagcatggtgggcaatgagacactgccttatacacgaatgacaaatgtcttctttgaattcagtgactctctaagactgtgtccataacctcatgtgaaattcagtgactctctaagactgtgtccataacctcatgtgaaggtaaggtctaaagtctaaat

SEQ ID NO: 460648 - DNA, 1419 bp, Homo sapiens
ggacctgtctcggcctttgccccagcctgaccgtcaccatggctcgtgggcgctattcaaggtgtttctgcccccagggagaaggctctggccctcacagggaaccagggcatcgaggctgcgatggactggctgatggagcacgaagacgaccccgatgtggacgagcctttagagactccccttgtgacatatcctgggacggtgagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctccacccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaacctgagttctgtacatgcctgactccttcgatgggatggtgggcgagctacaatagctaagggcagaggaagatgtctgagtgcggatacagtagatgcctcttcagtgatgctttagatttacaaatcaaagtatctatgttgtattttaatgctgtgggttgctgattagagtgtataggggaagttaagacggatggatgagagtgtctataaaggggggtggaagtagtactatgtgtgatggacaacctctttgatctctatagtgtgtatagtactagtaaatataataagtccgcattctttctgcttttatttagtttattagttttgtgacgacaggatgtctttgacatctgtttgtcgctgggtctacgacgtgacagtcgcgcgcaaatctacgagtctcatctcacaactctctc

SEQ ID NO: 460649 - DNA, 955 bp, Homo sapiens
ggacctgtctcggcctttgccccagcctgaccgtcaccatggctcgtgggcgctattcaaggtgtttctgcccccagggagaaggctctggccctcacagggaaccagggcatcgaggctgcgatggactggctgatggagcacgaagacgaccccgatgtggacgagcctccacccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaacctgagttctgtacatgcctgactccttcgatgggatggtgggcgagctacaatagctaagggcagaggaagatgtctgagtgcggatacagtagatgcctcttcagtgatgctttagatttacaaatcaaagtatctatgttgtattttaatgctgtgggttgctgattagagtgtataggggaagttaagacggatggatgagagtgtctataaaggggggtggaagtagtactatgtgtgatggacaacctctttgatctctatagtgtgtatagtactagtaaatataataagtccgcattctttctgcttttatttagtttattagttttgtgacgacaggatgtctttgacatctgtttgtcgctgggtctacgacgtgacagtcgcgcgcaaatctacgagtctcatctcacaactctctc

SEQ ID NO: 460650 - DNA, 1718 bp, Homo sapiens
ctcctcaagtgccgccagagtgggagcccaggcagaggaggcgccaagagcgagcgagggctgtgaggactgccggcacgctttccggtctggcagagagcgcggagagacgcagaacgcagccagctcctccagggccctccaggccctccggacccgggccggcgggtgaactggggggccccgggacaggccgaggcctctgccctgcagataccggaggcctctgctgtggctgcccactggctgtgcccaggccttgaagccgcagcgaacctctctttcccaccccacctggatgactgatggcggcggctgcgtctccccgacgggaccccgccggccgccgcgtctcccgacccaagcctgccgggcctcgacgaaacccccgcagagtcgctgggacgcagcgcctttgggcggcgccgggcgtggtgggccggaaagtatggcggccgcttgaacgccgcgcggcggaggccattaaggcgtggagggcccgggaaggcggcctagggacgcaagcaggctcggccacctctttaggccacggagccgcgcagatccggttcccgggtgaccactctgtcgccattgggcgagaccgacctagtcctgacgacaacggacaaaggccttcaggggcctggaaggtgagtgaagtcccgaaagacgacgggtggaacggttagcggctatcgggcggttggtctttgttctaccagactttgctgtcagaagagagaaatggtagaatgacaggccacgtttggcccgttggaaatgcccaccaccctctgggaagatttactggccgtttatgtaaggcctgtgtatataatatgaaaaagctgctctcaacttcaccccaaccttttaatagaaaacatttgtcacatctagcccttctagatggaaagagacttggcccctactacacccaaatcaccacccagggaagtcacaatagcgattgtgtcagcaacaaaattaatggccagcagatcaaagttgttcctatccaaaagtataacttaatgaaagcagaacctttagaccaatattcatatttctgtgacagactttggcatctagacttctggctcagggaccttcctcagttcctccctgattcttggctacagcttagaggggtagggggattgagacaacctgagtctcagataaattaaataccttataaacaaatgaaatatcctaaaatgttaaggtcaattgacgtgcctgataaataatctcttaaatgtccactgctcatcacaattgtgaaactggcagggacctttcctatctatttgtgctcacagcagtttctggcctgtatccctgtgagtaaagttaagaattatatggatttaataatattgcccttctgatcttccagtgtttgccaaagtagaaaaaaacagtacaattgtatataatggtattcaaaatatacagcatacacatggtatgcaagatatgaattgaatgattcaaactgtaagttcccaggaggcatgaaacaacattaactttctgtgaccaatgtttaatattgaatgtacaaacacaccaacaccaacctctgcaatgataatgatgggcggaagtgacactgaatatttcagcactgaaaagacattcatttttcaggtgtactgttatgcatttcttttcccatttgtaatcacagttgtaccacactgctcttt

SEQ ID NO: 460651 - DNA, 711 bp, Homo sapiens
gaggcgcgtccctagctaggagtgctgggagttatggtgtcttaacggtttccagcccattggtcgccgacctgctaactacaaaaccagcatgcgctgtctgtcctcccccgtggtgcgcagccctggagggagggacagggcggtgtggactcgtcctttcctaagcgatgccacatgctgattctgtgccaccccctcgccaagggagtccgcagaaggacttgaggggcaggtctaggctgggcgatgaggacggtgtgaccctgcgaagtgcacctcccttgctcaaatcggaggggtctggtcctcatgaacagcccgctgaacatctcggtgtcctctcacatacacacccgcggggggtttccagagcatcgcacctcttccagcccagggagccgcctgctctgctaaactctatgggaactgagacatccacctgctgcgtgacccacccgtgcgcaacttcagagctttcagggggtgatgcgggctgtggctccttcgtgaaaatgtcaccgtctgcagcgcctttcttgtgatatagaacttgacgggttcctgcgaatgaagttgcaaatattgatgaagataatactactgccttgctgtcaaacagtaacagtcacctttttttgtatctccaattataaatgcaatacatactgtaaaaagaaaagaaaacatcataaatatctttataaagta

SEQ ID NO: 460652 - DNA, 500 bp, Homo sapiens
ggaaactcactggcatttgtccttctctctgctccttcttaccctggcaggcatgagacttatcaagtgagatggagcagtggtagatcctgaccagtcctcacctggaatatttgttattataaaaacatagtcctctcattttttacaagtgtaacttctttgccttaaagttttgtctgggctttctcttacaggttcctgcgaatgaagttgcaaatattgatgaagataatactactgccttgctgtcaaacagtaacagtcacctttttttgtatctccaattataaatgcaatacatactgtaaaaagaaaagaaaacatcataaatatctttataaagtaaaagtcttggctggtctctgggagcagtgactcatgcctgtaatctcggcctcccaaattgctggaattacaggtgtgagccaccacaacttacccagcctttttactttgtgtaagaatagcatcagtgtattaaaaatacgacggaaatt

SEQ ID NO: 460653 - DNA, 348 bp, Homo sapiens
ggaaactcactggcatttgtccttctctctgctccttcttaccctggcaggcatgagacttatcaagtgagatggagcagtggtagatcctgaccagtcctcacctggaatatttgttattataaaaacatagtcctctcattttttacaagtgtaacttctttgccttaaagttttgtctgggctttctcttacaggttcctgcgaatgaagttgcaaatattgatgaagataatactactgccttgctgtcaaacagtaacagtcacctttttttgtatctccaattataaatgcaatacatactgtaaaaagaaaagaaaacatcataaatatctttataaagta

SEQ ID NO: 460654 - DNA, 887 bp, Homo sapiens
gaggcgcgtccctagctaggagtgctgggagttatggtgtcttaacggtttccagcccattggtcgccgacctgctaactacaaaaccagcatgcgctgtctgtcctcccccgtggtgcgcagccctggagggagggacagggcggtgtggactcgtcctttcctaagcgatgccacatgctgattctgtgccaccccctcgccaagggagtccgcagaaggacttgaggggcaggtctaggctgggcgatgaggacggtgtgaccctgcgaagtgcacctcccttgctcaaatcggaggggtctggtcctcatgaacagcccgctgaacatctcggtgtcctctcacatacacacccgcggggggtttccagagcatcgcacctcttccagcccagggagccgcctgctctgctaaactctatgggaactgagacatccacctgctgcgtgacccacccgtgcgcaacttcagagctttcagggggtgatgcgggctgtggctccttcgtgaaaatgtcaccgtctgcagcgcctttcttgtgatatagaacttgacgggttcctgcgaatgaagttgcaaatattgatgaagataatactactgccttgctgtcaaacagtaacagtcacctttttttgtatctccaattataaatgcaatacatactgtaaaaagaaaagaaaacatcataaatatctttataaagtaaaagtcttggctggtctctgggagcagtgactcatgcctgtaatctcagcactttgtgaggccgaggtgggtggatcatgaggactcttctagtggttagtaacacaatcaacttttatttattttggaaaggtttagtttttttatttctgaagtgatattactccagttgaagg

SEQ ID NO: 460655 - DNA, 1169 bp, Homo sapiens
gaggcgcgtccctagctaggagtgctgggagttatggtgtcttaacggtttccagcccattggtcgccgacctgctaactacaaaaccagcatgcgctgtctgtcctcccccgtggtgcgcagccctggagggagggacagggcggtgtggactcgtcctttcctaagcgatgccacatgctgattctgtgccaccccctcgccaagggagtccgcagaaggacttgaggggcaggtctaggctgggcgatgaggacggtgtgaccctgcgaagtgcacctcccttgctcaaatcggaggggtctggtcctcatgaacagcccgctgaacatctcggtgtcctctcacatacacacccgcggggggtttccagagcatcgcacctcttccagcccagggagccgcctgctctgctaaactctatgggaactgagacatccacctgctgcgtgacccacccgtgcgcaacttcagagctttcagggggtgatgcgggctgtggctccttcgtgaaaatgtcaccgtctgcagcgcctttcttgtgatatagaacttgacgggtgagagcgggtatttcttgggttactcaggatctgctaacagcagaggagaaaaccacaattcccaggcataagaatctacctaaagacgatggtttagatattttacagttgaaatcaccagcctcatctcaactgagtcctgactgacgagtgtctcaaaaaagcagttggtgacctcatccctcaggaacaggtggtgctccagctttgtggggatgactttcaaggtgcagagcacttgagccgcatttgaagtcattcatgttttacatctctgctttggatggaaagttgatcccccacagccgttggggatgtaccttaatatactggggcttatcagttaaatttttctgtctagacaatgaaaacccagaagttccacttgcaggtagcctcttaataatcgacgtccctaagttccttatgtcctcaggatagttccttttgttcccagatgttaccaactttgatgatgcatctaatctgtacaaacctgtgtatttctctatgtgaaaagaatactttgttcaaattacatgttcttataattttcacttgtgatcggtgagtatgggacactataaaaaaatcctgaaaaacctc

SEQ ID NO: 460656 - DNA, 1033 bp, Homo sapiens
  misc_feature (1028)..(1028): n is a, c, g, or t
  misc_feature (1033)..(1033): n is a, c, g, or t
atattgtaatatggtcttacaagatgtaatgatcaaaggaaactgggtgaatggtacactggacctctctgtcatatttttgcaacttcctatgagtctgctttttgggttcactgatatgtttgatccccgattaggagagaaggagtttcggaaagcacggaaagagaacatggaaatacaagtaaaaccagtagcagagctcctggcatttttactaaaagtacatcctaaattgtgtgccgttgtgcaggtacaattgccatttcaactggtacttgaacaatacctcctgctcgagcctttcagtcatgccacactgagactctcctctaacgtttattctcataattttagagctgaagagacctttggagatgctctaagccagcatcctccttttgtgactgaagagcacaggaccagacagaatcttcccaagaacatggtggagtgaacattaaaaaatatgtataagaggagtaaatatatttttagaagattataaagttataatttggaaactggagaaagaaaataagtccaatatttcttcctcacaggtactctgaaaattctgaagcctaggctggagtgcagtggcgcagtcttggctcactgcaacctctgcctctcaggctgaaacgatcctcccacctcagcctccacagtagccaggacttacaggcacacaccaccatgcctggctactttttatatttttatagagatgggatttctccatgtcggtcaggctggtctcgaactcctgacttcaggtgattcgcccgcctctgcctcccaaagcgctgggattacaggcaagattgatgtcttaatgtgaagggtcctttatgcaagctagaggttttgaggttccccctccccatcgagccttgcagttccattaaaggattttaagcaagggagtaataaaattcgttatatcattgaatgaataaaatagtcagactttttatttgtaggagaaaaattgtattagatgtagccaaatatggcttaagtantgcan

SEQ ID NO: 460657 - DNA, 614 bp, Homo sapiens
  misc_feature (609)..(609): n is a, c, g, or t
  misc_feature (614)..(614): n is a, c, g, or t
aaacatctcgcgggtacagattttaaaatgcaggtcaatttccaattatctagattaatttggaaataaattacatgaagtgtaaacacaaataattcttacactttaattcatgtactggcttttttttttttcccccctgagacagagtttcgctcttgttgcccaggctggagtgcagtggcgcagtcttggctcactgcaacctctgcctctcaggctgaaacgatcctcccacctcagcctccacagtagccaggacttacaggcacacaccaccatgcctggctactttttatatttttatagagatgggatttctccatgtcggtcaggctggtctcgaactcctgacttcaggtgattcgcccgcctctgcctcccaaagcgctgggattacaggcaagattgatgtcttaatgtgaagggtcctttatgcaagctagaggttttgaggttccccctccccatcgagccttgcagttccattaaaggattttaagcaagggagtaataaaattcgttatatcattgaatgaataaaatagtcagactttttatttgtaggagaaaaattgtattagatgtagccaaatatggcttaagtantgcan

SEQ ID NO: 460658 - DNA, 3512 bp, Homo sapiens
  misc_feature (1)..(1): n is a, c, g, or t
  misc_feature (4)..(6): n is a, c, g, or t
  misc_feature (8)..(8): n is a, c, g, or t
  misc_feature (11)..(11): n is a, c, g, or t
  misc_feature (13)..(13): n is a, c, g, or t
nagnnntnttntngcccaaccattatgccagtaggaccccacacgcactctagatgcctcagaactactgagaacaaagacagctgggtgttaagctgctacatcagaggactcatgtcaggtccctcttctgcaggtctgctggagtttgctggaggtccactccagatcctgtttgcttgggtatcaccagcggaggttgcagaacagcaaagattcctgcctgctccttcctctggaagcttcattttagaggagcacctgcctgatgccagccagagctctcctcccttgactggggctgctgcctttctctcagagatgccctgcccagtgaggaggaatctagagaggcagtctggccacagttgctttgcagcactgcagtcccactgggggaaaaaaaaaaaactcctgcagctagctcagtgtctccccaaacagccacctagttttgcacttgaaacccagggccctggtagcattggcacacaagggaatctcctggtctgcgtgttgcaaaaactatgggaaaagcataatttctgggctggatagcacagtccctatggcttccttgggtaggtgaggaagttccctggccctttggacttcctgggtgaggtgatgccccaccctgcttcagcttaccctccgtgggctgcacccacccgctgtctaaccagtcccagtgagatgaaccgggtacctcagttggaaatgcagaaatcactcaccttccgcattgctctcgctgggagctgcagaccagagctcttcctattcggccatcttgccagctgtctctatcgactacctcttattccaaaaaataaaaccataatgaagttagacaccattaaatatacataatataaaaataggttttcttattctaatctagatttgctacacaagaccatctacagaatgaatgccatgaatatacaatctgtacccaataagttgtacattttagtaaacattcctgattgtaagggtggcaaatggaaattttggcttcttagatctttactgtgagtttgactgacatcagtacatttttatttttaattgtatattttcattactgtgaatttttttgcagtgatttttgatgccatgtggctacattggttttagaatactaataaaatccattgcttttaaaataaataaataaaccccatagcacatcctccatacaacatctgttgtccctcaagatacaattgttaccactatcatctaaccattattttatgataactttaaaatatcaacttgcaagaaaatattccacaaaacacactctgcctttttactttaaagagtccttggctacctgggccaatattattctcatttgtaggatttaggttccacagattataatatgtgcctttttctgtgttccctgcagatttgcaagtaccatccctttttggggccttactttgcacctccagcatctgggaaacaatgttttcctgttgcagactctctttggtgcagtcaccctcctggccaattgtgttgcaccttgggcactgaatcacatgagccgtcgactaagccagatgcttctcatgttcctactggcaacctgccttctggccatcatatttgtgcctcaagaaatgcagaccctgcgtgtggttttggcaaccctgggtgtgggagctgcttctcttggcattacctgttctactgcccaagaaaatgaactaattccttccataatcaggtacaaaagtttatgtgtgctctgtcattctcaaaatggacctgtctcaaccaattgacacttaacaagggaaaaaaatccaagacaagttagttaaaaaacaatcaaatgtaatagtcataaaaacaacaaattacagcccaagtttatatcaagctgactttgttccagacgctgcattaagtcttttaatgcagtatcccatgtaccttctgaaccacctgaaaggttgatgttaaggaaaatagcattttgtaaatgataaaaatgtgtctaattcacttgtgaatctaaaataaattgctagcaaataagagaaaatttcaaaagcaagagtatgttatcacctccatgtgtttaagtgctcatccataatcacagcaaaatgataaatcacaaattatatgtatgatttttaacaacttttcctctgttgctgtttttactccaaggggaagagctactggaatcactggaaactttgctaatattgggggagccctggcttccctcatgatgatcctaagcatatattctcgacccctgccctggatcatctatggagtctttgccatcctctctggccttgttgtcctcctccttcctgaaaccaggaaccagcctcttcttgacagcatccaggatgtggaaaatgagggagtaaatagcctagctgcccctcagaggagctctgtgctataggtctgtgctgaggaaagcaaaacaccatttagggctaccatcccccaaaaaggcttagatctgggctattcccatgtagtcagtgcctttgcctttggtgtatcctcatcccttccacagtgacctcatacatcccctgagcctcactagatcacacagaccatctctgcccagcctgtccaggaggttaatttgtggtgaaaagaccaaaattaggtgacctctgcccttcctgccctggtatgacatgcatactcttgaaggtattctacaaacatgcagggatccaaacaccatcttctcatccctggggagccctcagcccagtgagtgtacctgttagctgtctgggattgccagtgcttacaggcctgactcccaggacactgaagaatttgtgagagactgtatagaaaataagagcccctcccacagatgagaagtccttttgtatcacatgtgagattcagtctatctaattttcacgggggaaaaaaagcgttggaaaaggggaaaagaagtgataagtaaaggaattttttaagtaatgaagaatgagaaaaggttctaaaacttttctgtgcttctcttgccttttccaaaatccctttggtcaatgccatggtgtccaagttctcaggtatgtctttatcagcagcttgaaaatggactaatacaatggtgcagtggaactgttgggtcaaatgttagctttacttttgatttttttgaggaacctccaaactgttctccatagcagttttactaaaggccccatacaattccaaaatccagcagggaagtccaatcttaaagctccaaagttatctcctttgactgcatgtctcacatttgggtcacaatgatgcacagcctccctcctggctgcttttgtgacctggcattgagtgtctgcagcttttccaggtgtgcagtgcaagctgtcaatgcctttacaattctggggtctggaggtcgaagaccctcttctcacagctccactaagcagtctccgatggagactctgtgtatggacttcaaccccacatcttcctttcacacc

SEQ ID NO: 460659 - DNA, 637 bp, Homo sapiens
  misc_feature (1)..(2): n is a, c, g, or t
  misc_feature (4)..(4): n is a, c, g, or t
  misc_feature (7)..(7): n is a, c, g, or t
  misc_feature (9)..(9): n is a, c, g, or t
  misc_feature (11)..(11): n is a, c, g, or t
  misc_feature (14)..(14): n is a, c, g, or t
  misc_feature (18)..(19): n is a, c, g, or t
nntnttntncnttnttgnnttgttaggactttcagtacaatgttaaaaaggagtggcccctattggactcatgtcctatttacatggaaatccaaggagggcctgaaagtctacgtcaacgggaccctgagcacctctgatccgagtggaaaagtgtctcgtgactatggagagtccaacgtcaacctcgtgatagggtctgagcaggaccaggccaagtgttatgagaacggtgctttcgatgagttcatcatctgggagcgggctctgactccggatgagatcgccatgtacttcactgctgccattggaaagcatgctttattgtcttcaacgctgccaagcctcttcatgacatccacagcaagccccgtgatgcccacagatgcctaccatcccatcataaccaacctgacagaagagagaaaaaccttccaaagtcccggagtgatactgagttacctccaaaatgtatccctcagcttacccagtaagtccctctcggagcagacagccttgaatctcaccaagatcgagtttaaaaaaagcaggaacttttactgaaacgtttgggtttcaggcttctcatgaacaaccagctggtgtggccctcctggccagctctgtacagctcagc

SEQ ID NO: 460660 - DNA, 539 bp, Homo sapiens
ttccataccaagtaatataggcagttgcaacatccatgaagagttgttaattggagcacaaggcatctgcagtgtcaaatctacagagacaagtgcacctggagacaaatgaccagactaccataaaacagaagcttaattatgttcacttacattttcaaattattcccaacaaattaccctgtttttccaggcagaagaagcagagtgaagagaggacattccaaataaaatgaatgctgatcctgcattgagtgcaagcaaaaaactgtcaagttttccctggatctttgggctttcatttctgaagtctcctgtgtcacgtaaaactttgttaaataaatttgttatgcttttctcttatgtttcctcatttgctgtatgccatttggacaatttccacagattagagcaaaacttcaatgtctgttccagaaggaagtatcatgttggattttactgtacaatgaagaaatgggtattgggggaacctgcccccaatatttcaacgtaggttttttctattttccataagtgtc

SEQ ID NO: 460661 - DNA, 1127 bp, Homo sapiens
gaagaaccagtagtgttgatgtcatagagcaggagaagataaatgtcccagctcagacagagactccattaccccacggactacaggcagcagcctcatcaggattctgtggaaggctcgtctctgggcaggacggcagtaccaggaaaggcctccctgaaaccagaacaggaagaagcaggcccttcagagggctcagggaagagtctttcagctagagggaattgcttggacaaaggccctgagaagggaatagcttgcatgtttgagagacagaaagaatctccgggtggcaagaagatggcaactatctaccaaatatttgtgcgtcccctttcaaacctttcactgagaggcagctgcctaggccaggactgcatttcccaacaacccttacagtcaagtgtggctgtgtaccttgttctcacttataggcagtgtatataattattttagctctagtaaagaatttctgcttccataatttatctatttactctgtggccctccgagacttcgtgtaacagcaactgcattttaatgcaatggcagctatggaaaacacaaaactatcagtcattgtcaaatactccataaatggagacagagaaggggttcagttctctgtgtaacaaggacagaggagaaaggcatctgcagtgtcaaatctacagagacaagtgcacctggagacaaatgaccagactaccataaaacagaagcttaattatgttcacttacattttcaaattattcccaacaaattaccctgtttttccaggcagaagaagcagagtgaagagaggacattccaaataaaatgaatgctgatcctgcattgagtgcaagcaaaaaactgtcaagttttccctggatctttgggctttcatttctgaagtctcctgtgtcacgtaaaactttgttaaataaatttgttatgcttttctcttatgtttcctcatttgctgtatgccatttggacaatttccacagattagagcaaaacttcaatgtctgttccagaaggaagtatcatgttggattttactgtacaatgaagaaatgggtattgggggaacctgcccccaatatttcaacgtaggttttttctattttccataagtgtc

SEQ ID NO: 460662 - DNA, 1046 bp, Homo sapiens
cactgaaatacatgaaccgtcgagcaagccagatgcttctcatgttcctactggcaatctgccttctggccatcatatttgtgccacaagaaatgcagacgctgcgtgaggttttggcaacactgggcttaggagcgtctgctcttgccaatacccttgcttttgcccatggaaatgaagtaattcccaccataatcagcaaaatgataaatcacaaattgcctgtgtggatttttaacagatattcttgtattgctgtttccactcaaagggcaagagctatggggatcaatgcaacctttgctaatatagcaggagccctggctcccctcatgatgatcctaagtgtgtattctccacccctgccctggatcatctatggagtcttccccttcatctctggctttgctttcctcctccttcctgaaaccaggaacaagcctctgtttgacaccatccaggatgagaaaaatgagtgagtaaatagcccggttgcccctcagaggatctgtgtgctataggtctgtgctgaggaaggcaaaataccatttagggccactgtcctctcaaaaggcttagacttaggattttcccatgtaatcagtgccttaggtctaggtacagccacatgccttcccacagtgacctcagacaccctctggaggctctcccagatcacacagaccagctctgcccagcttgtcaaaggaggcttccatagtgaagaagccaaaattaggtctcctcttccctccctgccctagtgtgatatgcacactgttgaaggtattttacaaatatgcagagatccaaacaccagattttcatccctgggaaaccctcaaacaagtgggtacctgtaagctgtctgagattgccagtgcttacaggcctgactactaggccactgaagaatttgtggaagagtatgcagatgcaggggtatccaatcttttggcttccctggtctacagtggaataagaattgtcttgggccacacataaaatacactaacactaataatatctgatgagctaaaaaaaaa

SEQ ID NO: 460663 - DNA, 1901 bp, Homo sapiens
cactgaaatacatgaaccgtcgagcaagccagatgcttctcatgttcctactggcaatctgccttctggccatcatatttgtgccacaagaaatgcagacgctgcgtgaggttttggcaacactgggcttaggagcgtctgctcttgccaatacccttgcttttgcccatggaaatgaagtaattcccaccataatcagcaaaatgataaatcacaaattgcctgtgtggatttttaacagatattcttgtattgctgtttccactcaaagggcaagagctatggggatcaatgcaacctttgctaatatagcaggagccctggctcccctcatgatgatcctaagtgtgtattctccacccctgccctggatcatctatggagtcttccccttcatctctggctttgctttcctcctccttcctgaaaccaggaacaagcctctgtttgacaccatccaggatgagaaaaatgagagaaaagaccccagagaaccaaagcaagaggatccgagagtggaagtgacgcagttttaaggaattccaggagctgactgccgatcaatgagccagatgaagggaacaatcaggactattcctagacactagcaaaatctagaaaataaataacaaggctgggtgcggtggctcacgcctgtaatcccagcaccttgggaggctgaggcgggcagatcatgaggtcagaagataaagaccaccctggccaacatggtgaaaccctgtctctactaaaacaaatacaaaacttcgctgggcacagtggcacaggcctttaattccagctacttgggaggctgaggcaggagaattacttgaacccaggaggtggaaattgcaatgagccaagattgggccactgcattccagcctggtgacagagcgagactgtctcaaaaaaaaaaaaaaaaaaaaaagaaagaaggaaagaaagaaagaaaagaaaagaaataacaagatatagtgagtcagtagattcacttcacaattgtggtactaaataactaaatataagctatctacatataatagtaagaaaaagtttgaagaaaattatataacactttaaaatcaatcataatagactatttatgtagttataggtccctagcaagtttctggataggaagattgagtactattaaacacaatgtgtcttcttcaattatttgatagagtaactggtgggataattacaatgaaaaatctgctacttttacaaaaactttaaaataaattcaaatttatctaggaattaatagtagacatttggttcagaaaaaagaagatcagggagtgaaaaatgtagctgtcaggtaagtggggtagcatgcacagaattttatcataagttgtaatattcataacattattagcagatgcatttacaaaacaaagaaattcaaaagtagactttagtatgtataacatttaatgtgtaacaatttcagtattgtacattcttagaggaaacacctaattatggaataaatagcattagccaactaatcagaaataaatgactaacaattcaactttatatcctgtattagtcagggttctctaaagcaagagaaataatagtatatatgtgtatataaaagtgagtttattaggagaattgactcacacggtcacaggatgaagttccacactaggccatttgcaagctgaggagccaggaagccagtccaagtcccaaaaccccaaaagtagggaagctgaccatatagccttcagtctgtggccaaaagcctgagagcccctgacaaatcactggtgtgagtccaagagttcaaaagctaaggaacctggaagtcggatgtttgagggcagaaagtatccagcatgggagaaagatgaaggctgaaagactcagcaagt

SEQ ID NO: 460664 - DNA, 707 bp, Homo sapiens
agctgattgctgagtcagcgggccatggaaaaactggcacccaaactgcaggaggtatcccaaaggtccaaaggtgcccttggacttagcaagctgaagaatcctggaccgctggtgagggtgacattccatgcccttgtacgaggtgcatttggtataagctatattgtcttgaaagtcctaggtccaaaggacagtaaaataaccagactttcccaaagttcaaacagagagcacttggtcccttgtgaggatgttcttctgaccaagccagaagggatcatgcagatcccaagaaattctcacagaactactatgggttgccaatggagattagtagcccctttaaatcacatcattcagcttaatattattaacttcccgatgaagccaacaacttttgtctgtcatggtcatctgcgtgtttacgaaggatttggaccaggaaaaaaattaataggagaatgttgatgagcactgagctttcttggttcctaagccaattcagcaccaagaagaccacagcttcttgtggggagactgcagtatctatgaaaatgatgtatacttctatctttcttgccctacagaacacctgttaccatgcactgcctcatgaggttgttttgagaattaaataagagaaggcatgttaatcaatactaagaaaccaagcttgcattttatttggattagaaatatctatt

SEQ ID NO: 460665 - DNA, 385 bp, Homo sapiens
ctctatccctctatctttaatctctcttccttaatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacaggtaagggtcagctttgaatatgttaata

SEQ ID NO: 460666 - DNA, 4790 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagatctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460667 - DNA, 2720 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagat

SEQ ID NO: 460668 - DNA, 3219 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggaagtagtaagagaaagacaagaaaacctaagacttgtgagactgatgccagataaagaggcaatgattggaaactccaagaagaattgtctcttaatagagactagat

SEQ ID NO: 460669 - DNA, 3423 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagaaaggaaacgtcaagaggaaatagaagccaggtcgagaaagaagatatatttgcctgatgaaccggcatcatgtgtacatccaaatggggctgcaaaaagtggcaagtttgatggtagcatcatgtctttgagtgtcctatgggactacagattagaggataataaagaacattcattgaggtttcattgtttgggaactttcaagaaatgttcaaagagatttggggtgtccgtatatacaaatcattactgtctctttcctgagaaaagaggacaacaaagaaaggataaaaaagcaaaaggatgagagaaaagataaaaagagaaagagatgatggtgaggtaaagaaatttaacctaccatggctaatgacgaagatatgacgtaagtggacaaaagagaccgagggttggaacttgaaagagaggtgggtgtgtatgaatggaagtaaggagaaagaactaggaaaaccggttaaaattttgtgtgaggcgtttaatgggaaggagtgtggttttggttacaaaaaacagttgggcaacaagggatg

SEQ ID NO: 460670 - DNA, 5654 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggcactgaacgctaatccctttttctatttccgcttctcacaggcacaggaacacaggcacaaatgcacaccacacactacataataaacacacatggaggaacataactggtaacagcgactggtaatccagctttcagcagtatagttgtatgttcttttctcttaaaatttctgtcttattatcctaactttaagagtgctgagacctcaaaggaaaataagttgtgcttaaattgcacagaattttgtttttatcataggtctagttgctggaatctgggaccagttgttgaacaagattcagtattaagccattttaaacattttgccattttctaaaatttaaaaaattttctttttcatggtcatcagttctagtcatggatatttgaaattggacaaccacaagtctgagagatttgaaatttcaggctatgtggcaacgtctttggtacatttcaaaggtctgactaaatcagtctttgggtggcttgaaaattgaggcaagatcacacactgtgtggtttgtggagaccggcagtgtttgtgcatccctgatatcctttgtgttgtaatttatcacccttttgtgtttcacagatctggctttgattggctgatgagtgtctttgtgatcagttaaaagtggtagaatgtatgtacgtggacttgcctaaataataactttaggagaagacaatctgaaacatttgtgaccttgcacagatcagcaacagacttttaaaaataaattatttttattttaaggtttcataatagtaattacattcttaactttgtatgtcaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460671 - DNA, 4879 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaagacttttgacaggattgaattatttgactataataggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460672 - DNA, 2416 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggtatgtactcaatctattattatactcta

SEQ ID NO: 460673 - DNA, 3004 bp, Homo sapiens
cgcggtggctcacgcttgtaatcccagcactttgggaggccgaggcgggcggatcacgaggtcagaagatcgagaccatcctggctaacacggtgaaaccccgtctctactaaaaatacaaaaaaaattagccgggcgtgatggcgggtgcttgtagtcccagctactcgggaggctgaggcaggagaatggcgtgaacccgggaggcggagcttgcagtgagccgagattgcgccactgcactcccacctgggccacagagcgagactctgtctcaaaaaaaaaaaaaaaaacaatatccgctgccccccgccccccgccaccttttttttttccgtgtttttctgctccatatattcaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460674 - DNA, 3086 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggcactgaacgctaatccctttttctatttccgcttctcacaggcacaggaacacaggcacaaatgcacaccacacactacataataaacacacatggaggaacataactggtaacagcgactggtaatccagctttcagcagtatagttgtatgttcttttctcttaaaatttctgtcttattatcctaactttaagagtgctgagacctcaaaggaaaataagttgtgcttaaattgcacagaattttgtttttatcataggtctagttgctggaatctgggaccagttgttgaacaagattcagtattaagccattttaaacattttgccattttctaaaatttaaaaaattttctttttcatggtcatcagttctagtcatggatatttgaaattggacaaccacaagtctgagagatttgaaatttcaggctatgtggcaacgtctttggtacatttcaaaggtctgactaaatcagtctttgggtggcttgaaaattgaggcaagatcacacactgtgtggtttgtggagaccggcagtgtttgtgcatccctgatatcctttgtgttgtaatttatcacccttttgtgtttcacagatctggctttgattggctgatgagtgtctttgtgatcagttaaaagtggtagaatgtatgtacgtggacttgcctaaataataactttaggagaagacaatctgaaacatttgtgaccttgcacagatcagcaacagacttttaaaaataaattatttttattttaaggtttcataatagtaattacattcttaactttgtatgtcaggatgaagaagagaaggatgatggtgaagctaaagaaatttctacacctacccattggtctaaacttgatccaaagacaatgaaggtaactttgataaggatggattttatttatttttttcaattaaaaagttctttctgagacagagtttggctctgt

SEQ ID NO: 460675 - DNA, 2566 bp, Homo sapiens
gcggccgtctactactactatacggttttgagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460676 - DNA, 1733 bp, Homo sapiens
caagaaatgtattttcatctctgtattttgtttacttgcatgcataacaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460677 - DNA, 151 bp, Homo sapiens
gtaaaaggacacatttgttttaactttagatgtattcactttgcttagctgtaactttgtacacataaaatctaaagccctacattttaatatttgttgattaatgagtaattttagtattaaggcacccagaatttaatgatgtagatgt

SEQ ID NO: 460678 - DNA, 637 bp, Homo sapiens
catagtggctcacacctgtaatcccagcactttgggaggcggaggagggtggatcacctgaggtcaggagttcaagaccagcctggctaacatggtgaaaccctgtctctccaaaaatacaaaaattggccaggcatgatggcgggtgcctgtaataccagctactctggaggctgaggtaggagaatcgcttgaacctgggaagtggaggttgtagtgagtcgagatcacaccactgcactccagtttgggcgacaagagcaagactctttctcaaaagaaagtgaaaattatatcatagtttttctaagagaatcaagaaatgtattttcatctctgtattttgtttacttgcatgcataacaggtaaagaagcttcttaataaagtagtgctccgtgaatcttgcttttaccggaaattaacagacacctcaaaagatgaagagaaccatgaagagtctgagtcattgcaggaagatatgctaggtctgagtaatattaagattttgctttttaataaatatactagtaattaaagaagaaaaataacttactaaaatatggtatattttatattataggaaacagattattacttccaacaccaacagtaaagcaggaatcaaaggatgtgga

SEQ ID NO: 460679 - DNA, 4364 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggcactgaacgctaatccctttttctatttccgcttctcacaggcacaggaacacaggcacaaatgcacaccacacactacataataaacacacatggaggaacataactggtaacagcgactggtaatccagctttcagcagtatagttgtatgttcttttctcttaaaatttctgtcttattatcctaactttaagagtgctgagacctcaaaggaaaataagttgtgcttaaattgcacagaattttgtttttatcataggtctagttgctggaatctgggaccagttgttgaacaagattcagtattaagccattttaaacattttgccattttctaaaatttaaaaaattttctttttcatggtcatcagttctagtcatggatatttgaaattggacaaccacaagtctgagagatttgaaatttcaggctatgtggcaacgtctttggtacatttcaaaggtctgactaaatcagtctttgggtggcttgaaaattgaggcaagatcacacactgtgtggtttgtggagaccggcagtgtttgtgcatccctgatatcctttgtgttgtaatttatcacccttttgtgtttcacagatctggctttgattggctgatgagtgtctttgtgatcagttaaaagtggtagaatgtatgtacgtggacttgcctaaataataactttaggagaagacaatctgaaacatttgtgaccttgcacagatcagcaacagacttttaaaaataaattatttttattttaaggtttcataatagtaattacattcttaactttgtatgtcaggatgaagaagagaaggatgatggtgaagctaaagaaatttctacacctacccattggtctaaacttgatccaaagacaatgaaggtaactttgataaggatggattttatttatttttttcaattaaaaagttctttctgagacagagtttggctctgtcgcccaggctggagtgtagtggcgcgatctcggctcacttcagcctctgcctcctgggttcagtagattctcttgcctcagcctcctgagtagctgggattacaggcaccctgccaccacgcctggctaatttttctagttttagtagagacaaggtttcagaatgttggccagtttggtctcgaactcctgacatcaggtgatccacctgcctcagtctcccaaagtgctgggattacaggcatgagctgccgtgcctggccaattgtatttatatacatataaattaaaaggcaattttataaatcagtacagccaatatctgttgaatgcctataatatatgagggtctatagtgtaactatagtaactttgagaactaagaaggtaggatttctgcactaagtaacttcaaggggatgggactataggcgcctgccaccacgcccggctaattgttttgtatttttagtagagatcgggtttcaccgtgttagccattatggtctcaatctcctgacctcgtgattcacccgccttggcatcccaaagtgctgggattacaggtgtgagccaccgtgcctggccgtaatttggtttttaaaatagaatatttttttgagacagagtcttgctgtgtttcccagactggagtgcagtggaatgatcttggctcactgcagctttggcctcctgggttcaaatgattcttgtgcctcagcctctcgaatagcttggattacaggcacgtacaaccatgccaggctaatttctgtatttttagtagagatgggattttgccatattggtcaggccggtctcacactcctggcctcaagcgatctatccacccccgcctcccagagtgtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaatatgcaggatgggaaatttttttgggaggggggatgagaaatatttattaaagttggtatgatcttttgaaactgcatatcagctggatgttgtggcacaaccagatatttccatatgctttagtttctcaggcaaaaattatgtcaaagctgcttctagtctctcattttcataaatacctttactatgtaccaaagaagggagccctattttcccacaag

SEQ ID NO: 460680 - DNA, 4844 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460681 - DNA, 3987 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaacctgactttccatctctggagaaccaattgatctggacatccgaacttatttaccgcatggtggaaatcccccgggtccccaaggtatgtcgactgacgccatccaaatcccgcgaaaggggcgggcggtaaaaccagcagcaagagaggggggacatgatgtctaaaacacgcatcaaaatagggacggaccactcttagaaagagcacaattccatccaacgatgagactaagaaagtagtctgcaacagaaggtgtactctcataaacgcggcaaaagagagagtgtgcaaccacacctcatagcttacaaactctcgtatcggaacctaatcatcagactatagtctcgtccactatgtctcgatttcgtcacagtaataaagagaggggggggagga

SEQ ID NO: 460682 - DNA, 4968 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcaggtgaaggtctggtccccgtagttggagcagtgggcggccaagccgggtctcttaacatcttgtcgaatctgtggaagggccgggagcgatcttttgggtagcccggcggccccgggcggcgacgatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460683 - DNA, 4370 bp, Homo sapiens
ggaatccgaggtgataccagtggcaagcgcagctgcggcagttgttacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460684 - DNA, 6596 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggcactgaacgctaatccctttttctatttccgcttctcacaggcacaggaacacaggcacaaatgcacaccacacactacataataaacacacatggaggaacataactggtaacagcgactggtaatccagctttcagcagtatagttgtatgttcttttctcttaaaatttctgtcttattatcctaactttaagagtgctgagacctcaaaggaaaataagttgtgcttaaattgcacagaattttgtttttatcataggtctagttgctggaatctgggaccagttgttgaacaagattcagtattaagccattttaaacattttgccattttctaaaatttaaaaaattttctttttcatggtcatcagttctagtcatggatatttgaaattggacaaccacaagtctgagagatttgaaatttcaggctatgtggcaacgtctttggtacatttcaaaggtctgactaaatcagtctttgggtggcttgaaaattgaggcaagatcacacactgtgtggtttgtggagaccggcagtgtttgtgcatccctgatatcctttgtgttgtaatttatcacccttttgtgtttcacagatctggctttgattggctgatgagtgtctttgtgatcagttaaaagtggtagaatgtatgtacgtggacttgcctaaataataactttaggagaagacaatctgaaacatttgtgaccttgcacagatcagcaacagacttttaaaaataaattatttttattttaaggtttcataatagtaattacattcttaactttgtatgtcaggatgaagaagagaaggatgatggtgaagctaaagaaatttctacacctacccattggtctaaacttgatccaaagacaatgaaggtaactttgataaggatggattttatttatttttttcaattaaaaagttctttctgagacagagtttggctctgtcgcccaggctggagtgtagtggcgcgatctcggctcacttcagcctctgcctcctgggttcagtagattctcttgcctcagcctcctgagtagctgggattacaggcaccctgccaccacgcctggctaatttttctagttttagtagagacaaggtttcagaatgttggccagtttggtctcgaactcctgacatcaggtgatccacctgcctcagtctcccaaagtgctgggattacaggcatgagctgccgtgcctggccaattgtatttatatacatataaattaaaaggcaattttataaatcagtacagccaatatctgttgaatgcctataatatatgagggtctatagtgtaactatagtaactttgagaactaagaaggtaggatttctgcactaagtaacttcaaggggatgggactataggcgcctgccaccacgcccggctaattgttttgtatttttagtagagatcgggtttcaccgtgttagccattatggtctcaatctcctgacctcgtgattcacccgccttggcatcccaaagtgctgggattacaggtgtgagccaccgtgcctggccgtaatttggtttttaaaatagaatatttttttgagacagagtcttgctgtgtttcccagactggagtgcagtggaatgatcttggctcactgcagctttggcctcctgggttcaaatgattcttgtgcctcagcctctcgaatagcttggattacaggcacgtacaaccatgccaggctaatttctgtatttttagtagagatgggattttgccatattggtcaggccggtctcacactcctggcctcaagcgatctatccacccccgcctcccagagtgtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460685 - DNA, 4633 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460686 - DNA, 2833 bp, Homo sapiens
agcctgcgacagagcaagactctgtctcaaaaaaaaaaaaaaaaagaaaagaaaactttgatcttatatggcccaacaggaatggatcatgatggaggcagaaaaagatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460687 - DNA, 2691 bp, Homo sapiens
tctagcaggatcccctgacttggacgcctgatcccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460688 - DNA, 3615 bp, Homo sapiens
tctggaatctcagttgacagtgttcccttcttcactttggagccctgagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacatttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggcactgaacgctaatccctttttctatttccgcttctcacaggcacaggaacacaggcacaaatgcacaccacacactacataataaacacacatggaggaacataactggtaacagcgactggtaatccagctttcagcagtatagttgtatgttcttttctcttaaaatttctgtcttattatcctaactttaagagtgctgagacctcaaaggaaaataagttgtgcttaaattgcacagaattttgtttttatcataggtctagttgctggaatctgggaccagttgttgaacaagattcagtattaagccattttaaacattttgccattttctaaaatttaaaaaattttctttttcatggtcatcagttctagtcatggatatttgaaattggacaaccacaagtctgagagatttgaaatttcaggctatgtggcaacgtctttggtacatttcaaaggtctgactaaatcagtctttgggtggcttgaaaattgaggcaagatcacacactgtgtggtttgtggagaccggcagtgtttgtgcatccctgatatcctttgtgttgtaatttatcacccttttgtgtttcacagatctggctttgattggctgatgagtgtctttgtgatcagttaaaagtggtagaatgtatgtacgtggacttgcctaaataataactttaggagaagacaatctgaaacatttgtgaccttgcacagatcagcaacagacttttaaaaataaattatttttattttaaggtttcataatagtaattacattcttaactttgtatgtcaggatgaagaagagaaggatgatggtgaagctaaagaaatttctacacctacccattggtctaaacttgatccaaagacaatgaaggtaactttgataaggatggattttatttatttttttcaattaaaaagttctttctgagacagagtttggctctgtcgcccaggctggagtgtagtggcgcgatctcggctcacttcagcctctgcctcctgggttcagtagattctcttgcctcagcctcctgagtagctgggattacaggcaccctgccaccacgcctggctaatttttctagttttagtagagacaaggtttcagaatgttggccagtttggtctcgaactcctgacatcaggtgatccacctgcctcagtctcccaaagtgctgggattacaggcatgagctgccgtgcctggccaattgtatttatatacatataaattaaaaggcaattttataaatcagtacagccaatatctgttgaatgcctataatatatgagggtctatagtgtaactatagtaactttgagaactaagaaggtaggatttctgcactaagtaacttcagcctcctgagtagctgcgaccgcgggcatgcaccaccatgtcctagcttttttttttttttgggatattaaaggggaaaacaggcctccccccaggccccccaggctggctctca

SEQ ID NO: 460689 - DNA, 1790 bp, Homo sapiens
tgcggtgactctgcaggatctcgatcacgtgtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460690 - DNA, 1721 bp, Homo sapiens
aggattcactcctacgagcgcatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctaacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaatt

SEQ ID NO: 460691 - DNA, 1562 bp, Homo sapiens
tgccggccatgggggaagggggcgccgcggcggcgctggtggcggcggcagcagcagcagcagcggcagcggcagcggtggtggccgggcagcggcggcggcggctagggcgcagggcgcgctgccatgggcctggccgggctgcaggcgggaagatgtccaagccctgcgcggtggaggcggcggcggcggcggtggcagcgacggccccgggcccggagatggtggagcggaggggcccggggaggccccgcaccgacggggagaacgtatttaccgggcagtcaaagatctattcctacatgagcccgaacaaatgctctggaatgcgtttcccccttcaggaagataactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaacgtgggaactgccaaaccaaactgcacgacatcgacggcgtacctcacctcatcctcatcgcctcccgagacatcgcggctggggaggagcccctgtatgactatggggaccgcagcaaggcttccattgaagcccacccatggctgaagcattaaccggtgggccccgcgccctccccgccccactttcccttcttcaaaggacaaagtgccctcaaagggaattgaatttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagctaggtgagtctcctttctccagtggaagagccgggaccttccccctgcacccccgaaatccagggacggggtgtgaggaagatgctgcctcccag

SEQ ID NO: 460692 - DNA, 894 bp, Homo sapiens
aagtgttgctgaggtgactctatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaacgtgggaactgccaaaccaaactgcacgacatcgacggcgtacctcacctcatcctcatcgcctcccgagacatcgcggctggggaggagcccctgtatgactatggggaccgcagcaaggcttccattgaagcccacccatggctgaagcattaaccggtgggccccgcgccctccccgccccactttcccttcttcaaaggacaaagtgccctcaaagggaattgaatttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagctaggtgagtctcctttctccagtggaagagccgggaccttccccctgcacccccgaaatccagggacggggtgtgaggaagatgctgcctcccag

SEQ ID NO: 460693 - DNA, 1623 bp, Homo sapiens
tgccggccatgggggaagggggcgccgcggcggcgctggtggcggcggcagcagcagcagcagcggcagcggcagcggtggtggccgggcagcggcggcggcggctagggcgcagggcgcgctgccatgggcctggccgggctgcaggcgggaagatgtccaagccctgcgcggtggaggcggcggcggcggcggtggcagcgacggccccgggcccggagatggtggagcggaggggcccggggaggccccgcaccgacggggagaacgtatttaccgggcagtcaaagatctattcctacatgagcccgaacaaatgctctggaatgcgtttcccccttcaggaagataactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaacgtgggaactgccaaaccaaactgcacgacatcgacggcgtacctcacctcatcctcatcgcctcccgagacatcgcggctggggaggagcccctgtatgactatggggaccgcagcaaggcttccattgaagcccacccatggctgaagcattaaccggtgggccccgcgccctccccgccccactttcccttcttcaaaggacaaagtgccctcaaagggaattgaatttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagctaggtgagtctcctttctccagtggaagagccgggaccttccccctgcacccccgaaatccagggacggggtgtgaggaagatgctgcctcccag

SEQ ID NO: 460694 - DNA, 1036 bp, Homo sapiens
ttttactcagccatctctagaatgtcatatggtctcccttcaactggaataacaggggctaaaagaaatggcggtcattgttttggactaaggtcatgcactaggccccaacaaaccaaaccaaaccaaaatggagttgcttgtgctaagactttaaggaaacacatagattctagaacagaccaggttttgttttttctcttgcaaatctctataatgaaaatttctaagagcggaggtatctgccccctgaagttcccattaaatcttttaaccaaattcatttcctcttgcctagagaccttcaagcttcagataatcatgcaacaaaggttccagccaattccaggtgaagacaccgccccaatgccatcaagaaactactccacctccactagacagaacaggatgccaagaacctggacaccctccaccattaacaatgcctgtaataccagcactttgggaggctgaggtgagtggatcgtgtgagcccaggagttccagaccagcctggacaacatggcaaaccccatctctacaaaaagtacaaaaattagctgggcatggtggtgcatgtctgtagtctcagctactcagaaggctgaagcaagaggatcacctgagccagggaggttgaggctgcagtgagctgaaatcatgccattgtgctccagaatggacaatggagtgagaccctgtctcaaaaagaaacaaacaaataaaagcaaataaaataattgagatcatataaaccatgttctgtgaccataattgagtcaaattaaaatcaagaacaggataacaagaaatcctccaataacttggaaattaaacatctgattactaaacaatcaatgagtcattaaatactttctgaaatttgtattaagtatctttgtctaacactgagatgacaggtataggcgggcaagaacagtggataagcccttctctactctggcctcctgctgggatggttggggacaatgctctttcacttcctagagggcctctggttttttgagaggaccag

SEQ ID NO: 460695 - DNA, 2536 bp, Homo sapiens
tgcaggcatggagattctgggctccagccacactttcagctccagggctgaggccgcgctgtccctggagggggctttgaccctggtgctagcactggctcaacagctggcactggaaatagctgtatttctgcacctgaagcaggaattgaaaaaggagagaggtgacctcagcatgtgcctgtgtctcaatgagctccagaggctccagctggacaaggacaatgtgcggatgtggccctggtgggatcactggtcaactccttacctgtacacagttatgtccacccagggcctgcttggacacctgcacctgatgttcaccagaggcctaggaatccacttggggcctgggaacctacaggggcctaatgttaccctgcagattggctgtggcctgatgacctactgcatcctgttgctcacctatggcctggtgtctacctggggcttggtgatcacctgggagctggatatcaacctggggcctggattcctcgtagacatctggtgccaggtggatatctggctgcaggaggacatcaggccccaggtggagacccagtacacaggtggacaacaggtgccaggaggacaccaggacccagttggtcatcaagccacagctgaacaccagttccccatgaacaccagtcctcaggtggatactgaactagaggtttacatcagaccccagattgacattcagtccccaggtggtcatgacacctcaattggacaccaagtcctcaggttgataaccaagtcccaggtggacactacgtcaaagatgaacacaagacctaaggttgtcattcaagccccaaatggacaccaggccctagaggacatctgtccccaggttgacatcactctcaaggtgtacattaggccacagatgtacacccaggtccaaggcagacacgagtccccagtaaaactcaaggccccaggaggatactcaagccctaggtggatgcccagaccccaggtgaacatcaagcttcaggtggacatcatgcctcaggtgaacttccgggtcccagcccagctgaacatcaggctgcaggtggacatcaggtcaaaggtgaacatcagtactcaggtggacatcaggctccaggttgacatcaagcccaaggtggacactgaactagaggtttacatcaggccccaggttgacacccaggctcaggtggacattgggccccaggtggacatcaggcctaatgtggacacccaggatcaagatggacatcaggactcaggtggacatctggtgacaggtggacaacaagcctggtgtgtaccttgtccccgggtggtcatcaggccccagttcaacaccagtccctgggtggattcctcggctccaggtggacatccggtcttcagctgaacatcagaccccaggtgaacaccaggttttaggtggacattaggcccctggtggacataaagtaccagtggacatccatgctgcaggtggacacccagcgcccagatgggcatcaggccccatttggacattgaggccccaggtggatatcaggcctcaggtgaacccaaggtccaacatagacatcaggccttaggttgacactcaagcaccagatggactgctgcacctaagcagaaaatagacccctatctggatatctaagatacaggccacaggtgaacactgaactctagaaggtcttcaggccctgtgttgactacctggccccagggggacaccaggcatagatgaacttcaggcaccagctgtacatcaggttccaggcaaatgtcccagccccaggtggatatcaaacctcagatgaacaccaggccccaggtgcctcaccttcccttcatgggctttctgcccgcctttgggtacccctagcgggcccgaggcccaccctggtttggagccagggatgctagtgtccctggggcccagcgcagcgctgatgggaagggacttttgtccgtggggaacccagggcccacttctccgaggtgcctcacctttccttcctcaaacctcaactgcccctcagagatttctgcccaccttggggtacccctagcaggcccgaggcgcacccgaggctcgaacagggtttccagcgtccacagggcccagcgcagggactgatgggaaggcattttcatccgtgggggacccaggcccagcttttcctaggcgcggcttgttgtttttttttttttctgccacaggttcctcacctttcctccctcaaacgtcaacttcccatcatgggctttctgcccgacttggggtacccctagcagcccaaggcgctccctggactcgaaccatggatgccagggtcgccggggcccagcacaggggctgatcggaaggtaccttcatccgtgggtacccaggccccgcttctcaaagctgcggttttttttctccaccccaggtgcctcaccttcccctcattggccttctgcctgctttggggtaacacgagcgggcccaaggcgctcccgggtctcgaaccagggtcgccaggtt

SEQ ID NO: 460696 - DNA, 1412 bp, Homo sapiens
cacagactagtcccttctgccttctgggcaggtcacatctgaaagattatcctctttgaatcagtttgaatgttctagtgaccaggccacacagtttctcttgacatttaaaaataaagcttccagtcttgtcactaatggatttggggtccagtacccttaaaatcacctcagagctgcctgaatccatagactacttgcagaatcactggttttacttggatcaagccatctgagaagatttttatatacctcaacatattaaaggtatgaaaagatcatgcagaaaaaaacctgttcagcttcatctcacatagtatttctgccacttatttcaccacagatactttgttaatatcttggaactcttgtttttagaaaaaagcattggaaatggaggagactgtcaaggacaataataaatgatgaaaactgatcatcaaactccattccacaccagtttgttttcccctctcgcactctctttgtgtaatagaatctgttcccacaggtttggggaatataaaagaagcctacaatcccccagccccccttcccttttccctcctaatgccccagagcagctagtagggtttattgctcttccccaacattggctcctttctatacatggagtaagattgatgatcctcattctaaaatgtgaagatccagcatgcgcctttgtcctatgtcccttgagagtgaattggcataagcagcactcggtaaagaggcagcactttttggtacatcaggatttggctgaaataaaaactcaaagcccccacaatattgaaccaccattccagacccagccaaggtttggaacataaagtgagctgaatgaatcagcctgcaggcaacccagagaaagtaattgttcatcctagcagcacggctgcttttctgcttagcatctgaacaagttaatttggaaacacagccttctggaaagaaatggcgcttctctcagcatcccatggattcatgagctccttgaatgcaaatattgcctgatattttcatgattcaaagctcttggagagcggaaaccatgatgaatactcctttatttattccatgtaacactccagacaagagtgagggagaatgggagaaacaagaaatgattacattattgtggatacttttattcaccacaatggaagtctttaaacataaagttgatgtacattaagaggcaagacccagggcatatcatctaaagaagattcctcccacttttcttctgcttacaccaatccatccaaccatacatgaatttatattcaatgtactcaatttattcagtgtataatattgctttgtgaactatgggaaatataaatatgactcagtttttcccctcaaataactgacatgctacttgagcagataacatatttaag

SEQ ID NO: 460697 - DNA, 1339 bp, Homo sapiens
cacagactagtcccttctgccttctgggcaggtcacatctgaaagattatcctctttgaatcagtttgaatgttctagtgaccaggccacacagtttctcttgacatttaaaaataaagcttccagtcttgtcactaatggatttggggtccagtacccttaaaatcacctcagagctgcctgaatccatagactacttgcagaatcactggttttacttggatcaagccatctgagaagatttttatatacctcaacatattaaaggtatgaaaagatcatgcagaaaaaaacctgttcagcttcatctcacatagtatttctgccacttatttcaccacagatactttgttaatatcttggaactcttgtttttagaaaaaagcattggaaatggaggagactgtcaaggacaataataaatgatgaaaactgatcatcaaactccattccacaccagtttgttttcccctctcgcactctctttgtgtaatagaatctgttcccacaggtttggggaatataaaagaagcctacaatcccccagccccccttcccttttccctcctaatgccccagagcagctagtagggtttattgctcttccccaacattggctcctttctatacatggagtaagattgatgatcctcattctaaaatgtgaagatccagcatgcgcctttgtcctatgtcccttgagagtgaattggcataagcagcactcggtaaagaggcagcactttttggtacatcaggatttggctgaaataaaaactcaaagcccccacaatattgaaccaccattccagacccagccaaggtttggaacataaagtgagctgaatgaatcagcctgcaggcaacccagagaaagtaattgttcatcctagcagcacggctgcttttctgcttagcatctgaacaagttaatttggaaacacagccttctggaaagaaatggcgcttctctcagcatcccatggattcatgagctccttgaatgcaaatattgcctgatattttcatggtgagggagaatgggagaaacaagaaatgattacattattgtggatacttttattcaccacaatggaagtctttaaacataaagttgatgtacattaagaggcaagacccagggcatatcatctaaagaagattcctcccacttttcttctgcttacaccaatccatccaaccatacatgaatttatattcaatgtactcaatttattcagtgtataatattgctttgtgaactatgggaaatataaatatgactcagtttttcccctcaaataactgacatgctacttgagcagataacatatttaag

SEQ ID NO: 460698 - DNA, 1971 bp, Homo sapiens
gggaagctctcttttacgttccccagcaccatccttcctggcatggttcactcatttgttagatgtttaccgagtgccctgggggcatctgcattgcccaagattgccttcactccaagctcactaccagccttttctctacagtctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaaggtgcagcctctcccctgccatcccccaccctgggctggttctgcattggtgcgggtgagccaatggatttgggtgagctggtgggaatgaccccagagattattcagaagcttcaagacaaagccactgtgctaaccacggagcgcaagaagagagggaagactgtgcctgaggagctggtgaagccagaagagctcagcaaataccggcaggtggcatcccacgtggggttgcacagtgccagcattcctgggatcctggccctggacctctgcccgtccgacaccaacaagatcctcactggtggggcggataaaaatgtcgttgtgtttgacaaaagttctgaacaaatcctggctaccctcaaaggccataccaagaaggtcaccagcgtggtgtttcacccttcccaggacctggtgttttctgcttcccccgatgccactatcaggatttggtcggtccccaatgcctcttgtgtacaggtggttcgggcccatgagagtgctgtgacaggcctcagccttcatgccactggcgactatctcctgagctcctccgatgatcagtactgggctttctctgacatccagacagggcgtgtgctcaccaaggtgacagatgagacctccggctgctctctcacctgtgcacagttccaccctgacggactcatctttggaacaggaaccatggactctcagatcaagatctgggacttgaaggaacgtactaatgtggccaacttccctggccactcgggccccatcactagcatcgccttctctgagaatggttactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacaggtagaggctggtcctgggctcctgggatctctctaggtgcccaggcccggagggaagcctcactgggttaggaatttctagggcttgcatgaatttacctaagcagctttctgttaccacctgaggcagagctttatgactaaggaagcaactgagtcagactgcatggcagtagatgctagtgcttgttctgccacttccatgccctgtggcattgggcaggttactaaagggagagaaaagtccctctgaagttttgataactgaatctaaaataaatgaacattagacagtgacaggaggagagccattttaattacgtgcatatgcacgggaggcccacattatattagatctgcagaagggtcagatgattgaagcttatacagtttatatatcacttaataatggggatatgttctgagaaatgtcttgttaggtgatatcgtcatgtgc

SEQ ID NO: 460699 - DNA, 1999 bp, Homo sapiens
  misc_feature (1614)..(1614): n is a, c, g, or t
  misc_feature (1624)..(1624): n is a, c, g, or t
  misc_feature (1671)..(1671): n is a, c, g, or t
  misc_feature (1685)..(1685): n is a, c, g, or t
  misc_feature (1691)..(1691): n is a, c, g, or t
  misc_feature (1708)..(1709): n is a, c, g, or t
  misc_feature (1719)..(1719): n is a, c, g, or t
  misc_feature (1723)..(1724): n is a, c, g, or t
  misc_feature (1882)..(1882): n is a, c, g, or t
  misc_feature (1998)..(1998): n is a, c, g, or t
gggaagctctcttttacgttccccagcaccatccttcctggcatggttcactcatttgttagatgtttaccgagtgccctgggggcatctgcattgcccaagattgccttcactccaagctcactaccagccttttctctacagtctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaaggtgcagcctctcccctgccatcccccaccctgggctggttctgcattggtgcgggtgagccaatggatttgggtgagctggtgggaatgaccccagagattattcagaagcttcaagacaaagccactgtgctaaccacggagcgcaagaagagagggaagactgtgcctgaggagctggtgaagccagaagagctcagcaaataccggcaggtggcatcccacgtggggttgcacagtgccagcattcctgggatcctggccctggacctctgcccgtccgacaccaacaagatcctcactggtggggcggataaaaatgtcgttgtgtttgacaaaagttctgaacaaatcctggctaccctcaaaggccataccaagaaggtcaccagcgtggtgtttcacccttcccaggacctggtgttttctgcttcccccgatgccactatcaggatttggtcggtccccaatgcctcttgtgtacaggtggttcgggcccatgagagtgctgtgacaggcctcagccttcatgccactggcgactatctcctgagctcctccgatgatcagtactgggctttctctgacatccagacagggcgtgtgctcaccaaggtgacagatgagacctccggctgctctctcacctgtgcacagttccaccctgacggactcatctttggaacaggaaccatggactctcagatcaagatctgggacttgaaggaacgtactaatgtggccaacttccctggccactcgggccccatcactagcatcgccttctctgagaatggttactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacagcctgtagnccctggcccntctgatggaagctgggcctcatctcagtagaggggtagaattagggnctgggggggggccngggcgnacctatggggggagggnnccctgtgggncggnncattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctccctncctgtcgttcaatggacgtggtggtggctgttccacacccattttgttgcagttcctgtgagacaggagaggctgagccaagggaactgtgaaggggatgggcaggaggggcttgng

SEQ ID NO: 460700 - DNA, 1367 bp, Homo sapiens
tacaataaaccacattcttttgtaaattgcccagtcttggatatgtctttatcagcagtgcaaaaggaaacttacacacttccatattttcagtcagctcaattagacccctgccttatctcaagaagagagggctttctgtatcccaggttcttgtcttggtgtaccggaagaattggatcacacgtgggcttggggaatgagtacaaggttttattgagtggaattagctctcagcagatgggggagccagaacggagatggttttcccctagagtcgagctgctcagcggcccgcgctctcctctgaccaccccagccaaactctgcgtcattccatgggtggatggcctgccggtgtgttggtgtgctcttccacaggtgtgctcccctcaacatctagccgcttgtgtcttcttcgttgatgtgttcctctcgatgtcaagcagctgtgtctttgcctgctagggtcttggggtttctgtaggcacaggatgggggcctggtgggccagggtggtcttggaaaatgcaatatttggtcatgaaggcaggagtgcttgtcctcacctagcctgggcaacagagcaagaaaaaggaaggaaggaagaaggaaggaaggagaaaggaaggaagaaggaaggagaaaggaaggaaggaagaaggaaggaaggagaaaggaaggaagaaggaaggaaggagaaaggaaggaagaaggaaggaaggagaaaggaaggaagaaggaaggaggaaggaaggaaggaaggaagcatgtacctctccatagggcaggaaacacatggcagctgggttcagcacagcaagcaagagagaatgtgtaagaaaatgctagcaagatgagagccatggtgttttggtaacctaaatacagtttgccttttgtgtttgtggattcctgtgtatggatttaatcaaccactaatcaacagtagagactccaaaaagcggtaaagaagaagggggacaaggactaaaaactacctactgggtattatgtttactatttggccggtgtgttcaatagaagtccaaaccccaggattacacaaaatattcatgtaacaaatccatacatatattccctgaatctaaaaatacatgtatatgttcaaaaaattgtgtctgtactgaatatgtacagattttttcttgtcattatttcctaaacaatacagtataacaactattaatacagtataacaactattaacaacagtataacaacaatacagtataacaactatttaatacagtatactgtattaaacaatacagtataacaactatattaagtttattataaataattatagattattatagtaatctaaaaattatttaaagcat

SEQ ID NO: 460701 - DNA, 1422 bp, Homo sapiens
tacaaccagtagagcagaggtatgcaggtgtccaagaatattctagctgtgaacattcagtgcgccatggacatcaatcagtgtcggcagggttggttccttctggaggttctgagggagaatctgttccatgcctccctcctagcttctaatggttgctggcactccttggctggtagacacatcacatcacatcaccttctgcccccatattccaatggagttctctcctctcctcggactatttttaagatcaaaatcatggcctttttaatcagatggagcagaggacagccaccccatgtgagggggccaggggccaaccgggctgctaacatgctgccatccatcgggctgtggatggcagaactaaaaaagctcatcagcacactaccaccccctctggggctttggggcagtggatatgaggatagaggagacactcctgaagacttcactttctccatttctgtacttgaatttttacaccaagcatacagcttgaaaaaattaaatgagtatgcagtattttaaaaatcaacaaaagcttcacattttaattttcacttgaaaaaaaaacatgagtggtactcagcagaacaacaactatatcgtataagctgcatcagagacaaatgaagatgaaaaaactatcctcctatataactaatctgtgctgtgccccaacaaagcctgctttaaatttccgtgccaattacaacccccattctgtatcaggcaaggaagactcctctacccttgattctggattggaaaggtcacaaggcttagattccacaggaggaggtgaagacatctgcagagtctgtactgcgagctgaagctttatttgcttgtcagatccccaaaaggtccaaatccagtctgcaccaaacaggaaggcttggtgcttggtcatcttggtggtggtcagccactcatcaactcccttttcttggcagaaagtgatgaaatggattaagaagatctcattcagagtatttgcagctgggcagagtttacttggaggatattcaaatccaaggtactccttcagtttctgagctgcatggactatagcttcactgaccacctcacagacgacgggcacctctttgctgtccttcagagccaactgttgcgatgctttctgccccattttctctgcatccaaatatcaaacatgtgaatctggttcagacgtacttctttttcaaagtaaaagttctgcagggaggccacatctgttaatggttcatgtttttctaactctacagcttcctcgggtgtagttaagcatatatacatacagctaaataaacatgttagttctctaaagaaaaaatgaaatcgggcgcacgaaaaaaggtttctctttctttctcccttgtcctcgagtgtctggttatataaaataatata

SEQ ID NO: 460702 - DNA, 1334 bp, Homo sapiens
acttttgagtgctagacttattatttcaaacagacactttttttttgcaaatcaaactttaaatgtgactttattatctctcttccatttttattattgaataagtgaatgaaatattaaactaaattataacttttcctgaactgtttttaaatcataggcagagccagggttttctttttttctctctctctctgtaattgcgacatgaatgtactttgatcccagtaatcattttcaatcaatgggaaaacaaatgaaaaaaaatcccatgctggaatgatgcaaataggtgagcttgcttattagaatctttttttcttttcctcttacaggccactcacataatacatatccaagtcagagaatgctgatataaaccttgcccacctctctcagcccgtctttcttactcagacaatttctgagcagctctttgatgaacacacaatcttcagtttccaggacaaactgagccacagccttccctcctggcagatggctcctcaccatctgacttttgacactgtccaggacaactcccctgatgtctttaggctttcctggcataccaaagatgataaacagacccaggcaatcctctcctattaagttacagaattcttccagcttatcaaatctacttttcttccaggaagactcctctacccttgattctggattggaaaggtcacaaggcttagattccacaggaggaggtgaagacatctgcagagtctgtactgcgagctgaagctttatttgcttgtcagatccccaaaaggtccaaatccagtctgcaccaaacaggaaggcttggtgcttggtcatcttggtggtggtcagccactcatcaactcccttttcttggcagaaagtgatgaaatggattaagaagatctcattcagagtatttgcagctgggcagagtttacttggaggatattcaaatccaaggtactccttcagtttctgagctgcatggactatagcttcactgaccacctcacagacgacgggcacctctttgctgtccttcagagccaactgttgcgatgctttctgccccattttctctgcatccaaatatcaaacatgtgaatctggttcagacgtacttctttttcaaagtaaaagttctgcagggaggccacatctgttaatggttcatgtttttctaactctacagcttcctcgggtgtagttaagcatatatacatacagctaaataaacatgttagttctctaaagaaaaaatgaaatcgggcgcacgaaaaaaggtttctctttctttctcccttgtcctcgagtgtctggttatataaaataatata

SEQ ID NO: 460703 - DNA, 1292 bp, Homo sapiens
ggaaacacgttggtctgcgcactcagagccgagtcaaatgtgcaggaagattcccccaaactgaaagaagtaatgaaaagaaaacaaaaaaaatccttaaaaatcgagtgaatcagttcgtagagaattgcagagtggtactcagcagaacaacaactatatcgtataagctgcatcagagacaaatgaagatgaaaaaactatcctcctatataactaatctgtgctgtgccccaacaaagcctgctttaaatttccgtgccaattacaacccccattctgtatcaggcaaggccactcacataatacatatccaagtcagagaatgctgatataaaccttgcccacctctctcagcccgtctttcttactcagacaatttctgagcagctctttgatgaacacacaatcttcagtttccaggacaaactgagccacagccttccctcctggcagatggctcctcaccatctgacttttgacactgtccaggacaactcccctgatgtctttaggctttcctggcataccaaagatgataaacagacccaggcaatcctctcctattaagttacagaattcttccagcttatcaaatctacttttcttccaggaagactcctctacccttgattctggattggaaaggtcacaaggcttagattccacaggaggaggtgaagacatctgcagagtctgtactgcgagctgaagctttatttgcttgtcagatccccaaaaggtccaaatccagtctgcaccaaacaggaaggcttggtgcttggtcatcttggtggtggtcagccactcatcaactcccttttcttggcagaaagtgatgaaatggattaagaagatctcattcagagtatttgcagctgggcagagtttacttggaggatattcaaatccaaggtactccttcagtttctgagctgcatggactatagcttcactgaccacctcacagacgacgggcacctctttgctgtccttcagagccaactgttgcgatgctttctgccccattttctctgcatccaaatatcaaacatgtgaatctggttcagacgtacttctttttcaaagtaaaagttctgcagggaggccacatctgttaatggttcatgtttttctaactctacagcttcctcgggtgtagttaagcatatatacatacagctaaataaacatgttagttctctaaagaaaaaatgaaatcgggcgcacgaaaaaaggtttctctttctttctcccttgtcctcgagtgtctggttatataaaataatata

SEQ ID NO: 460704 - DNA, 475 bp, Homo sapiens
  misc_feature (7)..(7): n is a, c, g, or t
cctcagnatcatcgcttgaactgtgcttttgaacgatctcataccatgagctcgagctagatacgactcactttacttggaggatattcaaatccaaggtactccttcagtttctgagctgcatggactatagcttcactgaccacctcacagacgacgggcacctctttgctgtccttcagagccaactgttgcgatgctttctgccccattttctctgcatccaaatatcaaacatgtgaatctggttcagacgtacttctttttcaaagtaaaagttctgcagggaggccacatctgttaatggttcatgtttttctaactctacagcttcctcgggtgtagttaagcatatatacatacagctaaataaacatgttagttctctaaagaaaaaatgaaatcgggcgcacgaaaaaaggtttctctttctttctcccttgtcctcgagtgtctggttatataaaataatata

SEQ ID NO: 460705 - DNA, 1230 bp, Homo sapiens
cggctctttataaactgtgagagggctgtgcatatgaggggctgttactaccactgctcattcattgggtgatgacatgcattttggtgatgtctaggtattttatgtgtctctgctacaggcagctcttcctctgcccccttcagctgaaattgtctaagaactcattcttggcgttcactgcaagctataagctctgcaagtggtgaccccgacgtgatcgccttgaagttacgcttgaaggaggaaaactcatcaattttcggggaatcccgcctttgtttcccaggctctctgagcacgatgtctgcagctcccgccagcaatggagtgtttgttgtcatcccgccaaacaacgccagtggcctctgcccacctccggccattctgcccacatccatgtgccaacctccagggattatgcagtttgaggagccaccgctgggggcacagacaccaagggccacacagccacctgacttgcggcccgtggagacattcctgacaggagagcccaaagttttggggacggtgcagatcctcatcggcctcatccacctaggctttggcagcgtgctgctcatggttcgccgcggccacgtgggcatcttcttcatcgagggcggcgtccccttctggggaggagcctgcttcatcatctccggatccctctcagtggcagccgagaagaaccacaccagttgcctggtgaggagcagcctgggcaccaacatcctcagcgtcatggcggcctttgctgggacagccattctgctcatggattttggtgttaccaaccgggatgtggacaggggctatctggccgtgcttactatcttcactgtcctggagttcttcacagcggtcattgccatgcacttcgggtgccaagccatccatgcccaggccagtgcacctgtgatcttcctgccaaacgccttcagcgcagacttcaacatccccagcccggcagcctctgcgccccctgcctatgacaatgtggcatatgcccaaggagtcgtctgagtagcagatgtggcacctgcgggtggagtccagccttttccctctgggcccagcctctccccacccccaccttgttcatcaggggccagccccatcccagctgccctccctcaccacatctacacatactccggcatctgagtgaagtgtccccagggacatctctcccacactttccccagtgctttctttctaaaagacacc

SEQ ID NO: 460706 - DNA, 943 bp, Homo sapiens
cggctctttataaactgtgagagggctgtgcatatgaggggctgttactaccactgctcattcattgggtgatgacatgcattttggtgatgtctaggtattttatgtgtctctgctacaggcagctcttcctctgcccccttcagctgaaattgtctaagaactcattcttggcgttcactgcaagctataagctctgcaagtggtgaccccgacgtgatcgccttgaagttacgcttgaaggaggaaaactcatcaattttcggggaatcccggctttggcagcgtgctgctcatggttcgccgcggccacgtgggcatcttcttcatcgagggcggcgtccccttctggggaggagcctgcttcatcatctccggatccctctcagtggcagccgagaagaaccacaccagttgcctggtgaggagcagcctgggcaccaacatcctcagcgtcatggcggcctttgctgggacagccattctgctcatggattttggtgttaccaaccgggatgtggacaggggctatctggccgtgcttactatcttcactgtcctggagttcttcacagcggtcattgccatgcacttcgggtgccaagccatccatgcccaggccagtgcacctgtgatcttcctgccaaacgccttcagcgcagacttcaacatccccagcccggcagcctctgcgccccctgcctatgacaatgtggcatatgcccaaggagtcgtctgagtagcagatgtggcacctgcgggtggagtccagccttttccctctgggcccagcctctccccacccccaccttgttcatcaggggccagccccatcccagctgccctccctcaccacatctacacatactccggcatctgagtgaagtgtccccagggacatctctcccacactttccccagtgctttctttctaaaagacacc

SEQ ID NO: 460707 - DNA, 1977 bp, Homo sapiens
gtgagtctgtctccgttcctgccagggctgcagaaaggggcctctctctgagtcgcggacttgggccctgcagtgagctctgaaggacgctgcctccctccttctaagtcgcagacgtgggccctgcagcgagctctgaaggacgctgcctccctcctgaagttgcagacgtgggccctgcagcgagctctgaaggacgctgcctccctcctactgaagtcgcagacgtgggccctgcagcgagctctgaaggacgctgcctccctcctgaagtcgcagacgtgggccctgcagcgagctctgaaggacgctgcctccctcctgaagtcgcagacgtgggccctgcagcgagctctgaaggacgctgcctccctctactgaagtcgcagacgtgggccctgcagcgagctctgaaggacgctgcctccctcctgaagtcgcagacgtgggccctgcagcgagctctgaaggacgctgcctccctcctgaagtcgcagacgtgggccctgcagcgagctctgaaggacgctgcctccctcctactgaagtcgcagacgtgggccctgcagcgagctctgaaggacgtgcccctccttcacagctgggcttctgtggccgttgttgatcccttcattccatcccttcattccatcccttcattccatccctctctgcttcaagcccagctctgctgtggttccccgaaggaatcatggcagtttgagatttgcgtttccagcacttctgctttaagccagactgcagaggctgacgcccttgggaatcataggtttcctccaccgaggaaactttcaccagaattgtggcctgagtggtggaaggctaaggttaaatataggtatatttgtgaagacggcagatagtggatgtccgctggctgagatggtgatctattctgagatctgggcgactgcggtggggcacggagagcaaccgctgcctggcggagactttgatgtgcggctgaggcctggcgaggaattttatcgtcaggcatcagctgagataggaacgctgtcagtcgagaattttcacattctagaatacgcattcaccccagacattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtaattctcaaactatgtgttatttatgtaatctgatacataatctctttcactgaaatcttgtgatccattctttacctttccattttaataatggttaaaatatttgaaacatttactagtattttttattttatacacactttcttatactacccatcaaaatataatacagggagctaaacccgtttaactggtttgactcatactcttaagcactttgctaaaatagtgtttgtgagtatttcattaaaaacaaatccgtgggccgggtatagtggctcacacctgtagtcctagcatgtggggaagctgaggcaggagaatcacttgagctcagaagtttgggagcagccaggacaacagagtgagaacccctctgctacaaaaaatagaaaaaccagctggggcgtggtcgcgctcatgtatagaccagctgctggagagactgagctgggaggatggcttgagcccaggaggccaaggctgcagggagctgtggtcgcaccactgcactctagcctgggtgacagagcaagaccccatatcaaaaaaaaacggccgggcgtggtggctcacgcctgtcatcccagcactttgggaggctgaggcgggtggatcacaaggtcaggagatcgagaccatcctggctaacatgatgaaaccccgtctctactaaaagtacaaaaaaaattagct

SEQ ID NO: 460708 - DNA, 609 bp, Homo sapiens
ccttacacgactatgacacgcctatgtcgacctctcgtgtgacaacaaacacagtgtatcgcgttaaagacaagcaccccagccttggttgtaagtacgtgtcatcacactccccactcataaaaccaacaagatgccgaggagttgataccagtgccctagcatttccttgttcccttgctgggaagctgtgtagggatccttataagggttattccctagatgtctgggtgagctcgagggagaagctgagccctggcactactctctcctgcagcgtcactggtgtaccgcctgccccagtcgtgggtggggcccaaactgccctggaaactcctccatgcagccccgcacctgatggcttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggtgcgcagcctcctaaaacctatccacgtcttttttggagccgccatcctctctctgtccatcgcatccgtcatttc

SEQ ID NO: 460709 - DNA, 908 bp, Homo sapiens
agaaaggaggccatctaaaaaagcgattggtgttgaaaagttgctgctcccgtcctagcagcacaactcttcacttcatagtaatgggacgatgtgcattttgtaagcactttggagccactatcaaatgctgtgaagagaaatgtacccagatgtatcattatccttgtgctgcaggagccgacacctttcaggatttcagtcacatcttcctgctttgtccagaacacattgaccaagctcctgaaagatcgaaggaagatgcaaactgtgcagtgtgcgacagcccgggagacctcttagatcagttcttttgtactacttgtggtcagcactatcatggaatgtgcctggatatagcggttactccattaaaacgtgcaggttggcaatgtcctgagtgcaaagtgtgccagaactgcaaacaatcgggagaagatagcaagatgctagtgtgtgatacgtgtgacaaagggtatcatactttttgtcttcaacgaattatgaaatctgtaccaaccaacggctggaaatgcaaatgaataccgaattggaaaaacagatttctaatgaggctgatagtgaagaaatgaaaatgtcttctgaagtgaagcatatttgtggcgaagatcaaattgaagataaaatggaagtgacagaaaacattgaaaactcagtcttaataaaacttacatatttgaataaagtgtcatggccactgaaagcaagcatggaggtatagctgtacagcagaggtcttaaactgtatactccatggacctgactgtggcctgggggttggggacccctgctatagaggattcagatttaaattcagaagttagaatgaaaaagaattatattctttatctaaatgatttcacagttaactgagagaaagtcagtat

SEQ ID NO: 460710 - DNA, 704 bp, Homo sapiens
ctagaggatcccggttcactttctacactgaccaagctcctgaaagatcgaaggaagatgcaaactgtgcagtgtgcgacagcccgggagacctcttagatcagttcttttgtactacttgtggtcagcactatcatggaatgtgcctggatatagcggttactccattaaaacgtgcaggttggcaatgtcctgagtgcaaagtgtgccagaactgcaaacaatcgggagaagatagcaagatgctagtgtgtgatacgtgtgacaaagggtatcatactttttgtcttcaacgaattatgaaatctgtaccaaccaacggctggaaatgcaaatgaataccgaattggaaaaacagatttctaatgaggctgatagtgaagaaatgaaaatgtcttctgaagtgaagcatatttgtggcgaagatcaaattgaagataaaatggaagtgacagaaaacattgaaaactcagtcttaataaaacttacatatttgaataaagtgtcatggccactgaaagcaagcatggaggtatagctgtacagcagaggtcttaaactgtatactccatggacctgactgtggcctgggggttggggacccctgctatagaggattcagatttaaattcagaagttagaatgaaaaagaattatattctttatctaaatgatttcacagttaactgagagaaagtcagtat

SEQ ID NO: 460711 - DNA, 2856 bp, Homo sapiens
  misc_feature (1)..(2): n is a, c, g, or t
  misc_feature (8)..(8): n is a, c, g, or t
  misc_feature (12)..(12): n is a, c, g, or t
  misc_feature (14)..(18): n is a, c, g, or t
nngaagtngagntnnnnnagaaagttgggtgagttcagttccagggcttcggaggtaggcagggcataccaggacagggagccaagttctgagcagaaggaaccccccgaggaggctgagcctgtggcggcagctgagccagaggtccctgagaacaatggaaataactcgtggccccacaatgacacggagattgccaacagcacacccaacccgaagcctgcagccagcagcccggaaacaccctctgcagggcagcaagaggccaagacggaccaagcagatggacccagagagccaccgcagagtgccaggaggaagcgcagctacaagcaggccgtgagtgagctggacgaggagcagcacctggaggatgaggagctgcagccccccaggagcaagaccccttcctcaccctgcccagccagcaaggtggtacggcccctccggacctttctgcacacagtgcagaggaaccagatgctcatgaccccgacctcagccccacgcagcgtcatgaagtcctttattaagcgcaacactcccctgcgcatggaccccaaggagaaggagcggcagcgcctggagaatctgcggcggaaggaggaggccgagcagctgcgcaggcagaaggtggaggaggacaagcggcggcggctggaggaggtgaagctgaagcgtgaggaacgcctccgcaaggtgctgcaggcccgcgagcgggtggagcagatgaaggaggagaagaagaagcagattgagcagaagtttgctcagatcgacgagaagactgagaaggccaaggaggagcggctggcagaggagaaggccaagaaaaaggcggcggccaagaagatggaggaggtggaagcacgcaggaagcaggaagaggaggcacgtaggctcaggtggctgcagcaggaggaggaagagcggcggcaccaagagctgctgcagaagaagaaggaagaggagcaggagcggctgcggaaggcggccgaggctaagcggctggcagagcagcgggagcaggagcggcgggagcaggagcggcgcgagcaggagcggcgcgagcaggagcggcgggagcaggagcggcgcgagcaggagcgacagctggcagagcaggagcgtcggcgggagcaggagcggctccaggccgagaggtgagggacctgctggcccgcctgcctgccttccatgtgtgtggaagagagacggtgtgaaccttgcctggacacagccccacctgcatgtgacggtttgcaggtgctttccttggcaccaaacccagaggcccacctgaatacactgcccattggctatgggagatccaaggagctcttgctgggtcctcagggagctgcaggagcgggagaaggccctgcggctgcagaaggagcagctgcagagggaactggaggagaagaagaagaaggaagagcagcagcgtctggctgagcggcagctgcaggaggagcaagagaagaaagccaaggaggcagcaggggccagcaaggccctgaatgtgactgtggacatgactccgcaagggcacagggcccctcccaagatcaacccagataactacgggatggatctgaatagcgacgactccaccgatgatgaggcccatccccggaagcccatccccacctgggcccgaggcaccccgctcagccaggctatcattcaccagtactaccacccaccgaaccttctggagctctttggaaccattctcccactggacttggaggatatcttcaagaagagcaagccccgctatcacaagcgcaccagctctgctgtctggaactcaccgcccctgcagggcgccagggtccccagcagcctggcctacagcctgaagaagcactgaggctggcctgcggccttcttggcagcctcgcctcctgtccatgtctatctgtctgtctgtcggtctctgtcttggtctgttgccctccttcttggcatgccattgtggagggcttggccaggtgtatataaacgtcctctgtgctgggtgtttctgctgcaggtggcaggtggccccaggcctgtttggaggatgggctgggtgggtgggtggggaagaaatgggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaaggggagtttgttcattgggaaagacctgggtcttgacacggccctgccacttagtcccctaccctctccattccccaggctccacccgtgctgctcaggtgcaaatggacttgagagcatctatgtgctggtgaagcatgaggtctgagtagaaaaggggtatcccttgagaccaccttgggaccagtgcttgcaagcagcgagatatttccccagcaaaaccaggcagctgctaattaaatgcttagaaccaatgaaagctggctgtggtcctgcctgtgagctgcctactgctgccttctgaatgcatatatctgctactgtagccccgggttgtcaaactatggcctgtgggccaa

SEQ ID NO: 460712 - DNA, 860 bp, Homo sapiens
tgcaacatagaggtcacatgcctgctgtggtattatttaaagcccttatggtattttcattctggaaaatcttttttaaatgttcatttttttcattcatttgcttaaaaagaagtattacactactactttgtgatgaaaactctgctattccatcaaatttaggctttacatattttttcatgaagactgaagatgatgcaaggctgtttgaacacctccagggctctgatgcttggggagccctgggagacagcatctgggagaagctgcagcaaggcctgagaagactacagtgtatctggaaagtggctgccccatatactcagcaacagctcagccaatgcctgctggagaacaaatgtgaaaattctggggactcccagaaatgctctggaaattgggatttgcagataagtggggagcctgagagccggccgggtgctgggctcctggctatccctgtgatggtagctcagcgagatctggggacctggcgctgagcgcgttgccagccgggatcttcctcttcatctaggcctgggcgctggcgtgagaactcggactgggtcctggacgagcgccccccgaaactccttggaaccttgaacaagtaaaatgcaggaagtttgctaataaagacatcaccaaaggttaaagagaaaatcatctagaggaaatgctggcagtatggcatgtgttctttaacaaatctctacagcagattctctcgttttagggactatccagattatgattggcatctttcacattttcatgtggtactttctattggttttgtatatgggacaaattaaaggagcctttggaacgtatgaacctgtaacttacaaaacagg

SEQ ID NO: 460713 - DNA, 667 bp, Homo sapiens
acctctatcacatcctcaagcttcggccaaacttgtagtaatcatgaccattgtacacaatctcctttttctgcggtattggtgtgatgcaggctctccctcttcctgtccccatctgcaggttgaggctcccacagctgtggccttgacttattggacatctccctcaaaggctccctggaatacagacatgaaatcacgcaatatcgcaattgcaacattgcaaatgcctcagggaataaaagtatggaaatctttgtcctctgaaaatgtgtgcctggataccagaggcaccataacagacatgctgtgtcatgaggtcacaaaggtggtggcaagacaattaacgttgaggctgggggaaaagacaccagaagaagaaggcaacaacaggaagaggagaagcagcaattcagaaagacacactttcttcttcgcttgccctgaatcggatagtgcttgaagcctggatttgtcagcagccacacaagccagccaacgcagcagagaacagggctgaggacagagaaaaactgatggccatgcttaggccatggatcaaggcatgcccaaaccagccccaatcttgtgcttctccgttatgccagtcaataaattgcctttgttgttcaaaactgtatagttggtgtttgatcatttgcaacac

SEQ ID NO: 460714 - DNA, 1463 bp, Homo sapiens
ttagaatttggaatcttattgctaaagacttgtttgagtaagtatgggctgtgttgaaacccctgaaataggactatataggtgcaagttattggttaaagatttaggtagctttcacaggagaaaagggctattagaaggaaacatgaattcaaagatgcactttctaaagaggtgtcccacctattcggaaggacctcttggtgctggagcctttatgctagatggccagtccaggttaagttatggttgtgctaaaaaggccaagcaggaccagaaaggcacctgtaggaaagaggaactaaggattcctaaattcaaacttggtctttcagccattgtgaagctaggaacaagaacacagaacacagaactggcccagagtggtgaggttgctcaggttgcagagggcctgtcatttcagaggatggtgactgggtagccagctgtgaggcaaagcctttcaggagcaaaggcaagacctgaagaagggagtgtggacggcagcacttctgtggaggaagctggctctaaaggctatttgaggaaggtacctcacataaatgaactcttgtgctctgaaagaaaagtttgttcttgccctgcctcaaggtcagcagaaagaaaatattctcttacaacatggcatgtaagaaatagagaaaagaggaaagaaaatctatttgaaataaagcaaccatttctcatgatgaaaaatctgcacaattactttggacgcaatatattgcacctgtttctggctgatgcctcctaaattaggcttttaagtgatcaaatactgcacgtttcacacataccctaaaagtagtatgaaatacaagtgactgggataaaacataagtaaactaggaatgaaaatgtcatttttttctataaaattgaaataattgctttgggaacagttttctatttgatagctacatgagtatatctatcttgacctgtcaactttttttgagaaataccatttttaatgataattctaaatacaaatgtggttaaagtccagggagaaaatgtgccagtatttggacataagataattaaggggtaattagggttaaatgatgtcattagggtgggcactaatctaatatgactggtgtcctcgtaagaagagatgaagacacagatcaacataaagaccatgcagaaacacagggagagggggagaggagggtcatctacaaaccaaggagagaggtctcagaagaaaccgaccctactgacaccctaatctcagacttctagcccttcgggactgtgaggagataaatttctgtttaagccacatagtctgtggtactttgttatggtagccctagacaactaaaacaaaaccacagcattcattcattcaacaaatagttattgagcctttatatgagctaggcactgttataagaccatggggaaataggagtaaacaaaactagtttaaa

SEQ ID NO: 460715 - DNA, 5169 bp, Homo sapiens
ggcccagccaagatggcctggggcagctactacccaaagtgattcccggaaagagtaggtgggtagcggggtccctagggcactgagagtgagagggcatcagaggttataggttagggggaaagtgaggcaggggaaaggggcagcctgtctctcctctgcaccagctccttagcttgtcttctctcttccctcttaaaagagggctctggttagcaaagaaagagtttccacggcatggagctgtgcactctgctcctgtagcagcctgctggtgtcgtcagagtgggcatagttcctgtcactttactggaacttggagtgacacgtctgaagtcagctactgacggggtggtgcgtaacggcaaaagcaccgccggacatcagcgctatctctgctctcactgccgtaaaacatggcaactgcagttcacttacaccgcttctcaacccggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacccagggttgtgtgataatagagttgattgttccaggcactgccgtggcttttttacacattgtccgatctaatcctcaaaacaattgcctgaggtagggactgttttcctcatcctatgattgagggaaatgagacttaagttaatcaggcccaacagcacacagcttttaggcatttagattgcttctacttttctcctaaaatacataaaaatatttcactttttaaagaacgattttcttaaattcctggaactgggattcctagatcaaagaataagcacatttaaaagtgtattttggtggactcttctatttaccttatattaaaaagcaaaaaagttatggtgtggtgaggcggctgcaggccagcttgggtgaggtccctgcttctgaccattgtgcacagaaggctgcctccttgctgctcacttgcttcctggcggacagtacaatcagcctcttgtggtttgccagtgaaatttaagtactgggtcagcctttccagtgcttctctgtctgtcaggaagttcatctgtgaatctaacctaaatctcatctgctgcattttaaatcctcacctgctgtcgcttcccctcagtggagtggaacagagcaaagctgcgcactgtctgcaggcagccttgttcacctctctcccgtgaccactgcgacgccagctgccagccttatgttaccctggaggaaatttgagggtctctggctactgctgtcgagactgggagggcagtccttgcatcgagttgctgctgataacaccaggtagggtttctgaatcctagagtgcccatgctgtgcgggccagcatctcccgcgccctctgcagaacttgtgggggcaattagcattcagagtggcactctcctctggatgctgtgggtctatcagattcattctttgggggaaaaaaaaatgtggctggagcagggactaattgcatttcagccccaattgcattggccaagcggtaaatgtacagtgaaggaagatggccaggcaaggaggggcgtttgagaacattctggtaataggaaatccggctgtcattgtgggagggaaaggtcccaccctgggcctcccacccttggcataaagcagctgtgccctctaccagaacagccttggccacctttcttagcgtgggtccattgttgagagctgacagctttattatggagcagtaggatgttaatttggaagagaaatgaatatagctgcaacttcatgggcagcaagaggccccttgtgtcccctcacttaggcattttagagctggctggcaattggccagcagggtggagcgagtcacacaggaaagagtctgggaattgagtccttgcagcacctgtgagaatatctgagcatggctagaagcccagaggagatggagcctgaagcctcccggggacccagtctgggctgactgacctccagctccctgccctcccctctatcacagcacctggagatcctgccttaatgttaactgcttgatgctcccagcttgtccttggaagttctacacacgtaagatgagatgccttgttttacactttgctattccctccttcagtgtctcgtacagtgtaggtcttgattgaaatgaagtcagcatttaagaggcaaaacccagtggttttgggcactcagtaaagaagctagttctctgctcttcagctcccatttaaaatatccatgtcagagtattattcatccttttgaagaggggaagctttttctgtctccctttatagttataccaaattctctttggtgctgaatgtcactgtacttttagcttagtgggttgaagttggaggccaaagtccccactgcaaggccttagcccagtgagtgccacccctggctgcacattagaatgccttggggagcttttaaaaaatatgtctgggacctagtgccagagattctgatttatttgatctggactggggctctggcatcattttagaaacattccactgaataaggagtaaggtgtgtctgccataccctatcagcagtttccctttatgggaagatacatagtagaagcctgtgacatctgcagcagtaggttactccacatcctttttggaagcagaaagggtaaagtgccaaatgagagcattgcatcagggctttcatgtgagggattggcttgatgggaagcctccaaagatgtatcttgtgcccatttctgttaccagggtgtgctctggctgtgtcgctctgcttggtaattaagcaggtgccgtggacgggatgaggatgctttggtttaggttaaagataaaaaggaagaagcaggatatgagtgtgtctctatttgattcatcagcacagggactggattaacttttttctcaagcttttggagcaggtgggagagcgtggggaaagagctctgagtgaattgaggatggcttttcagtttgggtctagaagacaggtcaaagaggtgggtgcctgcagtgagtgttcaaccctgcatggctctctgttatccccgagacctcacttctgccagtttcctcttgaatgttgtagagacctctttacagaggagtcaataagggacaagactactgccatgagtgaataagcaccttggctgtgtgtgtttggatttggccgtgggttcctttttgtgactgagaaagattgcactcctttttggctaatgcacacgacttgatgtcctgagtcttaccccttctccgatgccctctggggtgtttgtggttggagctttgttccaagagtagcctcccaggttgaagggctgtttttgtggttgcagctgccccttagcttctgtctcatggctggcctgctccctggccctgtcagccttagagaagttgaagctcccttgagagaacccctgtagttttcccacaggtgaggaggcctgcgggttaacacctggggtgctgatgatgccattccccaaactggcaaatcctgcttagaaaaaagatacacacattttgatttcctcgtgctgtttcaaactgcaatttgctaatcacctataacagattcctcttgggtgcttgttaaaaatgcacaatccctgggaataaaaccgaggaatttgcattttagccaggatgccaggtcatcagatataggaatgtttcagaatcactcagttaaaaaatgtcacatcactcttgctttacagtcgggaaatgtgacagagtggttaagtgacttgcccaggatcacacagtagattacagctggagccaagcctggaagaactcaaagccaagtccagaatgttatctccacttcatatttgtatggagctttgttctttgtaaagtgtagtccatctttctgctcctctagtttgcttagatggagaatgcccttgttgattttgggccagattattctttgttgtggggggctgtcctgtatattgcaggctgttcagcagcatccctggattttaccccctggatgccagtagtgcttcccagttgtgacaaccaaaaatctctccaggcattatcaaatgtcccctggggggcaaaattgtcccagttgcaacccagttgtcccagttgctttagtgggggaagccgtgttccagggatgttccctagtggtatcccatgacatttatttttatgtttggggacttgtaaaatttgcagagctggcttcttcccagcttcgctaataagctggattacaaacataaatgaagtcacactgaatataagctctctcctcatctttgctttggcttacagagggaaggcataaataagcttggaaagatcactgactttggactccaatctgcaatttgcctgccaccctgggctttctaggtgtgtgatcttgggcaagtcgcttaattttctggaactcctttccttatctgattatgatagaaagaaatgtttgttgtgaatgagaattaagtgacaccttggatgtggaagtgtttataaaacattactcatatattaattggtgctgataaaattcaggtctaattactagcacttgagattttctcaaatttaaaagtgcagaactcagcacagcaattctagacttgtatttggccaagtatattatccttgtcatcttcccataaagttaatcttcccctctcccactttaaatttgatctacctcttcttggtggccattgccgtatctctttagggtcattgtctctgcaagattggccattaggttattacctctggcaacag

SEQ ID NO: 460716 - DNA, 5457 bp, Homo sapiens
aagcagtagtatgggctaaaaatcagccccctgtctatgggctaagagatttctagcttggggaccaaggttggacatgacacagaacccattcagtttatcccagtgggtgactgaggaagctctttctgcccatcttagtgcccactgggcagctgagcttgccgggtccaaactcaagcctcagtatcaagcctctgtcttgggtttggggttagaatattccaagccccacagcaaacgaaggcagactcctgctcaaaactttttgatggatttccagtgcatggaggagggaaccagaacggacctcagcatagaaggccccctaagaacagtctctccagtttcagcaaacagagcactcttaactccaatcatgatatccaccaacaccagcttccaagctctctctgcttttgcatcttgccatacccctagagctgttgggtacatagtaatttacaaatatctgtgaataaataagtgagtttaggaaatgtaatgaaaggaatatttaaagacacatcctaaagccaccttaggaagtaagggaagaggagctgatgtagtggaataaatagagagctggcatagagggattgaggtccagaccacctagttccaaagcacagaacaacatgtccagtcttcattccacacacccagtactactagaataacctgggaatttggcccaagtgtattagatggggaaggtcctatttgtcctttctccctgcctctccactggtcatcttagcactttggcccacttgtgtctggtagcttctttatggccagttcctttctcaatggacttgctttatagagaaccattcagaagaataaggtttccttctctgcagccgccgccgccgctgctgctgctgtttaaaggtgcttaacaatgctgagtcatatattagattatgttccagaatcctacacccacagcatgtgaggcagataagctgtacttacccaagaaatgtaaacaccacaatagtccttggttgtcaatctggtagggtcacgaagacctgcctggtatcagtgttttttaaagcaacagctgaaaaagtgacacctaactagtcaaagaacagagttacaagagacatgctgattcaacgaatggagatgagtaaactgaattgcagagagcttagatgacttgaaagagacttgacagctgagcagggagaccatctgtagccacctccctgtcacaaggaagcctgcacatagagacctcccatagagacgaaatatatctacaaaagggtcactgcccttgcaaggaaaatgcgatcccagcacggcctggcgtgttcctggcggcagaaaggactcctgccaggacaggaggagaagttgccgctgagacgaggagacggcgggaagccctgcagatgccccaagcccactgaagccacaggaggggaagggaggaggctgctgtgctttctgtgtaccttgttctctgcccagaagggtcagcacagccaggcagccccgaaacccagtggaggctaaagaaaggagggccctctctcctagagaaggctcagtaggctcccgaggaaagggaaggagcaactttttccgtttgacttcaaggaggagggggaaagggtacagaatcaaaatgtatggcacttgcgattcagttggcttatttctgaaaaaattggggtagattgggcgcccaatgcaccataagcgttatgtgtgtttgtaaacacacacgggggtgtacacaggggtaggggtcttagagagaaaagtaaaaagggaaaagaaggaaagtagcagaggctactttacacataaaagtacataaataagtttacttatgaagaccatggtttcccactaacagccccatcttggtagcagaatgggacaaactgtcacacacgcacagtgaattgtaaatagcagggaatggaaggacaatgctcatatgcattggatgtataataagaatacatatgtgacctacatatgtctgtttaattaggacaagtgtccatccctagtgaagattgattagtcactgtgaccttgtttttgaaaggataatgagagcagatgagacttttgctttaacaaacttacttggccaaaattttaaaagctggcaattctaccttgctaccaatcctgattgatttgttgttgttgttgttgtttttccaactttacttgtctctgatattgaaatgtctaggaactgtaacctatgacatggaagtgctatataatttgttttcaaatttcaagcctctttaactaatgtggatttttattaagcagttgtttgacattcaatgtcagatgggttacaaggaaagctgatgtttagaaggatgtactgtgtgttgggcatcatcccagactctgtcttttaattcgggtcgtaaaacttacgcatctttatacagtagatacgacttaacccaatattttttcaaaagagaaacaagttttataccttgcacaaaaccacaggtggtgaaggcagaatacaaactgagggcctgtctgactcagaagcccacgatgtttcctatcctatctcctcagttaccaaaaagaggttcacagcactggaccagagagagaccttggatgttaactccaccagcctctaattttgcagagaagaatgcgctacagcagaggttaggttacttgcctaaggcttactcagtaaatttggtgatgtagctaaattcatcaccaaatttggctgccactcagtctctaaatcgcttgcctggtgtcctctccaccctcacccccacccctaccccagccgtgccccaggcactatccatagatgaaaagagacagccatcctcagcaccctccagaccagagcaagctgagaacagttgatgcctccccagagctcctgacacaactccagtgctgtggaggaggcccatcccacagagctgctgcaagaagaagatgctgggagctgagctgctccctggcaatcgcctccaggccagctcaagccatgctaagggatgggggtcatagggacaaaagggcattgtgtgtgagagagggagtggggagggagtgtggggaggaatgcactggcaatttcttcctctcccaaagctttcctcgcccagctgtctcgtggcaaaggaaggaccctccctggaggggctggcagcccaccatggatgcctggagactggagctgattgattgtgttattagatttcctccaaaggacagagggcttcatttagctggcattgtgtcacttgctacaatggcccctgagtatatagacgctgccttatgccgttccctttaattcccttcaaatagggacatttaaaaagagtccaataacatttttctgaaaggaacctccacctcctttttttaaagaacagaatcatttgtttccaaaagggggccctccaaaagaagctggaggagcagaaaccattttaatagcatcttctctttgctgaattgtgtcttcattttacactgcggctttattctctgcccctttgacacagccagctgcctttcacgttccagctcagaaacaggctggcttcaggctgtaacaggcaccagcttccaaagccctttctccagatgactcacgttagcttgtgtgagcctgtgagccccacaccacagctcccagacctttgttcctttgcaaagtgcatttaagctccaagtactaaaacagtgtctacctaagtctcctgccttacattggagtgaaataattaattacacagtggagtgtctggttcctatcttgttcaggttcatcctgttatcaactcagcagctggaggaagtgacatcacgtgcccaagctcggctttgaagctggaggtgcataccgagacactgtatgtggtactgcactctggccaggaaacatcacccttggaccatctgttaaactatttaaaaaaaaaaaaaaagttgggacatcagtttcttaactagagtttcaaatcctattgttcaaatggtgagaaaagccttttgtgaattctgctcttagcctggaaggttataaaaggagtggagataagttcctgcaagtgtcttgaaaattaaatccttttatagaaagcataaatatatgtggggctaggtggggggaatgctccactgagcaggctcccatgtaactagtgaagcagatccatttaatgctagtcaccaggatttctttgcccgagtattccaagccctggtctggggctgcttttctactcctatgaaaaagtgctttatcaactgcttatctcaagtttttcttagtgagtaacagctctgggaactctctgtgtggatctgaacagcatgcaaaatcattttacttttaagacaaaagacattagcttcctgtagctttcttagccatctctacctctcttcctttcccacccacttttccctcccctccccttcttccaacccccatggcactaaataaaatgcttagaaaatgaaggccacagctgccctttcttcccattaaaacaatcaagaatgatggtgggtttaatatatttgattagagaaactccaatttggtgcacttgaatcagctgcctttgtcttcagctcccgatggcccgatttcagtggaatgtcctctgctgtccactgccagctcaggctgggagaaaattcagacgctgaaagcattggcttggcatgctcagaaacacggtatttatgctgtagaagatgccaggcccacttcttcctaatcagagggagcgccacttcattaaatcgtggtcacttactggtgaccctcatagttgtagccctggggggcctgtggtactctttagcaatgttaatttttcatggattttattgctttccttcattgatattggctgttgaaattccagcctgaatcctgttcaaacaacccaggagattctggtacccaacttgcacagaggaagttcagagaataataatcacatttacatatggagtctctttcattcaaagaacaaatagaaaactaatggaaaataagaaaatgtgtcatcatttccccacaaggtgttattaaacaggtttgaaatattgcctgggcagccccaaacttgtagggtacttgagaaggaattgatctccttgggggctggaggcttggcaaacacagcttatttgcacttaaagtttatagagatttttaggaagggctctcttgaaatattctaaataaatgtatgctccaagaataagtacaagaatgaattcaggataagagtttaaattcctatcaaagacatattgaaatgctacagagtttgtaggggtttatttgaatatattttaatccctaccatggccaaagtcagagattggagttagatggatgaggtcacaaagactgctaaactcattttctacactttt

SEQ ID NO: 460717 - DNA, 1245 bp, Homo sapiens
taccttgattttgcattcatctgagctattcgcggaactcagtggtgagttttctggtaaaaatggctctagaattacaaaaatttcagttcacagatacttgaaaatgttacattgcaaaaaaactcagtattctaaaactaactgttcaagttgggagacagccaaacaaagattgaaaaccaagcctccggctgttggtaaacccaaggaccctgtgattgtagaagaaacaatcactgtggatccccggcactgtaggggaaccccagaagctgttcagtccagcttccatccttccatcctgcttccgtcctcccgggagaagcagacaggctatgccagcctatgggactctgacacattcactcatttgaaaaggaattcatggtgccagttctgtgacaagctctgtaagatgcccaattctgatgccaaagaaagtcgggagactcgcgagggacttaaagagacagcacagcttttccaggtacaactggtttgctccacgcagggactctgagataaagaaaccaaacaaagatccagtaggaaggagggagtgaatggtgggagagaatgtgacaaaagcaatgttgtgtaacttccaaagtcaggacttaagagatttgcaacttttgctttccctttcttggaacactcctgcttggaattcagtgctatgctgtgataagctccagcctagtagagagcccatatggaaggaaaatgaggtgcttctatcgacagctcacctgagcccctgactgactgccagcaggaactgccaactaggccttgggttacactctgatgatgccaggataatcagaccagcctctgggagaccctccccaccaggcaacagctgtccctcatcctcccagctctgttcccatctggcctggggaagtgagcttaaggatttttccggaaacgaggagaggtcaggatgctgaagtgtttggaaggcatccgacggaatgacggctgaggccctcactctccactgaactctgcttgcggctggggactgctctgtgtctgcacgtgttcgcatttattaaatgtggaggtgcaaaacaaaacaaaacaaaacaaaaaaaaaccagtgagatttctggactgctgatggaatctatcaaatctctcctcctcctcattataaggcaggcccccacatagtagatgcgcaagggtgtccatacccacagggacccagacagcatccgagacttgacttgc

SEQ ID NO: 460718 - DNA, 661 bp, Homo sapiens
ccaatccatttggaaggagatctaaatgcttaattgtccatccttgacagccccctgttgtccttgtagaaccagtccttgggcaaatataatatatgtagacagttggcgtccaccctcaatttacccaatggcattcaatatccctgaacaatgtcaaactaatactacctattggtaccgcgcctctcatttactaaaacatcctgactggttccaccccatcatctccacagggatgacgtacagattggacaggacaactgcttccctgaaggcatcactgatcatgcagaagagaggagtaatgggtgctaatggacataaacaaactgtaagaacaattcatttctggcaccctctgaggatgctactcttaataacagaaagtgtagagctgggtatcacctctgagaaaatgtgttcatgaaaacatccattgtgcaggagtcggaagatctgtcactccccctaagaaattggagtaaatagctcattaaatttacatagcatactaaggtgagagagaaactataaaaatcaagaaagaaggtaaataaacaaaaaggctgcatgtctccaatggaaactgtttaatatgtattaggaagaaaataagttacatattaagcaagaatttaaccataagttgtaataaaaa

SEQ ID NO: 460719 - DNA, 1575 bp, Homo sapiens
ggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacccggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgatgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaaacccagagattcaaccatcccacgtgcagatcaccactttataaaggtagacattgttaccataggaatgctgtctttgccttgtggctggctatgtacagccataggattgcctacaatgtttggttatattatttgtggtgtacttctgggaccttcaggactaaatagtattaaggaagtcgctgtgcctgttagtgaaggggcggtgttactggagacaacgcccctgctcgtttccattagttttaaggactccatttccagtaacgtgctggaccaggttattcagaccacctttcacgtgctgaatgtaaccaaatctattgtgcaagtggagacattaggagaatttggggtgttttttactctttttcttgttggcttagaattttctccagaaaagctaagaaagcaaaagtttttaagtgactgtcagatgtaacaggcattcttgaaccagattcgtgagaatcacaactgtacaccctttctgtatttttggggttttttttccac

SEQ ID NO: 460720 - DNA, 1144 bp, Homo sapiens
ggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacccggatcatgaaggtgttgggaagaaacagaatatatggaacttctggcagcagaaaaacatcaagttgaagcccttaaaaatatgcaacatcaaaaccaaagtttatccatgcttgatgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaaacccagagattcaaccatcccacgtgcagatcaccactttataaaggtagacattgttaccataggaatgctgtctttgccttgtggctggctatgtacagccataggattgcctacaatgtttggttatattatttgtggtgtacttctgggaccttcaggactaaatagtattaaggaagtcgctgtgcctgttagtgaaggggcggtgttactggagacaacgcccctgctcgtttccattagttttaaggactccatttccagtaacgtgctggaccaggttattcagaccacctttcacgtgctgaatgtaaccaaatctattgtgcaagtggagacattaggagaatttggggtgttttttactctttttcttgttggcttagaattttctccagaaaagctaagaaagcaaaagtttttaagtgactgtcagatgtaacaggcattcttgaaccagattcgtgagaatcacaactgtacaccctttctgtatttttggggttttttttccac

SEQ ID NO: 460721 - DNA, 3715 bp, Homo sapiens
agctgcagagcgcaaggcgcgcccactgcgcgtgcgcttcggcccggctcctcctgcgcccccggcccctgcgactgggacttggtacggccgggcggttggcgtcctctgcggctcctgccaggggcgggcttttcaaatcttccctttgaaggagtggcgacggcccggacagttcgcgttggagatggaggggccgagcctgaggggtcctgcgctccgcctggcggggcttcccacccagcaggactgcaacattcaagaaaaaatagacttagaaattcgaatgcgagaaggaatatggaaactcctttctctgagcactcagaaagatcaagttttacatgcagttaagaatctcatggtgtgcaatgctcgactaatggcctatacatcggagctacagaaattagaagaacagattgcaaatcagactggaagatgtgatgtgaaatttgaaagtaaagaacgaacagcatgtaaaggaaagattgccatatcagatattcgaataccactaatgtggaaagactctgatcacttcagcaataaagaacgatcacgacgctatgccattttttgtttattcaaaatgggagctaatgtgtttgatactgatgtggtgaatgtggataaaacaatcacagatatatgttttgaaaatgtaaccatattgtaagtattttttaatcttcagagaataaaaataatttaaaattcttcttttttaaaagaaagttcttattattggttctttggattcattttatgtttaaatgtttaagtgatctttaaatgtttaatatgattttaaaaatcattttgttcagaagaagtccatttctctatctgcagttttctgatgtgaaataaaaatggaaatcttgtaattactattagcagtaaatatttgacttattagatatgacccatttttaaattgttaataaatatagttcagttattaacaaagctatgcatacaacagaatatcctgtaatgttatttgatatagagagaatttaagcataaaacaggatttttatctcatgtaggatatttggttgcagaaatactaaaatagtatagcaactttatttacaagatagtcctgaagtacatgctatataggaagagcactttgaaattttggggtgttctttttcttatggtgcacttctttcatgtacttcaaagcaataaaaaaaaatgggtgatctcagggctgtttttattgtccctgctcttttacaggctcattttattgtggtcataatacagaacaagaaggaactccttgggtagccatagaaatcatttttaactaacatagtttttcctgccctccttcaaaggttctatgtgcctaaatcagtgtgggatttgtattttagacttttaaagacacgatctttagatctaaatgttaatagctactaactattaatataaaaatccatgtgcatggtttttgccattttcagctatggagctagacaggtgagattttagaggcctagttttgccactcacataacattaaaaaaacctatagtaaaccatattttgtagcttctggtccagtgtctcatagtaatagtatagcctggaaaaataaaatgcattgttctgagttataagtagtaattcaggccttcttacaagctgtattgaaccaaaggaatttatttaggatccaaaacatatccccaaatgcttatataattgaggctaaaaaaattacttttttcttggttatctgaatacatttatttccattatcaactattgctagtgaacttttttttctgccaaaattaccagttgatgggcccttttcttcacatcattttgctattgtttgttttgatcatggagacaaaaatcagacttttttttccagggaaagaacaatagaagttactgaggaagacaacacatgatttataattttttgagaattctgtaaatattttaaattgtactaaaaataactgctgacaaatgttctacatgttgaaaaatgtgctttttgttatgatgattgtttttaataagtattcaatatttatgaatctctggtttttctctaaatattgacatttgttagtcattaccaggaatactgcatgtttaaaagttgccaaataataaactataaaaatagctggaagttattcctgggattttttcaaactatagattggccatttatatctttaaaagtctgtgctccattttttaaatctctgaaactgatggatcttccatctgcaagtaacatctgctgctgatggacctcttttgcagtcttaagtatattttattgttagtaacaccaccacagtctttaatgctaaaggtagttcaaaggtagttcgttgtgtctgaaaaagggtaaagccaatcttaacatttgctaaaattgcagaattttgcgtatttatttgataaatatatatctaatacctcctacattccaggccaatactagattaagaacacaaagatcacccagacagcacccattctcaaggagttcatgctttgaagtacatttttcccctgtataaccagatagtaaaatgttatttatagttattaggtacaaaagtgggggagggtcaggggacacagtgacgagtgcactataagtgactctttataaagaagaaatgaaaactaaaggtttagcagattttttttggaagaacagtcatttcagaaaattacacatataaataccttaaaaatgtattaaaggaatgacaaggagaaatagtattggcaacaaaatgaccagggtattttatgctttctttaacatgcctatgtatatattggttaaattgagttaagattgccctagttttgaagctgatatctgtgaaagttgcggtaactctctcaggccatttagatgctaaataaacactgagagattctgtctcattaacatacattaacataaacttattccaaattcttattttttttcccataaaccttgcacttattgaggagattttgcaatcttctcttggctcccctgcagtcttttatttattttaaaaagaaattttattgtgtatatttgaggtttataacacgatgttacaggatacatataaatagtaaaatgttactataatcaaacagattaacatctatcatctcacatagttactttttgtgacaaaagcagctaaaatctatttaacaaaaatctctaacatgatttgattaacattcacctcatgtttttacagtacattatatctctaaacttattcatcctacatatctgctattttgtgtcctttgacctatatctccccatttcctctcccccagtccttgcccatggtaaccactgtttttttctctatttctatggttttgagctcttttttttttaatattccacatataattgagaacacacaatattttcatttctatgcttggcttatttaacttaatatcctccaagttcatccgtgttgtagcaaatggcaagatctccttttttaaggcagaatggttgtccgttgtgtgtgtgtatacacacgtagcttattttctttatctgttttaccattgatggacataccttggcgattgtgaataatgctgcattcttatagtttcttcaatatcttggctattgtgaataatgctgcaatgaacaggggagtgcagataacttcacaag

SEQ ID NO: 460722 - DNA, 723 bp, Homo sapiens
agaccgtgccttatagtagtcccatgtttgatcttacaaggagtctaagtggagatgatgtgaacgccaggcctcgttttctctcctggtgccaacagcaatacctggacatcagaggcagatgcagtcaagggaaggatcataaactttctttggaaagagaccatcttactaccaagccagtcgggggcttggatcttgccctaacagcaactgaaggatttgaggctttttctgaaaaggcagccccaggtcctagggaagatgcacctcctcacaggatgttttttactctccaggaggctcagatcctgattgggctgatgacacgatgcctgcgtctcacaatggcgctttttgtttcaactgtttatgcagttggagttctccatataattaatatgaactatcatttatggggatccttctcagaagaactgctgaatgctggatatgaaagctaatgtctttgagagtcagtggacaagtctgtaacaggggctttgctgctggaaggaaagcgaccaagggtctgatccaaggcagcctggggatgaatacagtcagtgccaccacagcaggaacaggcacagttctgatggctgtggaagtaatatatatctttttaagaagaatttgtatctctacttatagcacatttttttctgtagtaagtactgttgcactaatacaataatataaataggttttatattcaggagg

SEQ ID NO: 460723 - DNA, 1154 bp, Homo sapiens
atctccttagggttccctatactctgcccacactgaatcaatatgtcctttattaaactcttctcctacgacccaatcggggtgtgccctccaccaccctggttcctgcctggactgtggcacacagtgtcctgttcatcttcattgccccaggatccagctcagtgccttccacaccacagagcagtgccaaggacagaagagagagtagatccagccttggccctgctaggctgggcagcctggcaggtagagtcagcagggatagagcttgctttcctgttcacgatcttcagccaagttcagggaggtctgaatactgaggccttcatagccactgcaccccaggtagctcaggagaacctccgagcgcaggagtgcaaaggctggcattcttcaggctctgaggctgtcccttccggtggaggtgaactgcttcttattgatgtggacaagactgtggataaagtttgctgacccctagagaggaagtcatggcccatggctggcagatggaagcctcaggacctgaagatttctcaaagaaagggacctgctgctgacagcaattaatatatgttcacagcttgcagctgaagcctgatgatggctgtaggagaaaggacatcacccagatgacattttgcctccaaagctctggggaccaattgtggaagaactgcagggatattatgttagaatgttcttgtgtctggataggatgagaactgtcttataacaaagtgcagcccccatgtctgagggcatgtttcctgtgtttaggcacttccgaagcagggagcaccttcaaggggcactggccttcccagaaacagtgtttgacctgtgatgatgtcctgggggaggggacctaggaaaagaccttagcctttccataaggcacgattattctcctctatagagcctcaaaagtcaagtcaagtagcaagcacactgtgctccagtctgtggccacagacacacacaaggactggagcaaaaccaaacatagtgtatcatcaccgctgaacccccaggagcccccagatgcttttgaacgtgaaaggagaaagaagctgtcagagatcaggttgaatgtggtgggttaggtgtgcggcattgcctctgggtccctgctttggtttaattaaact

SEQ ID NO: 460724 - DNA, 402 bp, Homo sapiens
gtttctctatgttggccaggctagtctcaaactcctgacctcaggcgatccacccaccttggcctcccaaagtgctgggattacaggcctgagccaccacacctggcctcacctgtattttaaattgagttttactgggtaacagccatggtcattcatttacatattgtcaaaggctgctttcaagctacaacagcagaatttaacagtctcaagaccatatggcctgcaaagcctaaaatatttactggccctttacagataaagtttgctgacccctagagaggaagtcatggcccatggctggcagatggaagcctcaggacctgaagatttctcaaagaaagggacctgctgctgacagcaattaatatatgttcacagcttgcagctgaagcctga

SEQ ID NO: 460725 - DNA, 319 bp, Homo sapiens
cccccatgtctgagggcatgtttcctgtgtttaggcacttccgaagcagggagcaccttcaaggggcactggccttcccagaaacagtgtttgacctgtgatgatgtcctgggggaggggacctaggaaaagaccttagcctttccataaggcacgattattctcctctatagagcctcaaaagtcaagtcaagtagcaagcacactgtgctccagtctgtggccacagacacacacaaggactggagcaaaaccaaacatagtgtatcatcaccgctgaacccccaggagcccccagatgcttttgaacgtgaaagga

SEQ ID NO: 460726 - DNA, 1003 bp, Homo sapiens
agctcccagtgcacagtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggacagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggacagaagtacttgtatc

SEQ ID NO: 460727 - DNA, 1459 bp, Homo sapiens
agctcccagtgcacagtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggacagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaggagccttactctgtggccagcaccaccacaggtccatggggagagctgccacactactgccaatgttcccttaaggcccaagggctcttgaatcaacttctggtgaatgctgcctaccctaggactcacccttcagggttgtgcctgggcctttccaagggctgtgggcagcagcagtaccacctgggaacttgttggaaatgtacatcctcagaccccaacccagaatctactgaatcataaaccccaagtgtagagcccagaactctgtcttttaagaagccctgcaagtaattctcaaaactaaagattagaaaccactgcttttgaatatgtttgtaaagcttctgtagaaatctgataacatcaacacaagtacaaacatatttcaaaattacataggaaggaataaagatgttttaaagattgttggctgcataacctaaattttcattttctttataaaaaatatgttgtgttcaaaattttatagaatataa

SEQ ID NO: 460728 - DNA, 236 bp, Homo sapiens
ccaatgggctgtgtctacagtactatgtaggaaagtgctgcaagagagagcccattttgcctaaacaagaaccacgattatgtaaagttctttctgtcacctctctgaagacctggttcatatctgcagctgcaactctatccctgaactcatctttgaaactacccagagatagactgtcaagagcttcagagctttacaacaggatcttccaagtgccctgagaggtcatgatg

SEQ ID NO: 460729 - DNA, 687 bp, Homo sapiens
ctacaagcacatgccatctgatgtctggctatttttttttttctagagacagggtcttcctttgtgtccagtccagtcttgaactcgtagccttcagtagtccacctgccccagcttcccaaaatgctgtgattgataggtataagccacatgccaggactcctggagtatcttttcatatgcttatttgccatttgtatatcttctttggtgaagtttctgttaatatctttggtctattttttaattatattttttattgtacagttttaagagttatttgtgtatttgggataaaagtattatcagaaaatagtatgaaaatgggagttaaagtcacagcacacattcagcccactgagaccatcactgctgccatggttgaattttacaagccagagatgcagtgccatggccgcaagctctgaatcccagcaaaggatttttttttaatctttgcatttgtattttaacttttatttttttctcttataaagagagcccattttgcctaaacaagaaccacgattatgtaaagttctttctgtcacctctctgaagacctggttcatatctgcagctgcaactctatccctgaactcatctttgaaactacccagagatagactgtcaagagcttcagagctttacaacaggatcttccaagtgccctgagaggtcatgatg

SEQ ID NO: 460730 - DNA, 1182 bp, Homo sapiens
ataaaatatcaggctcttcacagttcttgagaggcacaaagtaggcctgagcctcaagaaagaaggggatggacaagcagcaaatatgaccgagagcagcaaagctaacctgggtcagggttagtgctaggggtagggcagagctgtgtggggtcacagggctctacctggtggaaaaggagggaagaagagaccaggattcaagatacccttttagggatgttacagtgcagacaaagattctggtgcctcacaagatttgacacaagccagcgctttgttgtttttctcacctgttggccagaagattatcttggagcaggaaaaggagccaagagaagcctctgaaggattgtaaacagaagaatgatccaattgtgtttgtaaattaaaaggtcaccctggctgctttgtgggaaatggatctgaatgggtgggaaaagaatgaagccagagaaagtccagtggtaggtagcctggcctcaaacaaatgtcttgcttccacccgccctggggcagaggctgggagatgtgggagagcagcccacttggctcagagggcagcctgccctgcagacagagccctggtgactggctttcaagcccagcgtgggaaggccccaaggaagcacacgaggaagtgggtacatcagcatgagagcaggaaacgttttcattcacagacgctgtggataaatcccaaagagagagctagcaaaagagggagcttttttaagtttaaagaaaaaaaaataataaaaggtccgacaaaaggagccagcacggctggggatcaaggcgaggcgggcgcgcccacaccttgtgggaagcggaggcggccaccgcgtgcaggaagggtctcccaggtggccggagaacccacaggcgtgtacggacaaggtgccctgggtgccctggctgacccctggtcagcccggccaggggtagagaccttcccggaaggcgaagatcgcatagtttgaagggtgtcttcttaccctagatgcttaaataaactgtaaaaccttagtcagaggaggtgttaataatatcacctccatattatccctgtgcaaatataattttggggtggttacatgaatcatgttaatggaactccctttgcaaaggaaatctattttgataccattataacttatggcaatgaacaattttcatata

SEQ ID NO: 460731 - DNA, 873 bp, Homo sapiens
aggcagatgcttttagcctgaaaaggagaatagaaatgcattttctctaaacatacaagagcactcatttccagagagatcctggactggagggacaggagcgtgacccaggctgttcatcatgaatggctggctggggcttccagggagctcaagatcaaatccgggggcaaagagacagaagaactaaaactcagagtgaccaccaatgcagctatgaaacaggtggcaacagccaagtggaagaagccaagtgaagggctatggggacctagaagatggagtcgtcacacagtggaagaattgcagatctctgagtcaccatttggacaagaacctactagaacaggtgcctgaacaagaacactggactttgtgtgagtgagaaacaaacttttattgtgttaagccaccgagattttgggttggtttttatagtagctggtgttgcttacactgactaatacatcttgaaagtaaatgatgcaaaacaattctacttattcacagggggtggtatttataagggaaaagaataacagggtggtgtcagtgatgggtcctgataagtaagcaacaacaaggaaggggccccaggtagggaagaacaattgttctgagagactgttaatcacaaacaacctgctagccccacatcctgttctcaaatactttgctcagcatgtagccccagcagcatgactttgtctgcatgtagaccctccagcatgaccctataaaatttccctccagccactgcctcttggcagacagtcccttctctgctgtgctgcccactgctttcttacaacgttatctttgtactttctctaataaatctgcctttctttacccacaactgtcttgaaaaat

SEQ ID NO: 460732 - DNA, 520 bp, Homo sapiens
gccttgctctattgctcgttggcactgagggaagctctctggggagaggagcccaccaatgcttggctgacaagacctcagtcatgtctgatgtggcttcacctttgctgccgtcttcgtatcactaggggagccctgtggagtggggtggagttcaagatggattctcaagaagttataggaagctctttatcaattcaattcctgagaagggcccacttcagggatgttacagtgcagacaaagattctggtgcctcacaagatttgacacaagccagcgctttgttgtttttctcacctgttggccagaagattatcttggagcaggaaaagccaagtggaagaagccaagtgaagggctatggggacctagaagatggagtcgtcacacagtggaagaattgcagatctctgagtcaccatttggacaagaacctactagaacaggtgcctgaacaagaacactggactttgtacaggacctggactagcttagacgaatgaggcacttgcctctg

SEQ ID NO: 460733 - DNA, 3125 bp, Homo sapiens
gaagtcaggtagtgtgtgtaggacactgtgttgtctagagtacttgggacccaatcataccaaggggtcccgcgtctggcacctctttcccctctctcttccttctgctctctcaccttgtgatcgctggacatcccagctctgcttcatgttctgccatgagcaaaagtagcctgaagccctcaccagaagcagatgctggagccatgcttcttgtacagcctgaagaattaaggagggacagggaagtgatgggaggagaatggtgtggtccctggcaagggctccacctccagcctgtgtccgtggacctaggcaggggtctaatagacctgacgaacacaagccgcctatggacaactaaacaaaaagagcaccctgtaacacatgcccactggggcttcagctgtaaacactcacccctaaacactggattgggaaggcgagatgatgtagatatgaataagtcacagttgatgagaaaattactgagaattttctacgctgatgaaaacaccccaaccttcagcagccaccaccctgatcagtcagcagccatcaacatcaaggcaaggccctccataagcaaaaagagtatgactggctacagggtcatataatcattatttttggggggggaaataaagcatttttaaactaaggtatgtgcattttttaagcataatgttatttgacactctatagactatagtatagtgtaaacataagttttagatgcactgagaaaccaaaacatccatgtaaccgactttagtgcaacatttgcttcttacagtggtctggaaccaaactcacaatatctctgaggtctgtctgtagagagattttatataataaatatttaaatctttgaaaacatatttaatagacaaacttttaacaatactgatcgagaaaaattgagatataaattagtacaagtaacaataataataatgtgagaggtattatttcaggttaaaatgtaataaaaataataaatttgaaaacttggaaaagcattttataaaatagcataattatttaataatactcaatatataatagaacacataaattgttttacgactgttacacatatttaatttctagtttagcatccatccatcaatatcactgagcacagatggttttcagagaagtgtttatcaaacattcaagaaaataataactcaaattatttttcaaattattttagagaataagcaaaaagaaaccacaatccattatctgaaataaaaatacagtttactacttaactcacattataagaaaggtaagttactacatactataaattataaccctagattaaaaaccttgtatattagtaaaataaatgcacaattatataacatgtgcattaataacaagtgtgtttttctgtgtatagatgcaatttaagaaagttataattacagagtatatacaattagatatgtgttcacttaaagtgacaaaagaaactgttcacattttatgacatgctaccagagagtttcttgaaaacgtggtgactaaagaaaattaccataatagtaagtgagaataaatttaaaaaaacaatgagaactcaaaattctagtgtagtggaagaagtaatgaaaatattattaagaaaactaattaaaatgaagtatttcaaagtgaagatgattagtttaatatggatgtgccaatgctgaggtggtaataagacatccaatcgtccaagttacaaatatctagtagaaaaatggagcaatcaatctaggcaatttgttcaaatataactttttctttgtgagtgtaaaatagtatacagtgcacatcataaatactgtggttacatttcagtggtatggaaactatctccacttatgggatacatacatacatattcataaaagtaatatatgtgtttacaatacatatgtgtgtctatttatataaaaatcaataatagtcattagcttcatttgagtataactcaaatcaatgtatctattaatggtgtagcatcactaccaaaaatataacatgtacgattgcagtcaattacgataaaaacttttattatagttacatttgattcagaattcagttacctatagtaaattttaactagttacctaatttgtcagacatcaactgcaagatatgggttaagaatctgtagtttcggaattgccaggtattgtgcagagttaaaaaaaaaatcattgagatgtttgacggcacagaggttgactgaaaagttgttaggttctaaatgctaatattgactgaaatttttaaatcaggtaaccttgcactttgttatcaaaggcagttaaataacattgagactaaataaataaaactagaaaagaacatatcattaagcatagaaggatacaaatgtgttgcgtgttgtgtgtgtgtctgtgtgtgtgtgtgtttgtccatgtgaaagtctgaggaacactaagatatgagttcatataatcaggttgtagtcttgccttttaaaaatattttatgatttaatactgagaaagtcatggtctctgatgtttctatctatatacagacattttcactagatcatattgaaaatctcttttagctttctgactcagcatttaaatattaatgtgttttattttgaataatgaaagctataaaatacaagcagtctactttcatctcttaggaggtgtaatttttttgcagtttcgcatatgctcagacctaatcctagcaagacatgttattttcatgacatatattgacactgcattaatcaatcagctttaaaacttaaaaattccaattcagtgtatgtgctattttttaaatatgctaaatttaaagcaaaactacaaaaggtaatgtctaataggaagaatctgttttttctcatacaatttaaacatcatatagtgtgaagtaacagaagatgcttgcttctgtcctaatatagtattcagacaaagtttcttttgttttattgcatactgagtgatttggcctctattgaaaagcagttcagaaaatctcagaggaggataatgtctgttgacgataactgatgctggcttccatggaaatgctaatttggtaacagttgctgtcaatcagtc

SEQ ID NO: 460734 - DNA, 875 bp, Homo sapiens
ctgttcggttctgagggttgctgaatgttccctttttttttttttttttttttacgtggccagactcaatccacaatctctgggtgctgttgttcgctgacagtcctcctgcctggctttaacctgttcaacatcttcatcggtgagttgctggaaaacacagaaaatcatggaatcatgctagtcaatatggcagagaggatcagtgcttaccagaggtatactaggttcccattcatgccaagaggtgacatcaaaacttctgcaacaggagaaagcagtgaagcagtgtgcatagcaaggagtcaaggcctggagttgtgtgacagggcagcacaaaccagtgtgtgtctggagctaacagtggaatctgcagcaagaccacagaaagccctgtctgcagttgaaaggtgcctggactctactgttggtctgtttcctaaacttgcctgacatgaaccaccagggtacttgttaaaagctgttccccaagttctataccagatctacagaatcagaatcttcagaaaagaggctttgaatcagtacttttaacaagccctcagatggttcttatgatcaggcaagtttggaaacagcctgggagtgatgccggccatggaaattaattctggagcagttctgaacgatgataagggctgtgtttgcaaggtgcgctagctacagactgactgaacattgcaatgataaaaaggacagaggaaagcaagagggtacatctgggaggagacattaaagtggtgaacggaaatgtttatgggtcagaaaatcacagttgtagccatttggcatagtgttctagaacatgccttgatgaagagataaatagaatctcaatagaatctccttcttct

SEQ ID NO: 460735 - DNA, 3804 bp, Homo sapiens
gactcccaccaggcgataaatatcaaagcttagtatacacttagactgagagttcaaagagaggcagattcaccatggggctagagcctgaacggagacgccctttgtggagggcgactggattctccccatgggaaaggcttaggatttgtgcacattccaccctagacctctggggaaagcagcagaccaacttcgcgggttgtgaaaaaccatccgggctggtcgattgtgtttccagcgggctccacatctatcctgagagcaagatgccccatttggccagttcagccgcagcacccatgaccttctttcaagttctctatatttcagccaaattaaacctcatgctgtgtccccaacacaatggccccctggattgggatggccgctggttgaaagcctgctgcaataatccaaataaaacacaaccagggctgccccagcccagtaagtctggaaagatagagaataacgtgggagactgggatgcatcagacacgggatcccataactagatcatgcattggcagaaattcctgcttcaatgaagacctcccctcacaattgccttagttagctacagaagaattcattcaaaggcaacccaaatctggaaaaaaatcaaagatgtgggaaatgggaaatagaattcatacatttatttgctataaatataattatgtcaaaatgttttctatcaaaaacattggcccaatggaccaatgctaagaagtttaaaaaaaaaaaaaaaaaagcaaagcggcttcttctgccccctggtggcttttggggaaaagtcactgaaagggcagaaagagcaaaggggaccagtttctctccactttgtacccaagggtcaactgagcacgcaacacccttaaaaataagggagaagtgcagagggctcgctcccctcccgcgccagctctctctcggtcaaggttgggccacagccagtgtctcctccactagatccgagccagtggctctgcccaggtggacagcagagtcgccgctgagattctaactgcttccatcggggctctcggagcagctgttggaacaggatggggagcagagcaattctgacagtgtcaggaaaacatccccctggcttccccgtgcccaggcttgaagacccaggggctggatacacagccacggacacaacagaattcacttttaacgaggcttcagaaaacaacgtttaactatataaacacctgtttttggaaaatgctgcagatctatttccaaatactgtcttccagcccactctcgctcccactgaggcagcatcccacgggacccaacgtcaccacttttccagtccaaaaaatgtgctttcgatgtcctgatttgaggctgctcttcctctaacctgtgcggctctgtgaaaagccaattttaagatgcgatgcctcctccagaattcgcctgtatgcagaagaatgatgcagaaggaggcagaaaagccggagcagttgggggcaagatgaaaacagtctagtcattatcagttaaactgtaactgcgtgcggcagcgtgctgagcgagacaatcagcggagcccgtgaaatgttgctggttttccagatagcccgtttagttttgtctcaaacaaaacaaacaaaaatgtgcataattgtacccaggtctcaagcccgttttatttctccattataccaaggaaaacttgaatggtggccccactggagtgaggctcccgtgaatatgaataattgttcatgaatatgaataatgggttcctatgaataattgtttatccacattcgattagagagcagcagccattagcatctttttagccttctgacattagggtcttctttgtgagcaggtatttaaaatggattcaattccacggtcttgaaggcctgttccgatatcgtgaattttgcagataactgtaatttatcctgtaagagaaccttttgattgctttaactatgaaatatttccattgcattatacatttgcttataatagagtataggaaatgtattttaaccatttcctggacaattcaacattgtcattaccaaagtcaactctccgactggcctgaaactaccctgttgtttagataaccttagctaagtagagtttactccaccttttttctgtaatgtttgttaaaacttgaatcttgtgacctttcttttttggttgatacctgctttgatcaagatataacgggctgaagaacagcagcgaggctgcgtgctgagctgtctacacctgcaaatctcatcaactcctatcagctgggcagcaggttgcccagttcaccactcctgatgaggaagctgaagtttgctgaacttccttctggcactaacgtcacacacttcatagcgctcctaggacttgaacttagtctggtttgccttccaagtccagattctccaaaacattttttctttttcttttaacttactaaatggtgaagtggccagataagcagcctacagataagtgaggtctacaattcatcacacaccgataatgctgacatataacagtttccgtatctttacaaaggcaataaatggatgaagagatgtgatgaggaaaccacgctctctatatgcatgcaagctatttggaagctctaataaaaacttgggaaacaaaacgtctacagcaactttaattcttagtctacactgaaacgtgaaaggtagtcaggagttgttgccgatgggattaaaattgtttttacttttcttcagtattcttttctatattgtctaaatgtttcctgatgaacactgtccatttcaactaagaaaaggctaagtccattctggaggaaaaaaatgacagtgggaattgtaactaatatttaaatcacttggaaataggattcattttatcaccaacctaccaggaccctctttactgtaaagagataaaacactagtaaatgtattgcataaatataccacagactattatgaacaattaaagcacactttatattttttaaaatttctctgtaaacgttctaagataaattatatttgaatttgataaagtcctattttgaatccctttgggttataaaagtctattccctaatttatcttgtgaaaatccagacttctggcttaaaatgggatttactttactctctgagaaaggaatccaccgtactttgatttagataaccacatggtctggaactccatttagtgaaaattaaattttatgactcatatagccaatgttttacctctgttttctacatattcacagcaggtgaaatgtgttcaggaatttaaagatgaaaacatatgtcttttaagtaatgaccaccaagagccactgcagatagaaacagctttattttttccattcaggctttatcaaatagcttgttcaaaaagcatatacaagagcaaaaaataccacatgcagtcaaacttcttttgccttatagtcattggctttcttttagaaaagagtgtgcacttgaataacttctaattcaaacattttccaactgtttctacttcatttttcaagttagcaacgacagatacattttagttaactgtttcatattccttatctttattcatactgaaataatataaagcctataaaatcaaagcatatactgttcagaaatctggaaaggttcttttacataatagattctgacacgttaagaaactacacacaacaaatatttgcaaaatgaatgaaaaataggataaagctatttaaaagtcaacatagtaatatttatctaaataattttaatcaaatgta

SEQ ID NO: 460736 - DNA, 1125 bp, Homo sapiens
cacctgtgccatggcaacatctgggagttaccacccctttctatggcaatgctaccttcagcacactgtctgtggggtagccctgctctgcaaaggcagtcacaaagctgtaacaccaccagagctgagacctgtggccctcttcagatcccccaccagttctctagtgcaaggttccaccttaaggtcgtcaggcacccctcccacttatccaacaagccctggcccgtatcctctactgcctgaagaagtaaacctaaccagtaccaccaggaacggggccccatatcagcccccagaattgaaaatgttttcattgcagtgggtagctgatggagatggaggagtggccggagtgtatgtgcctttttctatgcctgatttggctttgtgcaagcaaaaatatggaaccgctcctgttttggcactccataacttagaaaaacctttcaccctctatgtggctgaaaaacaagggatggctttgggcgccctaactcaaaggctcgggattatccctagaccaatgacttatttttctaaacacctagaccaggaagtcccaaactttcccacatttttctgtcttcttctgagccctccaaactgttccaacctctgcctgttacaccgttccaaaatcgtttccacattttcagtaatgatcaaagttttcttcttctcccagagagacgagaatgtgtttctccaggggccaaagcctggggtgaagctgtacgtcggcagccccagccccagaaaaggaacctactctccatgcacgtctctctggagcaacctgaagacaggatcttggcctcaggacagccatggccacaggagagcacacccctgatgaccctctgctcagaggcaaaaggaggcaagacctccaagagatgctgagagaagtgggcctggatgttgagtactggttacccaagctgcaggaacacctgggtgtgacctgtgcccaggccttacaacacctagacaaaaacaacctcaagaagctgtaatcccagacacaacatccatgggagaaagctgcttaatctgtcacactcaaaaagtctttcagcgttacaggagtctcagcctctgagttggtctgggtcaatgtga

SEQ ID NO: 460737 - DNA, 1262 bp, Homo sapiens
cacctgtgccatggcaacatctgggagttaccacccctttctatggcaatgctaccttcagcacactgtctgtggggtagccctgctctgcaaaggcagtcacaaagctgtaacaccaccagagctgagacctgtggccctcttcagatcccccaccagttctctagtgcaaggttccaccttaaggtcgtcaggcacccctcccacttatccaacaagccctggcccgtatcctctactgcctgaagaagtaaacctaaccagtaccaccaggaacggggccccatatcagcccccagaattgaaaatgttttcattgcagtgggtagctgatggagatggaggagtggccggagtgtatgtgcctttttctatgcctgatttggctttgtgcaagcaaaaatatggaaccgctcctgttttggcactccataacttagaaaaacctttcaccctctatgtggctgaaaaacaagggatggctttgggcgccctaactcaaaggctcgggattatccctagaccaatgacttatttttctaaacacctagaccaggaagtcccaaactttcccacatttttctgtcttcttctgagccctccaaactgttccaacctctgcctgttacaccgttccaaaatcgtttccacattttcagtaatgatcaaagttttcttcttctcccagagagacgagaatgtgtttctccaggggccaaagcctggggtgaagctgtacgtcggcagccccagccccagaaaaggaacctactctccatgcacgtctctctggagcaacctgaagacaggatcttggcctcaggacagttttgcaggctgggaagtccaagataaagccaccagcatctgacaatggccttcttgcaacatcctccaacagagaggaacaacatgtcctcacatggcagaagagcacagaggaaaaagaagaccaaactcactcttttataagagcattaatcccacataggaaggcagagccctcatggcccttttgcttcccaaaattctcatattctaataccaccacggtgggaaccaaatttcaacatgagttttggagcagacaaacattcaaaccatagcaccgctcaaacctttgatgagaccacatcctcagcaaacacctagattaaaatctggtgagctcttaaagcagagaacataactacactatgcctggacttctgacttatagaaactgtgagataataaatgtgtgtctttaaaccctcaagttt

SEQ ID NO: 460738 - DNA, 1542 bp, Homo sapiens
tccgggaggtccccgtcccggcagcccgcggccgcgtccttggccctcctccgggggaacctcgttcattccaaactctggaaggccggctgtccttcggttactgataaggacgcgagctcttggaaacccgggcacagagaggttaagtaacttgccccagggcacacagctagctgatgtcagtgccagaattccaaccgcggctgtcggaccccatgccatcctcatgtcaacccactaaggacgggatccttctgtccatcttaaagatgaggcaactaaggcacatggaaatttaagtataataccttgcccaaggtcacctagctggaaaatggacgagacagaaagcgaacccagggctcctttctgtacgcagaacccgcggtcttggccataggcgatgccacttccgacagcccagcagggtctggccctgggtcccagaggcgcagcccctgcggggtttggatgggttcctgcggcctccgatccgctggtgaattgggtgtgtctgagcatcgtccctgctcagcccgcaggcgtaggatagggaggcgtctccgggagtctactccgggacgggtccgcggtcctcagtcgggatggagcgggggcggaggcagccggagggaactggagtccccattgcagaactgcggggccgggctctgggctgggcgcctgccccgcgcggccggcagagggcgctgccgcacacgccttggatctcactgtcactgggacctcggggcaggctgacgtcggcctgcagacgcctggactcagaaccccgaagcaagaagcttcccttcctggtggctgccatccctcaggcccaccatttcagccctggacctgctttccctgaccacttttccccatcttctgtgctcctgccatcccaccactggccttcaagacttccccagtccctgcacagcgggttttgtcatctgctgagaggcgcggacactgattcccatcccattaaaaggcctagatgtctgcaagtcaaattcagccttgcttccccttctcgccctctggtgatttaaaatagggatacatcatctacttggaataaatgactaatttttctcttctccaaaatacggtgggtatggggagggttggttaaaaatttgctctggaaattcaatcaagtaccttcactccacagacatgtattgagagcccattatatgtaggtgctgggaggacagcagagaacctagcatgagctcatgggctcaccttctcctgttcccacctccacctggctcctttcttcatggctccaactttcaggagcagaacttgggaatgttctagctccaggacctgccaatgccgtcccatcctttcctagttggctttccttccattcataagaacactgtgacaactgaaataattcaggtcatatttatgaaacatctattacaatgagaatcccatagtgacataatactccactgttcacaggaaaatgctagctaaaacaaacaacagtgactgtctggcaagggacgcatc

SEQ ID NO: 460739 - DNA, 867 bp, Homo sapiens
ccggatcttaaaggaaaggctttcagtttttcctaattcagtatgatgctacctgcagccttggatacccaggcttcccagaaaaagcagctgcaactccaccaaagtggggggttagaccccttctttgcagaatgggtttgtttagaaaaacttcatcgaacagccaatccagagattctaggcaggctgtctgatgtggtctgcggggtaggcccaaatcttgggtccaggaggactggtctggagcctgagtctggagggatgttgacagatcctcggtctgtgggagttggcctggcactggggcctactggagaagtaaatagacaaaatgaaattaacacttgggactcaatgccctggtgggtttcctggaaccttgcaaaaggaagggccatatggcatgaaagaaaaagtcgtatggaagacctacacaaaataaaagcaagtctcattacttttcaaggggagtgtagaagcgattagtctctgatgataataagggtaccccccatgtaaaactgccacaagctctcagaagtgagactttagctccttacaaatgctgagcagacgtgaacaccctcctgggagattgatgagtcctattaaccttgttgcatagatggaaactcagaaacaaagtgactctgaggattaagaggaagtcaatgtcagcaccaggattagaattcacacttgcctggtttctcagcccacaaccagctcccccatggattcctgctttgtctccctccccaagtgaggggacagggtgtttccaaactttaaaagaatcctgttatcctcaggcctctgccttgtaggaagatcctttcttttaataaattacagagctgagaa

SEQ ID NO: 460740 - DNA, 728 bp, Homo sapiens
tacaagaagcatggcgccagcatctgctcagcttctgcgagtagccaaatcttccctctctagagccactggccaacacttttccgttgccgagttccttagtgccagggctcggccagggatgcaggtgctggagctaggcctaggaacagaggcaaaatgatcccaaaagctgatgagagggtctgggcagcaagaactaaatctctttccttcctccaggacaacaccttcctccagcacaacaggggcagaggagccggtcttctggggagaagcttttacacatctggccctctcctttgtgatattgggaagctgcatgtccagaggcagcagatactctcaggtgttctggatgtgattctcgagtgcctgggcttcaaatgggagctccatcagccccagctttttcagtctgagaccttggccaagctctacctgaaagccctggcgcagggcaccacacaccccctgagggagctggaggagcttctgcgagctcaatcacctaagaagaccaaagaaaaatcccctgcaaagaggatcatcatttccttgaagatcaatgacccactggtcactaaagtcggtatgtatatacccgtctatattctgagaatgccattgaacaaatggtcctcccagatttaaaaatgcacaagcaacaacaaagcaaaacaaaccaacagtagacagtgttcagtgctttcttattaaaaaggccc

SEQ ID NO: 460741 - DNA, 3668 bp, Homo sapiens
ggacagagcctcagacggttgggcggacggacggcccgacaggcgggcatgcgggcggccagactgtagccgagcagcgaggctccggccgcagccatggagcggcggctgcgcgcgctggagcagctggcgcggggcgaggccggcggctgcccggggctcgacggcctcctagatctgctgctggcgctgcaccacgagctcagcagcggccccctacggcgggagcgcagcgtggcgcagttcctgagctgggggacccgcacccccacgggcttccctcgcagactccctgcagtggccctgacgcgtaccaccggacccccgcggcccgcacactcgcctgcacacctcaccctcactccaattctcacacacgctctctccctctcacagaccccgacacatgcacacacacaccaacttgtgctcagccccttcgtatcaaaggtgaaagaactgcgtctgcagagagatgactttgagatcttgaaggtgatcggccgaggagcctttggggaggtcaccgtggtgaggcagagggacactgggcagatttttgccatgaaaatgctgcacaagtgggagatgctgaagagggctgagacagcctgtttccgggaggagcgggatgtgctcgtgaaaggggacagccgttgggtgaccactctgcactatgccttccaagacgaggagtacctgtaccttgtgatggactactatgctggtggggacctcctgacgctgctgagccgcttcgaggaccgtctcccgcccgagctggcccagttctacctggctgagatggtgctggccatccactcgctgcaccagctgggttatgtccacagggatgtcaagccagacaacgtcctgctggatgtgaacgggcacattcgcctggctgacttcggctcctgcctgcgtctcaacaccaacggcatggtggattcatcagtggcagtagggacgccggactatatctcccctgagatcctgcaggccatggaggagggcaagggccactacggcccacagtgtgactggtggtcgcttggagtctgcgcctatgagctgctctttggggagacgcccttctatgctgagtccttggtggaaacctacggcaagatcatgaaccacgaggaccacctgcagttccccccggacgtgcctgacgtgccagccagcgcccaagacctgatccgccagctgctgtgtcgccaggaagagcggctaggccgtggtgggctggatgacttccggaaccatcctttcttcgaaggcgtggactgggagcggctggcgagcagcacggccccctatattcctgagctgcggggacccatggacacctccaactttgatgtggatgacgacaccctcaaccatccagggaccctgccaccgccctcccacggggccttctccggccatcacctgccattcgtgggcttcacctacacctcaggcagtcacagtcctgagagcagctctgaggcttgggctgccctggagcggaagctccagtgtctggagcaggagaaggtggagctgagcaggaagcaccaagaggccctgcacgcccccacagaccatcgggagctggagcagctacggaaggaagtgcagactctgcgggacaggctgccagagatgctgagggacaaggcctcattgtcccagacggatgggcccccagctggtagcccaggtcaggacagtgacctacggcaggagcttgaccgacttcaccgggagctggccgagggtcgggcagggctgcaggctcaggagcaggagctctgcagggcccaggggcagcaggaggagctgcttcagaggctacaggaggcccaggagagagaggcggccacagctagccagacccgggccctgagctcccagctggaggaagcccgggctgcccagagggagctggaggcccaggtgtcctccctgagccggcaggtgacgcagctgcagggacagtgggagcaacgccttgaggagtcgtcccaggccaagaccatccacacagcctctgagaccaacgggatgggaccccctgagggtgggcctcaggaggcccaactgaggaaggaggtggccgccctgcgagagcagctggagcaggcccacagccacaggccgagtggtaaggaggaggctctgtgccagctgcaggaggaaaaccggaggctgagccgggagcaggagcggctagaagcagagctggcccaggagcaggagagcaagcagcggctggagggtgagcggcgggagacggagagcaactgggaggcccagctcgccgacatcctcagctgggtgaatgatgagaaggtctcaagaggctacctgcaggccctggccaccaagatggcagaggagctggagtccttgaggaacgtaggcacccagacgctccctgcccggccactggaccaccagtggaaggcgcggcgactgcagaagatggaggcctcggccaggctggagctgcagtcagcgctggaggccgagatccgcgccaagcagggcctgcaggagcggctgacacaggtgcaggaggcccagctgcaggctgagcgccgtctgcaggaggccgagaagcagagccaggccctgcaacaggagctcgccatgctgcgggaggagctgcgggcccgagggccagtggacaccaagccctcaaactccctgattcccttcctgtccttccggagctcagagaaggattctgccaaggaccctggcatctcaggagaggccacaaggcatggaggagagccagatctgaggccggagggccgacgcagcctgcgcatgggggctgtgttccccagagcacccactgccaacacagcctctacagaaggtcttcctgctaaggtcagtgcccagaggggcaagcagggtgggggcaccaagcagttctgccaggctgaatgggcactgtggggacactccacgtgcatcgtggctagcaggcacaattggggtggaggtggtggcgatgagcttgcctgccgccatagattggctgggactcggaggtcactgttgcctggctcagccccttgtctttcctgacccctcagggatggggcatggggccctgggaggccttgggtaatggctgtccccctccccagcccggctcacacacgctgcgcccccggagcttcccatccccgaccaagtgtctccgctgcacctcgctgatgctgggcctgggccgccagggcctgggttgtgatggtgagagtccccacccactatgctccagccacggtcccagcctgcggctacttttgtcacacaacctgtgccccacaggccccaccctgccccgtgccccctgacctcctccgcacagccctgggagtacaccccgaaacaggcacaggcactgcctatgagggctttctgtcggtgccgcggccctcaggtgtccggcggggctggcagcgcgtgtttgctgccctgagtgactcacgcctgctgctgtttgacgcccctgacctgaggctcagcccgcccagtggggccctcctgcaggtcctagatctgaggcccgtccttgccccattatggcgctggtcgcatggctctggagttgtctgtttgcctgtctggcctactccctgctgctgacagtgcac

SEQ ID NO: 460742 - DNA, 3405 bp, Homo sapiens
ggacagagcctcagacggttgggcggacggacggcccgacaggcgggcatgcgggcggccagactgtagccgagcagcgaggctccggccgcagccatggagcggcggctgcgcgcgctggagcagctggcgcggggcgaggccggcggctgcccggggctcgacggcctcctagatctgctgctggcgctgcaccacgagctcagcagcggccccctacggcgggagcgcagcgtggcgcagttcctgagctgggggacccgcacccccacgggcttccctcgcagactccctgcagtggccctgacgcgtaccaccggacccccgcggcccgcacactcgcctgcacacctcaccctcactccaattctcacacacgctctctccctctcacagaccccgacacatgcacacacacaccaacttgtgctcagccccttcgtatcaaaggtgaaagaactgcgtctgcagagagatgactttgagatcttgaaggtgatcggccgaggagcctttggggaggtcaccgtggtgaggcagagggacactgggcagatttttgccatgaaaatgctgcacaagtgggagatgctgaagagggctgagacagcctgtttccgggaggagcgggatgtgctcgtgaaaggggacagccgttgggtgaccactctgcactatgccttccaagacgaggagtacctgtaccttgtgatggactactatgctggtggggacctcctgacgctgctgagccgcttcgaggaccgtctcccgcccgagctggcccagttctacctggctgagatggtgctggccatccactcgctgcaccagctgggttatgtccacagggatgtcaagccagacaacgtcctgctggatgtgaacgggcacattcgcctggctgacttcggctcctgcctgcgtctcaacaccaacggcatggtggattcatcagtggcagtagggacgccggactatatctcccctgagatcctgcaggccatggaggagggcaagggccactacggcccacagtgtgactggtggtcgcttggagtctgcgcctatgagctgctctttggggagacgcccttctatgctgagtccttggtggaaacctacggcaagatcatgaaccacgaggaccacctgcagttccccccggacgtgcctgacgtgccagccagcgcccaagacctgatccgccagctgctgtgtcgccaggaagagcggctaggccgtggtgggctggatgacttccggaaccatcctttcttcgaaggcgtggactgggagcggctggcgagcagcacggccccctatattcctgagctgcggggacccatggacacctccaactttgatgtggatgacgacaccctcaaccatccagggaccctgccaccgccctcccacggggccttctccggccatcacctgccattcgtgggcttcacctacacctcaggcagtcacagtcctgagagcagctctgaggcttgggctgccctggagcggaagctccagtgtctggagcaggagaaggtggagctgagcaggaagcaccaagaggccctgcacgcccccacagaccatcgggagctggagcagctacggaaggaagtgcagactctgcgggacaggctgccagagatgctgagggacaaggcctcattgtcccagacggatgggcccccagctggtagcccaggtcaggacagtgacctacggcaggagcttgaccgacttcaccgggagctggccgagggtcgggcagggctgcaggctcaggagcaggagctctgcagggcccaggggcagcaggaggagctgcttcagaggctacaggaggcccaggagagagaggcggccacagctagccagacccgggccctgagctcccagctggaggaagcccgggctgcccagagggagctggaggcccaggtgtcctccctgagccggcaggtgacgcagctgcagggacagtgggagcaacgccttgaggagtcgtcccaggccaagaccatccacacagcctctgagaccaacgggatgggaccccctgagggtgggcctcaggaggcccaactgaggaaggaggtggccgccctgcgagagcagctggagcaggcccacagccacaggccgagtggtaaggaggaggctctgtgccagctgcaggaggaaaaccggaggctgagccgggagcaggagcggctagaagcagagctggcccaggagcaggagagcaagcagcggctggagggtgagcggcgggagacggagagcaactgggaggcccagctcgccgacatcctcagctgggtgaatgatgagaaggtctcaagaggctacctgcaggccctggccaccaagatggcagaggagctggagtccttgaggaacgtaggcacccagacgctccctgcccggccactggaccaccagtggaaggcgcggcgactgcagaagatggaggcctcggccaggctggagctgcagtcagcgctggaggccgagatccgcgccaagcagggcctgcaggagcggctgacacaggtgcaggaggcccagctgcaggctgagcgccgtctgcaggaggccgagaagcagagccaggccctgcaacaggagctcgccatgctgcgggaggagctgcgggcccgagggccagtggacaccaagccctcaaactccctgattcccttcctgtccttccggagctcagagaaggattctgccaaggaccctggcatctcaggagaggccacaaggcatggaggagagccagatctgaggccggagggccgacgcagcctgcgcatgggggctgtgttccccagagcacccactgccaacacagcctctacagaaggtcttcctgctaagcccggctcacacacgctgcgcccccggagcttcccatccccgaccaagtgtctccgctgcacctcgctgatgctgggcctgggccgccagggcctgggttgtgatggtgagagtccccacccactatgctccagccacggtcccagcctgcggctacttttgtcacacaacctgtgccccacaggccccaccctgccccgtgccccctgacctcctccgcacagccctgggagtacaccccgaaacaggcacaggcactgcctatgagggctttctgtcggtgccgcggccctcaggtgtccggcggggctggcagcgcgtgtttgctgccctgagtgactcacgcctgctgctgtttgacgcccctgacctgaggctcagcccgcccagtggggccctcctgcaggtcctagatctgaggcccgtccttgccccattatggcgctggtcgcatggctctggagttgtctgtttgcctgtctggcctactccctgctgctgacagtgcac

SEQ ID NO: 460743 - DNA, 798 bp, Homo sapiens
  misc_feature (22)..(22): n is a, c, g, or t
gttggggtaggatgcatggcanagacactatatacaaggaacatttttttaacccatcgaataatcacaaatgatgcaagccaaaagacaatggatcaaaatctttaaagtaaaaaactatctacctagaattctatatccaacaaaaagtccttcaaaatgaaggccacaaggcatggaggagagccagatctgaggccggagggccgacgcagcctgcgcatgggggctgtgttccccagagcacccactgccaacacagcctctacagaaggtcttcctgctaagcccggctcacacacgctgcgcccccggagcttcccatccccgaccaagtgtctccgctgcacctcgctgatgctgggcctgggccgccagggcctgggttgtgatggtgagagtccccacccactatgctccagccacggtcccagcctgcggctacttttgtcacacaacctgtgccccacaggccccaccctgccccgtgccccctgacctcctccgcacagccctgggagtacaccccgaaacaggcacaggcactgcctatgagggctttctgtcggtgccgcggccctcaggtgtccggcggggctggcagcgcgtgtttgctgccctgagtgactcacgcctgctgctgtttgacgcccctgacctgaggctcagcccgcccagtggggccctcctgcaggtcctagatctgaggcccgtccttgccccattatggcgctggtcgcatggctctggagttgtctgtttgcctgtctggcctactccctgctgctgacagtgcac

SEQ ID NO: 460744 - DNA, 2364 bp, Homo sapiens
gatccagctatggagaaagccgcagatctgcaggacacagcctcgttaactctgaagtttaagtttaacccaaagctgggcattgataatcctgtcctctccctggccgaagaccacgacccctatgatccctggagcctggagcggcctcgcttctgtttactgagcaaagaggagggcaagagttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggtggtacgccgcatccgggccagcagccctcgggtgttgctgacagtattggcacggcatgcacatgacgtggcccgagctcagctgggagaagatgcccacctctgtcccaccctaggcccaggggtccggccccggctgtgccacatagtgaaagatgagggtggttttggcttcagtgtcacccatggcaatcagggtcctttctggttggtgctaagtactggaggagcagctgagcgggcaggggtgccccccggggcccggctgctggaagtgaatggggtcagtgtggagaagttcactcacaaccaactcaccaggaaggtgtgactgcctgtctcccactctcctcccccaatccgggcctgggccccacctcgggaagacgcctccttccccatgcgcctaacctccttatctggtctcctacctttatcaccatcctccccctctacagtttgtgccaggctccacttagtgcctgggaggaggggctgtggggggagcatacctcttctctccctgcccaggtgttatactgatgccctgctgggtccccacagctttggcagagtggacagcaggtgaccttgctggtggcagggccagaggtggaagaacagtgtcgccagctgggattgcccctggctgcacccctggcagagggctgggcactgcccaccaagccccgctgcctgcacctggagaaagggccccagggttttgggttcctgctccgggaggaaaagggccttgacggtcgccctggtgagtgggagccctgggggcggtgggggaaggtgggccttggggtgggcacacaagcgtatatacacctttcagtgcaccgaagaggtgtccctgtctgagctctggccctgggccgcctcttcccgttcactctggggtcagtcccctggtgtgtacacagtggcctaggatagctggagaggagcagtgaggatgtctatgccccaggacagttcctgtgggaggtggacccgggactgccagccaagaaggctgggatgcaggctggggaccggctggtggctgtggctggggagagcgtggaggggctgggccatgaggagacagtgtccaggatccaggggcagggctcctgtgtctccctcactgtcgtcgaccctgaggcggaccgcttcttcagcatgaatagcctgtccccactccttttcttggagaacacagaggctcccgcctcgccccggggcagcagttcagcctcagtggttgagacagaggacccttcactggaagacacaagcgtgcattctgtccttcttggctcccgacagtgcttcctgtaccctgggcctggtggcagctatggcttccgactcagttgtgtggccagtgggcctcgtctcttcatctcccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaaggtgtggctgtgggtctggctaggattgaagccatctggaccttttctagatatgactccaggacccttgagtgtaatgcaaaaatttggagaccagctatgcctgccctctgtgggtgccttagcattgcgggagggtggtgcttggtcaccgttgcatttgttatagaaatggccattcgccataaatctgactgcctgtgtttgtgttggtgggggtaaggggcagtggtgtgaag

SEQ ID NO: 460745 - DNA, 2083 bp, Homo sapiens
gatccagctatggagaaagccgcagatctgcaggacacagcctcgttaactctgaagtttaagtttaacccaaagctgggcattgataatcctgtcctctccctggccgaagaccacgacccctatgatccctggagcctggagcggcctcgcttctgtttactgagcaaagaggagggcaagagttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggtggtacgccgcatccgggccagcagccctcgggtgttgctgacagtattggcacggcatgcacatgacgtggcccgagctcagctgggagaagatgcccacctctgtcccaccctaggcccaggggtccggccccggctgtgccacatagtgaaagatgagggtggttttggcttcagtgtcacccatggcaatcagggtcctttctggttggtgctaagtactggaggagcagctgagcgggcaggggtgccccccggggcccggctgctggaagtgaatgggctttggcagagtggacagcaggtgaccttgctggtggcagggccagaggtggaagaacagtgtcgccagctgggattgcccctggctgcacccctggcagagggctgggcactgcccaccaagccccgctgcctgcacctggagaaagggccccagggttttgggttcctgctccgggaggaaaagggccttgacggtcgccctggtgagtgggagccctgggggcggtgggggaaggtgggccttggggtgggcacacaagcgtatatacacctttcagtgcaccgaagaggtgtccctgtctgagctctggccctgggccgcctcttcccgttcactctggggtcagtcccctggtgtgtacacagtggcctaggatagctggagaggagcagtgaggatgtctatgccccaggacagttcctgtgggaggtggacccgggactgccagccaagaaggctgggatgcaggctggggaccggctggtggctgtggctggggagagcgtggaggggctgggccatgaggagacagtgtccaggatccaggggcagggctcctgtgtctccctcactgtcgtcgaccctgaggcggaccgcttcttcagcatgaatagcctgtccccactccttttcttggagaacacagaggctcccgcctcgccccggggcagcagttcagcctcagtggttgagacagaggacccttcactggaagacacaagcgtgcattctgtccttcttggctcccgacagtgcttcctgtaccctgggcctggtggcagctatggcttccgactcagttgtgtggccagtgggcctcgtctcttcatctcccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaaggtgtggctgtgggtctggctaggattgaagccatctggaccttttctagatatgactccaggacccttgagtgtaatgcaaaaatttggagaccagctatgcctgccctctgtgggtgccttagcattgcgggagggtggtgcttggtcaccgttgcatttgttatagaaatggccattcgccataaatctgactgcctgtgtttgtgttggtgggggtaaggggcagtggtgtgaag

SEQ ID NO: 460746 - DNA, 969 bp, Homo sapiens
ctacgctgggaagagatgagctgatgcccagctcagctgctcttctgagtcttcaatttccagaccaacctcccttaaggtgactgacagtggggacctcaacctcacctacagggatgtggactgatcccatggtctcagtgagagacccaggcaatatttctacatgaagcatgttggatttctgaattatccagcctcaaatgacaccgggatgggacagtgttaacccagataagaaaactgaggctctgagaagttgagggacttggtcaaggccacatgtcagtgagtgccagaagtttctgctactcctacaaaatcagaagttccccaaatccaaaccatctcgacctacccctgtgacccgccaaaagaagctggccttccccatcctcctgtctccgcagtgccatttgcctttcagtctcctaaaaagaagcacttactctcttccccaaatcgcagagggaagcttcaaatacacttctaatcatcctcagtacccagcagtatataggaagttattgtcccaaagttgtgtgtcatgcccgaagtgtctgggatccccgagtgcctgtggtgcccaagagctatgaatctgctatcatcaacacagagggtaccttctgaatgggctatgtctacagtgatgctgcaaatggaagctaaccctaggatgactggcctctgacacttgagccatcccatcatctgtcatgggttgacccatccatcccctcaatgagcctgaccttcaggaccactgacagaggagcagtcaatagaaattaattgttaaatacccagaaaatctgaaatggtatttaatatgcagttcatcaagagcaaaagttccttaaatcttcatctagaaaagttatttataagggatgaatatgttgtatgaatatgttgtatgcaaatattatattcaagggcaagaccatgaaaacagtttaagaatcc

SEQ ID NO: 460747 - DNA, 1714 bp, Homo sapiens
cctcagctggcttttgagtttgcacggacctacgttaaaacaagcatcacatttagaataaaggcgatgatgctcttctcttacaagctgctcaggcctgtcctggagttttccgttctgtttcctcatcacattcaagaggcccctacatcaataagaaaaggtcaagaggagaaacagcaggattgttacacagctggaagccatgaggcccctggaatccagattgacaaccagttggacacagccatttcaaatccctttcttgttttaagaggcttctttgactgccaccttttacacacagcaggtttgcaagcccttctagcacccacagatgacggggcggctggtcacagacgctcctcacctcccagacggcgtggcggcggggcagagacactcctcagttctcagacggggtcgcggctggacagaggcgctcttcacatctcagacggggcggcggggcagaggcgctccccacatcccagacgatgggctgccgggcagagacgctcctcacttcctagacgggatgacggccaggaagaggcgctcctcacttcccagactgggcggccgggcagaggggctcctcacatcccagacaatgggcagccaggcagagacgctcctcacttcctagatggggtggtggccgggcagaggctgccatctcggcgctttgggaggccaaggcaggcggctgggaggtggaggttgtagcgagccgagatcacgccactgcactccagcctgggcaccactgagcactgagctgctcttctgagtcttcaatttccagaccaacctcccttaaggtgactgacagtggggacctcaacctcacctacagggatgtggactgatcccatggtctcagtgagagacccaggcaatatttctacatgaagcatgttggatttctgaattatccagcctcaaatgacaccgggatgggacagtgttaacccagataagaaaactgaggctctgagaagttgagggacttggtcaaggccacatgtcagtgagtgccagaagtttctgctactcctacaaaatcagaagttccccaaatccaaaccatctcgacctacccctgtgacccgccaaaagaagctggccttccccatcctcctgtctccgcagtgccatttgcctttcagtctcctaaaaagaagcacttactctcttccccaaatcgcagagggaagcttcaaatacacttctaatcatcctcagtacccagcagtatataggaagttattgtcccaaagttgtgtgtcatgcccgaagtgtctgggatccccgagtgcctgtggtgcccaagagctatgaatctgctatcatcaacacagagggtaccttctgaatgggctatgtctacagtgatgctgcaaatggaagctaaccctaggatgactggcctctgacacttgagccatcccatcatctgtcatgggttgacccatccatcccctcaatgagcctgaccttcaggaccactgacagaggagcagtcaatagaaattaattgttaaatacccagaaaatctgaaatggtatttaatatgcagttcatcaagagcaaaagttccttaaatcttcatctagaaaagttatttataagggatgaatatgttgtatgaatatgttgtatgcaaatattatattcaagggcaagaccatgaaaacagtttaagaatcc

SEQ ID NO: 460748 - DNA, 1017 bp, Homo sapiens
acaaatttaaaggcaataacattttaaatgttgcagatgaaggtgcttttattaattcccctgaaatataagcacaaatttattccacatttacattttttcaataaatacgaaatagcaaaccatgacacttcagcaattttaaaaaattacagcacacaacttcactgtcacgctgtcttccagctaaatttaaaaagctacgtctacatggagtatcacatttcccttctagaagtgaagattggagtgtctgttgggagatgcactgattcacatgcacccaaatacaacaccaaccccacaagctctcagctcaccagtcacagacatcaccttctacggacatatttttatttcactgagctacaactacgggcaaggcaacgacgagctgtgtggagacttcaaaacatagaggacaacctctgccctcaaagacaacatccaactgaagaaaggatcaagaaagatgaaaataaataagttgtttgattatgctgtgttaataaatgacccatagaataattgtcagagaaattcagaagaagaagaaattaccctattttgagttgtttggaaaagtttaacagagaaaaatatgacaatatctggggtttaaagagtaaaactcgcacaaagacctggagggaaggaatcaagagatgccaacactgaagaaaaaaacatgttcatagtgtattcgtggtgaaaagaaagggtttttgtgcgcaaggaagtaatggaccaaaatgcagtagtcccagtgcctagaatcatgctgagcacaaaacaagtatttgtttaatgagcaaatgaaagtagagtttcatttgtccagttaacaaaatacacaagtattccctgccctcctctttttaaaattaattaattaattaatttttaacagacaaaaaattatatatattttcatgtacagcatgttattttaaaatatatacacatttgtagagtggctaaattgagctaataaacgtatgtattacctcacatact

SEQ ID NO: 460749 - DNA, 2357 bp, Homo sapiens
agaaacaactccttagtgactgaatttattcttgctggattaacagatcatccagagttccggcaacccctctttttcctgtttctagtgatctacattgtcaccatggtgactttcatcctggtctgaggccttcatcgctgactcttgctccctccagttttatccttaataggcatttataacaaaatatgacttcttgatgccaaattatgaactgagtggaacactgagtcccaaaggagccaatgctggatctgtgacacaagttgtaaacacaggaggctcctataaggtggttgttttcctgcatgcaggaggagagaaccgtctgggaaaattctcagacagatattatggcatattccctagaatacctcttctagcatgtcgaagatggaggtctgtgctgttggcaattacctccttcatcatcagcaactttgaccctctcaggacagtggggaggaaggaccctgaaggtcctgcagcagttagtcctccaaggatagaaaggccctggcagggggtagggggtgtcacaggccatggaagtccccagttggcaaagtggctgagaaaaatcctgcatcattactactgtgaatgaacttagggcaagatgcccctcaaaggatatatcatagaataatattacattgtgtgaatataccacgttttatttaccaaattactagttggtagatatttggtgttttttcctacattttgacaattataaaacaatggtgctataaatattcatatataaggttttatgcgaatgtatgttttttatttctctgatgtatataactaagagagaaatttctgagtgaagcagtaattctgtttaaccttttgagaaactgcatgaccattttccaaagtggttgcagtcagttggcattgccaccaggagtgtacaaaggtttcagttcttcacatccttaccaacacgtggttttattatttttaaaaaattatagccatctttgtgtgtgtgaggtcatattttactgtggttttgatttgaatttccctaattactaatgatattgaacatcttttgatgtacttattggccatttgtgtatattctttgaaacgtctattcagatcatttgcccatttcaaaattgagtgttttatctttttattattgagttttaagtgttatttaggcattctgcatactaggtcttttaagattatataatttgcaaatatttctcccattctgtgggatttttcactttcttgataatgtcttttgggaatgacccttattttgaggagtttgaaaacattcagagagtctgcggctttttggctaataaaaaaccctctataaatatacaatgatttcctttttcttttaattacataaggactgtgtgggtaaatatgaactcaatgtatacatatatttcacatatatgtttttataattgtttgaatatgctagggcagctgatttgatttaaagcttcagagagtaactcacttaacaaataacaagtatactctatagttaaattgaacaaacacaatttcctattatgaacatctttcacaagcttcactgaggtagaagatgttggtgtcctgccctatagaagacattgttccttcccttctaacgccacaaaatttctctcgtgatagtggctgaaaataagagataatcatttgacagttctccctgcaatgaggttggctgtgtgttttatttctgactgataagacatagagggaagtcatttttaggcttctggagaagacttacctccgaataaaaagagagggatatgtgaggagagttattctgcattgttttcttgctttcttctttggatacaggtgattgttggagctataacagatgttttgtgaacataaagtgaaaaccccgaggaataaggtcagcagactgaggacagtggaatggatgaggatgggtctttgatgagagggtttagttgctgaatcaacactgggacactctgcctctagatttattgttatgtgaatgaaatgagctcctattttcaatagcaaagacttggaaccaacccaaatgtccaacaatgatagactggattaagaaaatgtggctcataggtgggaattgaacaatgagattacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaatgtatttt

SEQ ID NO: 460750 - DNA, 1294 bp, Homo sapiens
cgtcgttgatggtgactgacacgccccagagatagtgacatgatgattaagagtgacagcctgagggagctgagcgcagcatggctggtctggcagctgctgtcggtgtcgcgaccccaccccacttccccggctccctgcctccttcgctggagaagcatcctcagccaatggagccacaatacctgtgccccacttgaattcctgcagagggtgaatgagtgtcctgtggttgctggaaaaaagtgccacaaaccagacagtgtgaaacaacagaaactcacacacagtcccgggggccagaagtctgcaatcaggacacgggatgaagagggtcagacagaggcacgggatgaagagggtcccacacaggcacgagatgaagagggtcccgcacagacacgggatgaagagggtcccgcacagacacgggaggaagagggtcccgcacaggcacgggaggaagagggtcccgcacaggcacgggaggaagagggtcccagcacagctccccagccgctcgtctcctgctgtgtggcctggtaccagtctgtggcccaggggctggggacccttgccctaaaggctcccggggcccaccacataatgccctgtgtcccagatcctaaattcctgaaaaggctaaaaatctgtatggctgactccctcaccactgagtctttactcatacacgaccttcttgacgacactgaccttgaccgccccacttgtaattgcacttccgaccactcctgatccccctcccggctactctgcttagtcttattcctatagcatttaccaccttcctgcaagctagagatcaatactggccaacacatgatgggacatttttcttgaccctctccaatgtgaattacttccttttatatggaagattgtgagccctttgaagacctgatggaagctattggacagtagaagacacagagtgtacatgcagaataactgttgattgtgctgggagtgcaacaacttgagataagaaggaactggctggaacagtccaaggtctctccctgtccctcctagaacaagatgtcctgcaacacttgtgctcagtgagtcaacttcccctaggtataaaacctagagtggagcatcttttggcgtcccttggctgtggtgctgcctagggcatgtgcagatggactctacccaccctggccagcttgcctgagccttgtcggggagcagggaccctaggctcctgctgtcccctgatgccgatccgcgaataataaagttgcttttcttaatttacagtgtgagc

SEQ ID NO: 460751 - DNA, 4669 bp, Homo sapiens
tgggtgccaacaccgaagaggcaccgagagcgagcgagggctgccagcatgctgtcacctctcaacaccaggcagttgctgaggcgggagggaaacttctatgcacactgtggggtccaaggagctgtctgtggaattagggtgggctcaggaggcttcaggaagctgcgcaaagaggatcgggtgcccaaggtggagtcacgggagtcaaagatctgtggggtcaatagtgccctcgaccttgtgtggttccaaggagcaatcttctacattacaacgcgggaaggatgttctgatgaatctcttgggcaggctgcgattccccaggtacccccgacttctgcagtggaagtggcgcttggtgatgcacatgacctttggggacagaaatgttggttgctgacaaatgtcatgttctgggtggaagaatgcagtgaacggatgttgaccaactttcggtggtgacgtagtgaaatgttccctaagtgggttgcttgtttttttaatgttgagatttttcctgaagattgccttctattttttcttctaaaagttttgcagtttttattttatatttatatttgtaatctatttttaaataatgtttttacagtataactttcagtccaagttttgttttttgttgttgttgttgttttttgcttttatcttatatatgtaatagctccagcaccatttaaaacatttgtgttaaaagacacatactataaaatttaccatgtcaagcattttttaactgtgcagttcaggggcattaattacattcacactgttgtgcaaccagcaccaccatccacctccagaactttttcatctttccaaactgaagcttggtacccattaaacaataattcccaatttcccatccccccattctttggtaaccacatttctactttctgttgctatgaatttaacaaatctagatgcctcataggaatagaatcgtgtcatattgttccttttgtgactggtttatttcatttagcgtaatgtcctcaagattcacccatgttgtataatgtgtcagaatttatttcatttttaaggctgaatagtatttccttgtacatgtagaccacattttgtttatgccaaaaaaaaactgaaagcaggaccttgaagaggtgtttgcatacccatgttcatggcagtgtcattcacagtagccaagaggtgaaagccatcccaatgtctgctatcactttttatttttggaaaaactattctccctccactaaattgcttttgctcttttgacaaaaatccatttggtatatttgtgttgttctatttctggggtttctgctctgttcccttgggccatgtgtctgtccctccacccatatcatagtcttgattgtggccactgcagaataagtcttgaggtcaagcaaaatgcgtccttccattttttttccccaaaattatttgaattgttccagttttttcatctttccatgtaaactttgctataaactcgtcattgtctaccaagccttgtgctgggatttttataagaattgaggggatcaatctggggagaaatggcatctttcccacattaaaccttccaatccttgaacacagcatgggttttttaattcatttagatattctttgacttataataatgcgctttctaagattatacacagctttttgtctgtttgtttttgtaaagataggctgaaattcaggaaatcctcagcaagagacaaaaaaaaaatgaaattgtgtcagtgatgtgttgatggcagctcatacacactcacgagggccaactatgtgtatctcctccccgccttgagttcagtgatggcaccttggtagggggaactggcaatagtggacaaatggtggacaaatgccaaagcccaccatacaagtggacaaattccatgaagcaggctgtcttccttccttcttgcccttccccttcccctcccctcccttcccctcccctccctccctccctccctccctcccttccttccttccttccttcctgctttccttccttccatccgtctctcacccttctgtctcccttcccctctctttctttgaagggggttgttaaacacccacctgcatacccctgactatatctaattcatggctctactatgaagaagagtgagcccatggtgaggggcagcatgaagagaggttgattcatgggcataaatatatgcagctaaggaagggctaacacctagtgctccctagatcagtagggtgactatagtttacaatcatctattgtacatttcaaaattgttagaaggtaatcatttaaatgcttctaacataaataaaagacaaacatttaggctgctggatattaattacactgatttgatctttccatgtgatatgaatgtatgtgccctgaaaatatgtgcatctcttatgtatcaatataaacaattagcaaacaataaataagaacaatcccttgtgtctatgccctggttgtttctggagctggtgttcccgctgtcaacacccgtcttcctggtcatcacatttgctttcttatctagcactgaacgatggatctacccatttgtcagaataaaaatgtggcttggagtgcaaaagagggaaaaataaaataaaagttccaaaccaaccaaccaaacaaaaaacaaggaataaatatgagcttatatttttcagttaacttcctgttgtgaatatttttatttgtcataaaatcatgtttctgtgaaccctgggagattcagtaatagttgcaaatatgtgaagtgataggcaaaaaacaatgaacacctactatccatatttctgagaataaaataacaagagctgagttaaaacgtaatagaaaaggacatttatttcagtcctaagttgtattatccctggtaatttgcatataccattattaaagtgtggcagtcttttgtaattattgtcttaatctagtgaaaaataatatatctgtatatctggagagaaggctgttctctggatgcagctgagcacttgcatgcactcgatgaacgggaataggactgcatgaggctgacctggatttgacaaccgcaccaggacaaggccgcgtgctgccctgaacagtggcccttgtgctaaatacgaatcctctctctcccacaggcatagcccgtcacctgcgtctggtttttgctcctcattttcttcaattttcactctatttatagttgagaaccttccatttccccctggttgaaatacattagttgctatggaaactgcgatccccccggtgtggatggagctgaatgacacctacaattgcagagcacggttaggtcccttctggagccggcgtcgaccttctttttgcgtcctaacccagctcctccatcccatggtatcgttttctggtctcagttcttctccttcacaggatcttgttacttcataaaaatcaaattggccccacgttaatttatttggccatcagaacatggagacttttgccaacatagctatagaacctctgtttttgtttgattttatgacagggatggggtctcactgtgattacaggtgtgagctgccatgcccaaccaaaatctcttcatagatgcgaagtttgggaagctgtgccaggtcccagattcacctccagtgtgactccggggtcgggagtaggtcccttgagagccccagtcactggacttcacaggcagctaaaatgcaggaagaggttgggaagtcagggccactgatctgcttcagtaaaaaaaaaaaaaaaaatcagaattcttaagcttaccaccactttttgataagcaaaggcagaaaatgttaatgaataattaaaaggaatgcttatcagagatcttcccagcttagaaaatggaaagaattatgcacgtaacaaagctgcatgtattttaacaagggcagtagaaacacaagaacagatgcatgctaagtcggaagaaggacgattctagaattgtgcaagacaggcctgcactgctggggacccagatttgaggagggcggtcccggggaccacacagtctttgcagatgcctggaccgaggtcgactctgcatcttatcttccctaggggggccgcggtgccagtccttaatttgctcattgataaaacattttctaaggttagttcctatattattttaaaaagtgacaggacagggaattgaggctaagacagttgctcctcaatcagcttttctcgacagcacagctgagtgagataaaacacagggtttggacctaagatgaactgggtctaagtcccctgaactatcgctgaggggctatcagctgctcatggagggagtcagtgactccctctcctgggttttgtgtctcacaggtgtctgtgtgtgtgctgggggccgtctcaataatgtctacttcactggcatcgtgtagagattaaacccacttacaaggaagtcctagcagagtcaatcgttgacagtaagtgctcagtaaaccagagctgttttcattatcattctaatttccatagctcaggaacataaaggaataacactgaattctaaggacaaaggtgtggagccagtgtagaaaaatcactgggccaccaaagaagccctaaataatcatttatttccaaggacactggaga

SEQ ID NO: 460752 - DNA, 707 bp, Homo sapiens
ccattctcagcatagcttttatttgaagcctctagttttcacagtggagtggctaaaagaggtaagttctttgagggttgtgcaggaaaggtcacccactccatagtgaatggttatttgctggctgcttctcacactgttgcaattgtgatccttttgcatctttgattgtctttcatcggaaaactatgacatgcttcattttgtttcccagggtggtagccacagtcggcggtcagttggcgagctggctacattcgatggtatgcaaacaactcggtggcagcttaaagggtggggtaggcagtgtggccctcaatgtgcagttcgagtttcccaagttgaaggctcacagagtgattggaaaccaggagaaaaattactgtggtctgagcagggaaggaagaaaggtcctggacactcggcttctagagagatccacgtgcgccatgccgcaactgcattcagtgtcttccagcttccaacttgttgtcagccttcagaaagcacatcatttgtatctatattcaggagccagcccggtctcctggggcatgcggctgatcaactgtggggacctcgcttaagaaaagtaaatatttattcagaataaggaaagaaaccaaaataaattacagattttaaaatgctgacaaataccacaaacatcacaaaaatctggaaacatagcatactgtttttattaa

SEQ ID NO: 460753 - DNA, 1451 bp, Homo sapiens
ttatagaattcatggaacctggcacaaaatgaacacaatggcacttgctgataacaacacagaaataacaagggcagactttctgcagtgtctcctgagcaattggttgtcattgtcctaaacagagcagctaggttaaaaagatttatccataatgtaacctcctggccctcagctatgggtggaagcagcactttctggtttgacctcctaataccacaaactccactttgccagaaaagtgacttcttgatgaatagtctgttcagataggccaatttggagtatattcatatttggccacctgctggagcgtcaatgaccaagaggagaccagatgagttttcaaagcagtcctcaaacacccaggacacacctcatcctttacctcgtgctttctgcaatgttgctgttcatgttcatcttcctattaacatttgccataataacccctcattgaccaccatcattcctccatccaccaccaactcagctccttctctaaagtgccctctaatgggcagtggctttggtctctgtttggcaaattatgtccagagggttaacattaatttctctttctcctattcctccctcatgctagattcagtccatcactcagcctcctgtcaggaaaaccatagcaaatcctactttctgctaaaatgaagttacaagacacttttccagagtagtcacactcaatgaagggacccagggtgtatctgagtgtgatgtaattgaaaccacatggaaagactagaaataccttgctcccagtcagatatagtgaaacagcttactcaagactggactaagatttagaatataggggggctagggaggagaaagagaaagatcctcagaagtggattgtccctgaatacaggatgaaatcatctagatttttttctccaattaaatttgcatttcattcaaccacattgcaatggcttcatactgggcattttcatttgagacccaaggcttttcttcatgggtcctgagccacaggttcctggatggtgaggaaaggtttcttggaagactggaccagggagttcctaattcttccctggaccatctcaggggcatcctcggtgccaaaatagttctgctccctgatgaagacacctttaggaaaagaggaatccttttcctagacttcctccctgagggacttcccttggttgatatcatgggagctggactgtttttccttctccaaatccagtacattacctactggcatttttcatgtttctgcggagcttccaagcccctctctgtcttgattactggagcaagacagaaacaaggcagagaggcgccctcttctgggagggaggagcaaagacattgaatccaccaggaagccggcgttacaccagcataattttggctgctgcccttaaagttctgatgtgcatttcttccatttccaacgctac

SEQ ID NO: 460754 - DNA, 1240 bp, Homo sapiens
attgagaagctgctaatggagaaatgctcggagctctcggcagtcacagagaggtgccttcaggttgagaatgagcatgtcctgaagtcaatgaaggcctgcgtgagtgagaccctgagcatgctgggccagcactttggccagctgctggagctggccctgacacgggaggttcaggcactggtgagaaaaattgatgcctcagacaatatctacaccacagagtccaccacagggaacctgttcagcctgacccaggagggggctcccttgtgccgcatcatagccaaggagggtggggtcgtagcactcttcaaggtttgccggcaggacagtttccggtgcttgtacccccaggcgctccgcacgctggcctccatctgctgcgtggaagagggtgtccaccagctggagaaggaattccactcctagattgggatctctgaagaaactggcagatgttcaccagaagacatttagaagaatatttatagcagcactgtccattatagcaaaagctgggaagccactcagacacccatcgacgggagaatgcataaatgaattgaaattgatttatataatgaaataccatacaacagtgaaaataaatggatcatagccacatgcaacaacaagaagaggaaactctcactgaatttgatgcagctggtccacagacctcacttggagaaacagggcctgttggtgtgacaaatgtgacaatgatagcaaaggtggatggcgttctgtgcttggccgacatcctgaccgacaacagccactcagaggccacacgggctgaggctgcggctgtggtggcccaggtcacctccccacacctgcccgtcacccagcacctcagtagcttcctggagagcatggaggagatcgtgacagccctcgtcaaaactgaaagtgcttgtctggataacaatccccagggaattttttgtgacccacctctttcttttaaaagtgctaacggtgatctgtgtttctatttctctggcactctctttgtatctaattgaaatggaatgaaatttaatttcatcagaaaatttaggattagctctcggagtcaccatgccagggctgggaatatctgaaatagcatgaacttaggggcaacacagaacattgggcaaggagtcagaaccctgggtttggactcgggcttttcactcatccattcaagtggttatgtgcagcaagcctgcgccggtactgtgtgaga

SEQ ID NO: 460755 - DNA, 1309 bp, Homo sapiens
gaaccaccccagagccagtagcataaaatcctcatgtataatgttcacagattctgtgggtcagcagttctggagggcacagcaaggtgcttgtctctgacccaacaagagtcggccacctcagccctgcgcctggcctggtggaacatgggtcaccgccccaacctggggcagccgccccatcccaacgcagttgctgccgctctccatgcctccctgtgcccagctaaccgggggacttgtcccctgggaaaacctgggtacccaggctgcctttggtttcagcccctactcctcttcccgggctgcctgtgctccccggacggcccctttccccgggctgtgttcacatcggctgggaagggtcccttgcagacagatcttggacgaggtcgcgtcccccctcgtgaccagcaaactcctaaaagcggcccttgccccagagcccctgtagcctccaaccggcagtcaggaggcagcgccccgcctccggccgcagaaaggcgttccctggacagagaagcgggcgcgcgggggcgggcgcgcggggccttgccggagaacctgactctccgcagcagcagtggaagccggagtgacgcgttgtttcaaagccacttcaactgcactggcccctgtgggtcactgctgcaccgccctgacccatgtgggtccctgaggagcgacctgccggggccacctggctggatgaaaaagacacaccttggacttaagccgtgagaaaaaaaaaacttcatcagtaagaagaatgaataaacagactaggttgaatccatacaatggaatgttagcagacaataaaaagaaaatgaactattgatgccccctactgcacagcagaagctctgaatcgtgttcctgaatgaaagaagtcaggggcctcatagacattcactccacccaacaaccacagaatatacattcttcctatctgtacacagaacatattctcagatcaaccatatgctgagtcataaagcaagtctcaataaattttaaaaaattgaaattataccaaacacactcttggaccacagtgcgataaaaatagaaactaatatcaagaagatctctcaaaactacacaaatacatggatattaaacaactttttcctgattaactcctaggtgaaaatcaaaattaaggcagaaataaaaaaatctttgaaagtaatgaaaatggagatacaacttaacaaagtctctgggatacagccaaagcagtgttaagaggaaagtttataacgttaaatgccttcaccaagaagttaaaacaatctcaaattaa

SEQ ID NO: 460756 - DNA, 798 bp, Homo sapiens
gcttgggtaaactattcacaaaggaacgtagacaaatgccagtacacacatgagaagcgcatacacatccacaaacttcaaacaagcccacctcatgtatttctagtgagtaaggaaaagaacgcaaacacttttgaaaattgtttggttgtttcttgtaaatttaaacaaataccctattatattatccagcgagtccatccttaggtttttatccaaggataaagaggtgaaaactcatatctaacaaatagacttctgaaaagatgaaaatagaagctttattcataaaagacaaaaactggaaataacccaaatattcattcacaggagaatgaataaacagactaggttgaatccatacaatggaatgttagcagacaataaaaagaaaatgaactattgatgccccctactgcacagcagaagctctgaatcgtgttcctgaatgaaagaagtcaggtatgaaagaataaacattgtatgattccatttatatgaaaatgaatctgtgatttaaaaatcagactagtattaggttggtgcgacagtaattgcgttttttgccttttttttttttaatagttgctttggggtttatggatggagtggcatggtagaggttagctgaagggggcatgaaataactttttgggggtgctagagtgttgtaaatcttacagtgggggagggacaggagtgcaggcatttgacaaaacacattgaattgtgaaatttaagatttttgaatttctttgtatgtaaattacctgccaataaaaacatgacgaatagagc

SEQ ID NO: 460757 - DNA, 1066 bp, Homo sapiens
actcaggaatggccaactgcaaagtccatgtgcttgaacagtatggcatactgatacatgcacctgccatgaccagaacacaatacagtgatctggcagcacttcgtggctcaccatctctgctatactgataacaacttgagggctggacctacttatcttattcaacaaggaccctctcagaggttagggttgcccagtgcaaagatagcaagtcatgtgacacatgggccacctcacccctcctgcagccattgataactttcttctttgaacatggcattctttcgctctaagcccagttaagaattcagaatccttctaggcccagtttttaaagcagcgaccaccaatctattggtgctgacatgaattcaaaagatactttctatcccttatctaaatagttcataagatgatgaggctgaactatggaacaaatgtagtccatcagagatttctagaaaaaaaaaacaactctcaatagtcctagaagtttggaaatgagtattaatcccaggataatccacacacatcttgtcttatggcctgatgccaagtgatgtggcccttatctaatagcacatttgcattttaaatgagtaaagctggttaaacctctttttctaatttcagctattattttatctacaggggcctcatagacattcactccacccaacaaccacagaatatacattcttcctatctgtacacagaacatattctcagatcaaccatatgctgagtcataaagcaagtctcaataaattttaaaaaattgaaattataccaaacacactcttggaccacagtgcgataaaaatagaaactaatatcaagaagatctctcaaaactacacaaatacatggatattaaacaactttttcctgattaactcctaggtgaaaatcaaaattaaggcagaaataaaaaaatctttgaaagtaatgaaaatggagatacaacttaacaaagtctctgggatacagccaaagcagtgttaagaggaaagtttataacgttaaatgccttcaccaagaagttaaaacaatctcaaattaa

SEQ ID NO: 460758 - DNA, 702 bp, Homo sapiens
gcttgggtaaactattcacaaaggaacgtagacaaatgccagtacacacatgagaagcgcatacacatccacaaacttcaaacaagcccacctcatgtatttctagtgagtaaggaaaagaacgcaaacacttttgaaaattgtttggttgtttcttgtaaatttaaacaaataccctattatattatccagcgagtccatccttaggtttttatccaaggataaagaggtgaaaactcatatctaacaaatagacttctgaaaagatgaaaatagaagctttattcataaaagacaaaaactggaaataacccaaatattcattcacaggagaatgaataaacagactaggttgaatccatacaatggaatgttagcagacaataaaaagaaaatgaactattgatgccccctactgcacagcagaagctctgaatcgtgttcctgaatgaaagaagtcagagatgaaaagatgggccaggagtccagtttctggaaggccaagaatcgaagtagcaagctgcagccgttttccagacaagcaggatgtggggatgcagaagaattcaggactggaggggcaaactccgtaagcaggggctgtcacgattcccatctccctctataaacctctctcttttcatgtcatactgttccatgttatatgtaactgttttaaagctacatactggacaaaaagtg

SEQ ID NO: 460759 - DNA, 1467 bp, Homo sapiens
gaaccaccccagagccagtagcataaaatcctcatgtataatgttcacagattctgtgggtcagcagttctggagggcacagcaaggtgcttgtctctgacccaacaagagtcggccacctcagccctgcgcctggcctggtggaacatgggtcaccgccccaacctggggcagccgccccatcccaacgcagttgctgccgctctccatgcctccctgtgcccagctaaccgggggacttgtcccctgggaaaacctgggtacccaggctgcctttggtttcagcccctactcctcttcccgggctgcctgtgctccccggacggcccctttccccgggctgtgttcacatcggctgggaagggtcccttgcagacagatcttggacgaggtcgcgtcccccctcgtgaccagcaaactcctaaaagcggcccttgccccagagcccctgtagcctccaaccggcagtcaggaggcagcgccccgcctccggccgcagaaaggcgttccctggacagagaagcgggcgcgcgggggcgggcgcgcggggccttgccggagaacctgactctccgcagcagcagtggaagccggagtgacgcgttgtgttgaacaccagttttctggagcgctgtgtgttcttaacagctgagcagtctgtttctccaatcaggtttcaaagccacttcaactgcactggcccctgtgggtcactgctgcaccgccctgacccatgtgggtccctgaggagcgacctgccggggccacctggctggatgaaaaagacacaccttggacttaagccgtgagaaaaaaaaaacttcatcagtaagaagaatgaataaacagactaggttgaatccatacaatggaatgttagcagacaataaaaagaaaatgaactattgatgccccctactgcacagcagaagctctgaatcgtgttcctgaatgaaagaagtcagagatgaaaagatgggccaggagtccagtttctggaaggccaagaatcgaagtagcaagctgcagccgttttccagacaagcaggatgtggggatgcagaagaattcaggactggaggggcaaactccgatgtgactgaggccccactgccaaatagcagcatgctcagatagcacccaggaatttggggaaaaaaactggtgctcacagctgcccagttaaggcacaactctcccgcctgctgcagggcttgtgaggtgtatcagaaccttgaagagatactctgggaagaaaggccttcccagactgcctctccgcagcgctgtaagaatcagatttcttctatgggggacttccaggtctcttcagcattttctcagtcatcactgtatccctgccactcagtgaaccacagcaacaactcccagcttccagccgagaagcttgaccctgaagctggcctcgattctctacagaagtgaggccacagagcacaggtgaag

SEQ ID NO: 460760 - DNA, 954 bp, Homo sapiens
acaaccctgagccttcgcgggagggccttccggggggtccggatgctctgcctgcccctcagtgccggattgtgctggagggtagcttggcccagccccattgcggtggccctcagggtggtgggctttgggggcctggggagagggtgctccttcttgtccttgtccctggctcccagcggctccgtggaggatggcactgcctcaggcccagctccacctcctccctgcaccctcccagcagttgctgcagatgagagcggcgatgggaccagggtccagagcaatggaggctccgtgcctgggagcgggttctgccggctgcggaaggataggggtggcacagtcagccgccttggggacacaggacataggggacccaccaccgccactgccgctcccgcagcagctcgtgccgccaccacccacgcctccttgctgcagccagcgtgacgacagcggctgctccggaccacccgcaagcggccatcacggcaagggactaaccgtcgtgtaactactgtctgccacaaaaatctctattattatctttaaagggaaacttcttcttaaactaaaaatgcttttgttcctaatatattgggacatcgggacatttcctgggtctgttgtttcctgggtctgtttggtaaaccttgttaacctgttcccttcactataaacatcctgtgacttagaatgcctagcctcttgggaaggcatcccagcagcttcctcattttacccagcccctgttcaagagggagtctctctggttccaacacctctgacagttttgaagagaaaaaaataatcctcttgaatgaatcttctgataattctcacctaatgtgattggaatctactgggcctactagatggagcttgttgaaagagaggggagctctatgagctcccaaaatacgtcaaaaaataaaaattagagaacaaaaa

SEQ ID NO: 460761 - DNA, 1011 bp, Homo sapiens
tgggcgttagatgaagacaaaagagcattccatcgtagaagacaatgtagcatgtgacggttttggtgaagatgtgtgttttcacaagtttatcaaatatggagttcttagcactagtattctgattgaagatctccccaattggaataacttacacattactggaggactccaaaaactggtgaaaattacagcaatgaatgagaatgtcactctcacagatcagccctcgatagaattctggagtgctgtgaccactgttttcctcatgctccctgaaagcttttctgaaggaaacctctctacagagattgccggactgtcctatttagattaccaaacggcatatggcaatagatttgatgcaaaagcagacacgaatatctcgttatctttgattaagctagacattaagtaaagacattggaaaacactaaacattaaaaacaacgccacacttcttaacgtattttttctgggaagtattgttataaaatgttatttatgttaacatgtagggttttaaaaattatttttatgtaaagatttcccaagaccaaaaagcttaggagcactgccccattccactgttctgctgctggttttgctttgactctcccagaggaaaaccggggttgtcactggaagttcctgaagtaatctccttttttagcaaacttttcattattacactatttgggtcatggtacaactttgctgaattgccttgaactgaagtattggatttttactttaatttatcctgtgattatgctgattttgcttcactgatattctgtcatgtccttagatttctaatgaaactgctcagaaatcaaccaggtaaaattttatgggaaagttaggtggggaactagcacttggttatgtttgtataaaaagaaacccacaaaattttttctcaaaacagtgtttctggttgtcaaatgaaataggggagcaattagacttctgtctggtgagtagattaaaatatttctgctgactgct

SEQ ID NO: 460762 - DNA, 955 bp, Homo sapiens
ccgccagttcccaggccccgtgggatgagccgtgtcctcacggcaagcctgccctgcctgacctctgggaaatccctgtgtgggctgcaagattcaagatgcattggggatttctccctcaaaaatatcttctccatggatgccccagggagctctcatggaagctatcagagtggtctttgtccaggagatgcagtcatcctcatggaagctatcagagtggtctttggccaagagatgcagtcatcctcatcgaagctatcagagttgtctttggccaggagatgcagtcatcctcatggaagctatctgagtggtcttttggctgggagatgcagtcatccacagatctcttcttgttttagccacctctctctcctccatgggctctctaaggaaaatacatgcataggctaaactggcaaaggaaagcaaagtaacgctttattattaattgggactttggttccaagcctccaaacagaattccattaaactatgttggactcaataggagctgttagaaatgtagaacctcagagcctacattgaagatattgaatcggagtctgcacatcgcttctgagaagccatgagctaagctgatgccattcagctgggtagcatcgcagtcactgtgcaacttttaaacatacagctgcccaggcccactgcagacctgctaaattcaagctccttgtagtggggccagggccctgggacttcatacaaaactctgcaagtcatcactgatgagaaaaccaagactcgatgagagtctcctgagctcagaggaagaagctgcataaccagcacacttccagagaggaccgaggaagagagcgttgcttcagccagggtctgattagtcatgcctggcaggctctgctgagctgggtgctcatgggttttgcttgctgagctgaattaatatattagtggatttcatgtttga

SEQ ID NO: 460763 - DNA, 1808 bp, Homo sapiens
ttggaggccatgtcacctgagagtcaatgggcaacgatcaaatttcaccttgagcagattcttttgtttgctttttagtcacaaatagcttggccctaagtggtggctcccattcttgtaagatgcgtttattcatcgtgtaatcaccagttccctgtagtgggggcgtggatggagtgtcagaggctcctgctggtctttagggtgtctggcctccaggaatcctagaggtagtatttggagagatttttaaaagctttgtttctgtgaccagcaaaacctggatttgacactgaggtcagcccgtttcagccagtgacgtaacctgtctttttgccccagtaaattgggaactacagcactcgatgttagagttgtcgtgaagattaaagaaggtgacgactggacaactcccagcccaatacctgaaactgtaccagcacccagtgagcactgctattcctgtgactgctgcacatttgccttatctcagcagtatgcctgtgtcacttttttggcactcttttctcatgggtacattcagagaagaggaatgtttgttcactggtgaagagaacatcccgtgtactatcgtgtagaagttgtagtagacgctgtggtctttccaacaacaaacaaaggctgagagctccaaggagctgtgaatcacacctccgactccccccagggtacaggaacggggttcagaatgctcttcccaaagctgctgggacaggacccaggaggttccggaggatcaggaggtccacctgggagaagagctgatcggctagtaggagagctggaaaagcaacagacacctacttagtcccttccctggggcccggctccagtctgagctgtcacgccacagcaaaggcatcacttcaggacagcaaagcccctgtctccctcccttccagctcctcagacttcaccctggtaacacgtttgtttaaaaaacatatttttcccccttgtaaagaatctaggatacaaggggtcagcccagcagtttaggtatcaagaagaaactgctctcggagctaaagtaagaaacagtgcctgtctatagcgcaaataaagagttggaacaagataaaaggcagtgatccttcaccagccaatctccaggtggatctcaggaatcctgtgtgatgtgtgacatcatctgggaaagccccgcagttgccatggagacgcacctcccaggcctcgggaagctgccccacctctctgccaccttcttccagactggtcatggcaggctggctctgatctgggtcccagacagaggggaattgaaaccagagggagaggaaatcaagagccagggcggggtgaatttcaaacagcccagggctggagccggaacgggaaccccagctccacctcatcagggccaaataaccagctgctatgagggggcaacatgctatcgggataaagcatatgaaaccatagaaccttcaacaatagggcgtgaagaaaaaaacagaaaaataaggccacacgggcccagaaggaatgcattgctcagtggccccaacagagaaagtggaaccacgagcctgcagagaaaaaggcaagcagctgggaaagaactggatgcaggggcttggtggggacaatgtcccccttctactcacagcggagtgggtcgggaggagagccctgtggaaatacctaaaacactcagacttagccttcaagggagcatcacctaggaaaggttttctcccctctcctgactgtggcacaaaacgaagaatctccaatgtgcacggggacactttaatgagatttcc

SEQ ID NO: 460764 - DNA, 1251 bp, Homo sapiens
tcttgatgtttacactgcactatggaccaaggacatcagaatccctggggtgggactgaggctggcattggtcttttgttaccgctccccaggggacggggaattccagtattcatcaaggttgaggataactgcattggaggaaagaagcagctaactacctggatccttaattcctatctcttcttttcccaggagccaacaggaaaaaatgcaccaggagggaaagacaggaaaggagggacaagagaggaaggggggctccacacatctgcagcaggaaaggctcggattgcaccacccacccctgcctgctgcacacgaggctgggagctaccttggactttgtggtcgtggtcatcctgcaggattgagagcagcatcatggctggcggtgagatcttccacctggaggagagtcgcagttactggttagacagagagctgcttggagaacagaagtggaattccgtgagtggaaaaggagagctggactttggtggtgatgtggcagccctcggaatcacggggaggtcactgccacaacctggctctttgtaggggggtccaactccaggcaggggatcactgcctgaggtacctctttagagtcctgagtgtggctcctggaccatccccttcccactgcttgtccacgcgcttgcaccgctatgagcgatgacggcaaaggaaaagaaaagcgtcctccctacgaggtggtctgtttcccagtggcagggggagctacggtacacaagcacaggttcacatttatgaagcagccaataagaattcccagcctgagaggaccttggaaccagaaggaattggaggagatttaaacaagctgacccaaggaaagcacaagatctttctatgcattgaagatcaccaaatcaaagataaaagtgctcgaccattatggcctatggcaaactcgggctggctgaagcatccttctcttccatttagaaccctggtgaggccccttagaccaccactgggctgtcctcctccctcctcagagacagagttctgggctgggccatggaggtgtctgtcaacacggcagtagtcctcgttctatggaaaaccagctgttccctgtgacacgactccattcccgcagctgcctgctattcagctgggctgacggacagcagagcacagggttggaagaccaccctctcagacaggtttaccaagaagctcactgagaggcgacacaaacggccaagaacatgaaaagac

SEQ ID NO: 460765 - DNA, 1343 bp, Homo sapiens
cccttctttttatgcttctgatggtggctgagatcttcctctcaaagaactacattacacagtactgcttgctcctaccagtacctgacacgggtgtcaggcccaaccacgtgctcggtgtattcatagaccttagtcacggaagcacagtcttgtccggatgcacagcatgtgagcacttgctctccaaacttaccatcttccagctccggttaatacagcagaccattcatgcgtctaggaaccaaagaattaccctagggccctgctattatttgggcaagagactcataatgaccttacttgactggctgcataaaaagtcccaaatcttcctgccattcctttctcgtcttggcctctgggccgggagcacaaagcctaggaaaggacccagggacagaaaaaggaaatatcgagatgactcatctgaagcctgaagacactaagcagatggcccgagccacagaggatttcacagaagggcccggatgagaagaggacagatgcagggtactgatcactgcactagaatatgtgcaaccttccacgctgccttggggattctattcctgcctattgtccttggcttcttccccttgtccacttctgaacccataagcacgaatttcctctcctctccccattcctaattatccccatctcacgtgggtggcagaaagtcttcacattttccaggcttcatggcttagaactccttagggaatggtaccagtctctatatccaggataagtaggtatgcagttattttgtaagaccaggacatttgtggaagagagaaaccacgtgagcaaaggcaggcaggtgtggagtatgcacaccagtgaatctaagactgtgcaaactgtatgaataacaaatgaaaggaaacagagcaggcctaagtttcaagtgtgagaatggcaaacaacctgttacctatatcaacagttcattcttttctcttgctgagtaatattccattgtatgcatgcactacggtttatctataaacctgttgaagaatatgtgggtagtttccaaggtttgcctattacaaataaaattactataaatatttgtgtactggatttgtgtacacattttaatttttctaggagggtttttattttctcattcatttcaagagtgtccatgattgctgtcaaagcaattttgtaaaagctgctctaaagtctttgtcagataatgccaacatctgtgttctcagcatctcagcattgacatctgttgtcttttccttgtgcattgagattttcctggttcttcacacagcaggtacttttaaattatatcctcgacattttggatattatgttat

SEQ ID NO: 460766 - DNA, 2569 bp, Homo sapiens
  misc_feature (20)..(20): n is a, c, g, or t
  misc_feature (23)..(23): n is a, c, g, or t
  misc_feature (26)..(26): n is a, c, g, or t
  misc_feature (39)..(39): n is a, c, g, or t
  misc_feature (47)..(47): n is a, c, g, or t
  misc_feature (51)..(52): n is a, c, g, or t
  misc_feature (54)..(54): n is a, c, g, or t
  misc_feature (57)..(57): n is a, c, g, or t
  misc_feature (60)..(61): n is a, c, g, or t
  misc_feature (63)..(63): n is a, c, g, or t
  misc_feature (67)..(69): n is a, c, g, or t
  misc_feature (71)..(71): n is a, c, g, or t
  misc_feature (75)..(76): n is a, c, g, or t
  misc_feature (79)..(80): n is a, c, g, or t
  misc_feature (97)..(97): n is a, c, g, or t
  misc_feature (185)..(185): n is a, c, g, or t
  misc_feature (191)..(191): n is a, c, g, or t
aatcgcgtaatatggggtanacntantagaaaccaccgntggggttnttannanacngtnnangcannngnatgnngcnngcggggcggatctccgngcggcgagtcatctcctgggaaatggggcggacagtgtttccttgactgactattgtgagcgccctctctctccggcggagcggagancatggnccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtcctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggtgcctaggggacgggccctcgcgctggagcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgccaggaggaactggcactttttccgggcccggtaaagatgatctcgctcttctctagccacggcctgtttccgggcacggcccagggtctgtgccaggtcccccagtgctgccagcgtgtagcctttctggttggtcgggccctcgcccagcaggatgcgggcgacctcgtgcatagcccctcgtgtgcccaggggccccggcgggtgctcgcctgcttccagcacgtgggctgccgcctgcagggcttcttccgcagaggcgaagacttgctgggcacccagggctccggaaacgccgagcagtgtggcacagaagtcagagagcagcgcgtcgtcaccgccgtgatacagggcgagagtatgcgcgtaggcgaacagcacattgggcagctggaagcgcacgagcggcgagactgggccgcggctcaggctgactatcgcggggatgcgggtgggtacgacgggcgtgcaggcccccgggacatctccaagaacccgctcggcggccgcgggctccgcggcggaggcatctttcacagaatccggcggggtcctcgcaggggcgagctccagctccgcggcgtcactacccggggcattatccagctcctccagaagctgcggtccggctccgcggttccaccaccacggccgccatggaggcagcagccgcccggcctcaccgcggctcagcagccgctcgaaggcagctttttcgcccggcgccagccgctcccagagtgccatgcgtccggtagcagcgcagcgagcagtagggcgcattacagcgagggcaggtgtaacgcgctggctggacctcccccgccgggcagaagccacagggcccggccggctccatggcaactggcaccgcgatctacctgcgaacgcacgccggtggtagttcgaaacttccggggcttcttcgattacttccggttcgcagcgcggccgacggcgcgctgtggcgagagcaggcccagaagccgggcgtcaggtacgagccccgccctatgcgatgacgcaaggagcgaaaaaatgggtctggcgagcgcttcgccggtgccacgtctccccctagtggtcacaccaaaacgtggcccgatcatctaaagagaaaaccctcttttt

SEQ ID NO: 460767 - DNA, 2462 bp, Homo sapiens
  misc_feature (20)..(20): n is a, c, g, or t
  misc_feature (23)..(23): n is a, c, g, or t
  misc_feature (26)..(26): n is a, c, g, or t
  misc_feature (39)..(39): n is a, c, g, or t
  misc_feature (47)..(47): n is a, c, g, or t
  misc_feature (51)..(52): n is a, c, g, or t
  misc_feature (54)..(54): n is a, c, g, or t
  misc_feature (57)..(57): n is a, c, g, or t
  misc_feature (60)..(61): n is a, c, g, or t
  misc_feature (63)..(63): n is a, c, g, or t
  misc_feature (67)..(69): n is a, c, g, or t
  misc_feature (71)..(71): n is a, c, g, or t
  misc_feature (75)..(76): n is a, c, g, or t
  misc_feature (79)..(80): n is a, c, g, or t
  misc_feature (97)..(97): n is a, c, g, or t
  misc_feature (185)..(185): n is a, c, g, or t
  misc_feature (191)..(191): n is a, c, g, or t
aatcgcgtaatatggggtanacntantagaaaccaccgntggggttnttannanacngtnnangcannngnatgnngcnngcggggcggatctccgngcggcgagtcatctcctgggaaatggggcggacagtgtttccttgactgactattgtgagcgccctctctctccggcggagcggagancatggnccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtcctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatccgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgccaggaggaactggcactttttccgggcccggtaaagatgatctcgctcttctctagccacggcctgtttccgggcacggcccagggtctgtgccaggtcccccagtgctgccagcgtgtagcctttctggttggtcgggccctcgcccagcaggatgcgggcgacctcgtgcatagcccctcgtgtgcccaggggccccggcgggtgctcgcctgcttccagcacgtgggctgccgcctgcagggcttcttccgcagaggcgaagacttgctgggcacccagggctccggaaacgccgagcagtgtggcacagaagtcagagagcagcgcgtcgtcaccgccgtgatacagggcgagagtatgcgcgtaggcgaacagcacattgggcagctggaagcgcacgagcggcgagactgggccgcggctcaggctgactatcgcggggatgcgggtgggtacgacgggcgtgcaggcccccgggacatctccaagaacccgctcggcggccgcgggctccgcggcggaggcatctttcacagaatccggcggggtcctcgcaggggcgagctccagctccgcggcgtcactacccggggcattatccagctcctccagaagctgcggtccggctccgcggttccaccaccacggccgccatggaggcagcagccgcccggcctcaccgcggctcagcagccgctcgaaggcagctttttcgcccggcgccagccgctcccagagtgccatgcgtccggtagcagcgcagcgagcagtagggcgcattacagcgagggcaggtgtaacgcgctggctggacctcccccgccgggcagaagccacagggcccggccggctccatggcaactggcaccgcgatctacctgcgaacgcacgccggtggtagttcgaaacttccggggcttcttcgattacttccggttcgcagcgcggccgacggcgcgctgtggcgagagcaggcccagaagccgggcgtcaggtacgagccccgccctatgcgatgacgcaaggagcgaaaaaatgggtctggcgagcgcttcgccggtgccacgtctccccctagtggtcacaccaaaacgtggcccgatcatctaaagagaaaaccctcttttt

SEQ ID NO: 460768 - DNA, 2532 bp, Homo sapiens
  misc_feature (20)..(20): n is a, c, g, or t
  misc_feature (23)..(23): n is a, c, g, or t
  misc_feature (26)..(26): n is a, c, g, or t
  misc_feature (39)..(39): n is a, c, g, or t
  misc_feature (47)..(47): n is a, c, g, or t
  misc_feature (51)..(52): n is a, c, g, or t
  misc_feature (54)..(54): n is a, c, g, or t
  misc_feature (57)..(57): n is a, c, g, or t
  misc_feature (60)..(61): n is a, c, g, or t
  misc_feature (63)..(63): n is a, c, g, or t
  misc_feature (67)..(69): n is a, c, g, or t
  misc_feature (71)..(71): n is a, c, g, or t
  misc_feature (75)..(76): n is a, c, g, or t
  misc_feature (79)..(80): n is a, c, g, or t
  misc_feature (97)..(97): n is a, c, g, or t
  misc_feature (185)..(185): n is a, c, g, or t
  misc_feature (191)..(191): n is a, c, g, or t
aatcgcgtaatatggggtanacntantagaaaccaccgntggggttnttannanacngtnnangcannngnatgnngcnngcggggcggatctccgngcggcgagtcatctcctgggaaatggggcggacagtgtttccttgactgactattgtgagcgccctctctctccggcggagcggagancatggnccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtcctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatccgcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgccaggaggaactggcactttttccgggcccggtaaagatgatctcgctcttctctagccacggcctgtttccgggcacggcccagggtctgtgccaggtcccccagtgctgccagcgtgtagcctttctggttggtcgggccctcgcccagcaggatgcgggcgacctcgtgcatagcccctcgtgtgcccaggggccccggcgggtgctcgcctgcttccagcacgtgggctgccgcctgcagggcttcttccgcagaggcgaagacttgctgggcacccagggctccggaaacgccgagcagtgtggcacagaagtcagagagcagcgcgtcgtcaccgccgtgatacagggcgagagtatgcgcgtaggcgaacagcacattgggcagctggaagcgcacgagcggcgagactgggccgcggctcaggctgactatcgcggggatgcgggtgggtacgacgggcgtgcaggcccccgggacatctccaagaacccgctcggcggccgcgggctccgcggcggaggcatctttcacagaatccggcggggtcctcgcaggggcgagctccagctccgcggcgtcactacccggggcattatccagctcctccagaagctgcggtccggctccgcggttccaccaccacggccgccatggaggcagcagccgcccggcctcaccgcggctcagcagccgctcgaaggcagctttttcgcccggcgccagccgctcccagagtgccatgcgtccggtagcagcgcagcgagcagtagggcgcattacagcgagggcaggtgtaacgcgctggctggacctcccccgccgggcagaagccacagggcccggccggctccatggcaactggcaccgcgatctacctgcgaacgcacgccggtggtagttcgaaacttccggggcttcttcgattacttccggttcgcagcgcggccgacggcgcgctgtggcgagagcaggcccagaagccgggcgtcaggtacgagccccgccctatgcgatgacgcaaggagcgaaaaaatgggtctggcgagcgcttcgccggtgccacgtctccccctagtggtcacaccaaaacgtggcccgatcatctaaagagaaaaccctcttttt

SEQ ID NO: 460769 - DNA, 2266 bp, Homo sapiens
gagaggcagcaggtacagcagaagtcagtgcgtgggcatccgcatccaatgggtactgcacctttgatggtatctactgagcgtttcagtcaacaatacagctcgtgttcgacaatattccttgatgacagcacagccatccagcattatcttacaatgacaataatatccaccagccaggaggaccctcagttcagtgttcctcccactgccaacacacccacccccgtttgcaagctgtccatgcgctggtccaacctgtttacatctgagaaagggagtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcaagagcagtaaaagcaagtcccagctgaccagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagttttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaatggtggatccgttccaaatatgaggagaagctctttctggccccactaccctgcactgagctgtccctgggccagcagctgctgcgggccaccactgatgaggacctgcagacagccatcctgctgctggcacatggctcccgtgaggaggtgaacgagacctgggaatgtggtcctggagcagctcctgacggggtggacgtcatggcccgagatgcccacgggaacacagcgctgacctacgcccggcaggcctccagccaggagtgcatcaacgtgcttctgcagccccgacacatccaggagagcagctccaggagcctgcattggggagagagcctcagacccctgccacaggcctgcaccccagaattcgccactgtctgctgccacacgatgctgggaggcctggggaagctggctgccgagggcctggcccaccgcaccgagaaggccaccgagggagccagtgaggacccagggctcctttctacctgggctggggggatctggggcagactggttcatgccgtggaggaagtggtgaaggaggtggtgggacatgccaaggagactggagagaaagccattgctgaagccataaagaaagcccaggagtcaggggacaaaaagatgaaggaaatcaccgagacagtgaccaacacagtcacaaatgccatcacccatgcagcagaaagtctggacaaacttggacagtgagtgcacctgctaccacggcccttccccagtctcaataaaaagccatgacatgtgtacattgagcgctggatttattcccatttggatggaaacactaggcaaagtattttcttgttgacataacatattttacatatttatggtgtacacttaagtatttattacatgcacagaatagtgatcaatcagggtgtttggggtgtctatcaccttgaatatttgctacagctgaaccttatatcctggtttggttcctgatgactttcaaattctcctgacccaaacgcaagctcagaagcacaagcacattgttggtggcagtacagactgaaacaccctctttggatggcag

SEQ ID NO: 460770 - DNA, 785 bp, Homo sapiens
tgctaaggggatgggatggggaatgaaagaagccttattgaacacaccagatggtgcatggaccaccttgcagatatttgtccacctttgtacttccatctcctggacactcaaaagagctgtctccctcaacagagggagccaacaggctgacaagaacagcaattcccagatcaaggtcaaaatgacaccatcgctgtgggcagaagggcaggatttacagtggaaactgggatatgttcttggggctgcattcaaacaggagaaagctcgctggaaattgccctggccaggggacagattcacagaggagatgaggttgggacagatttctagctgtcattctgccttattcctgctgacaacaactccaggaagatgtatctatcttcgatttctagtgtcttccaaacgctcaagaagctcttccttagcataaatccgagtttatcctattgtcatgttacctcaccctgtgtttatttcctctggactataacatttcttggcacaaaaaagttggtgtaagatagtgtagtaagcatgctgccgctggaatcagacaaacttgaacttcaatctcagattctccacttgttagccatgtgacttcgccaactttacctggccaccctgcacttcagtttctcagtaagtaaaatgggcataacaataacgcatacctcttagagttgttgtgagaattaaatgagataatatatgtaatgctccacaatttagaggctagtaaatatcagttataaataaaatgtttttgagaaata

SEQ ID NO: 460771 - DNA, 822 bp, Homo sapiens
tgctaaggggatgggatggggaatgaaagaagccttattgaacacaccagatggtgcatggaccaccttgcagatatttgtccacctttgtacttccatctcctggacactcaaaagagctgtctccctcaacagagggagccaacaggctgacaagaacagcaattcccagatcaaggtcaaaatgacaccatcgctgtgggcagaagggcaggatttacagtggaaactgggatatgttcttggggctgcattcaaacaggagaaagctcgctggaaattgccctggccaggggacagattcacagaggagatgaggttgggacagatttctagctgtcattctgccttattcctgctgacaacaactccaggaagatgtatctatcttcgatttctagtgtcttccaaacgctcaagaagctcttccttagcataaatccgagtttatcctattgtcatgttacctcaccctgtgtttatttcctctggactataacatttcttggcacaaaaaagttggtgtaagatagtgtagtaagcatgctgccgctggaatcagacaaacttgaacttcaatctcagattctccacttgttagccatgtgacttcgccaactttacctggccaccctgcacttcagtttctcaagaactgccaaacatccaataactttcaatccagtccagcaaaacatacgtgagttcagtaaggaattgctgacttactgacctggatgtgaacctgaaatttctccctctgttttgttccttggaatgctataatgtatcagtgttgcttttattgatttaaaaaaaaaa

SEQ ID NO: 460772 - DNA, 1607 bp, Homo sapiens
  misc_feature (1587)..(1587): n is a, c, g, or t
  misc_feature (1589)..(1589): n is a, c, g, or t
  misc_feature (1592)..(1592): n is a, c, g, or t
  misc_feature (1594)..(1595): n is a, c, g, or t
  misc_feature (1598)..(1599): n is a, c, g, or t
  misc_feature (1601)..(1601): n is a, c, g, or t
  misc_feature (1603)..(1603): n is a, c, g, or t
  misc_feature (1606)..(1606): n is a, c, g, or t
gtgtttggcgtggggcgcactgttcagttgctctcctggatggctttatgtctccgcggtgtttcctagagtctcggcgtttctacctcttcgcaccctttcctgccaccctttgtcccctggaagcccggagacatcagcggctgcaattttgctactcgctgctcggcgtggaactgtcaggacaaaaaataatatccaaagatattttggcactaacggcgctatctgtagcaagaaagttgagcagtgtgaactgttgagacttccaaggagacttcagacaaccaagacagtgtaaaggaaaacagagaaaaagacttgttagacattattaagggcacgaaagttgaattgagcacagtaaatgtacaaacaacaaagccacccaacagaagttcacttaaaagctacaactggcgggcctcaaagagctttaggacatgctccaaagaagagaaatgagcccctgagtcctgagttggtggcagctgcatctgctgctctgttttgacaagcaaacaagccagaactgctcaggcagctccgtagcatgaggaagagtcaggggcacagagagatggagagagacctagttagtttcaataacaaaatatcagatatgaaaattgccagatgtgctacagctagaattaatataaggccagagcatcagattcagtttgaccaaggctatgacaattatcctggcctggagaagactgctgatcttagaaacaggttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttccggtgggaatgacaactttcggtcgtggaggaaacttcagtggtcgtggtggctttggtggcagccgtggtggtggtggatatggtggcagtggggatggctataatggatttgccacatctaatatgagcactgggaagaagactctttctaaggctgctcagctttagagtacatttcttgatggtntnagntnngtnncntntcnc

SEQ ID NO: 460773 - DNA, 1173 bp, Homo sapiens
gtgtttggcgtggggcgcactgttcagttgctctcctggatggctttatgtctccgcggtgtttcctagagtctcggcgtttctacctcttcgcaccctttcctgccaccctttgtcccctggaagcccggagacatcagcggctgcaattttgctactcgctgctcggcgtggaactgtcaggacaaaaaataatatccaaagatattttggcactaacggcgctatctgtagcaagaaagttgagcagtgtgaactgttgagacttccaaggagacttcagacaaccaagacagtgtaaaggaaaacagagaaaaagacttgttagacattattaagggcacgaaagttgaattgagcacagtaaatgtacaaacaacaaagccacccaacagaagttcacttaaaagctacaactggcgggcctcaaagagctttaggacatgctccaaagaagagaaatgagcccctgagtcctgagttggtggcagctgcatctgctgctctgttttgacaagcaaacaagccagaactgctcaggcagctccgtagcatgaggaagagtcaggggcacagagagatggagagagacctagttagagaaatgacccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgctaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccc

SEQ ID NO: 460774 - DNA, 1372 bp, Homo sapiens
gtgtttggcgtggggcgcactgttcagttgctctcctggatggctttatgtctccgcggtgtttcctagagtctcggcgtttctacctcttcgcaccctttcctgccaccctttgtcccctggaagcccggagacatcagcggctgcaattttgctactcgctgctcggcgtggaactgtcaggacaaaaaataatatccaaagatattttggcactaacggcgctatctgtagcaagaaagttgagcagtgtgaactgttgagacttccaaggagacttcagacaaccaagacagtgtaaaggaaaacagagaaaaagacttgttagacattattaagggcacgaaagttgaattgagcacagtaaatgtacaaacaacaaagccacccaacagaagttcacttaaaagctacaactggcgggcctcaaagagctttaggacatgctccaaagaagagaaatgagcccctgagtcctgagttggtggcagctgcatctgctgctctgttttgacaagcaaacaagccagaactgctcaggcagctccgtagcatgaggaagagtcaggggcacagagagatggagagagacctagttagtttcaataacaaaatatcagatatgaaaattgccagatgtgctacagctagaattaatataaggccagagcatcagattcagtttgaccaaggctatgacaattatcctggcctggagaagactgctgatcttagaaacagttcagtgctttaccaaggcatttcctctctgccgtgacttgctttaatccaccatcctgttcaccggacgttcggttgagaaagaagaatgcaaggcactgaggaaagttctggagcagaaaagcctttgtttacaaataacttgggaacctgctagaggaaaacttgtatgacttgaaatcacattacttaatgttcatatgatattttcattttttccggttctatttagtagagaaaagtagtttagtccataaaaaaagaatttagaattatttttaaaattagccctccagtttataaactggattttaatctgccagtaagtttattcaagtaaatatgtaaattgatgcataaaacagttgattatcaagtttgcaagaaaatgttacctgttaactctgatattaatttcaatggttaaaaagtcatgtaaagaaagttaattattttacagaatgattgctttatgaaagggaatgttgtgatttacctatataatcttttgtaattataatttgtaattaaacattgcagtgtttcctgcccttaaaaacaagtgttgactctttttaacagcttcttttaattataatttgtaattaaacattgcagtgtttcctgccct

SEQ ID NO: 460775 - DNA, 1004 bp, Homo sapiens
aagccagctcggcaaggggaataaggggaagcaatggtgagatgccaagttgttcaccctgatatgacttgggcaggtctggggtatcaaccccagacaacccaggcctggacttattgcttctgttggaaattgacagttcacactggcctttctcagaatgttggcactgccactgactaattctgtgaccggggcaccttttatagcctccatcagcctgtttccccagctgtaaaatgctgaaagtgaaacctagcttaaatggctttcttgaggaatagaaaagaaaccacgtataaactctctggtacatagtaggtgctcagcaaatgtccattccctttctctgttgtgcattcctcttttgaagttcagtgctttaccaaggcatttcctctctgccgtgacttgctttaatccaccatcctgttcaccggacgttcggttgagaaagaagaatgcaaggcactgaggaaagttctggagcagaaaagcctttgtttacaaataacttgggaacctgctagaggaaaacttgtatgacttgaaatcacattacttaatgttcatatgatattttcattttttccggttctatttagtagagaaaagtagtttagtccataaaaaaagaatttagaattatttttaaaattagccctccagtttataaactggattttaatctgccagtaagtttattcaagtaaatatgtaaattgatgcataaaacagttgattatcaagtttgcaagaaaatgttacctgttaactctgatattaatttcaatggttaaaaagtcatgtaaagaaagttaattattttacagaatgattgctttatgaaagggaatgttgtgatttacctatataatcttttgtaattataatttgtaattaaacattgcagtgtttcctgcccttaaaaacaagtgttgactctttttaacagcttcttttaattataatttgtaattaaacattgcagtgtttcctgccct

SEQ ID NO: 460776 - DNA, 644 bp, Homo sapiens
gtgtttggcgtggggcgcactgttcagttgctctcctggatggctttatgtctccgcggtgtttcctagagtctcggcgtttctacctcttcgcaccctttcctgccaccctttgtcccctggaagcccggagacatcagcggctgcaattttgctactcgctgctcggcgtggaactgtcaggacaaaaaataatatccaaagatattttggcactaacggcgctatctgtagcaagaaagttgagcagtgtgaactgttgagacttccaaggagacttcagacaaccaagacagtgtaaaggaaaacagagaaaaagacttgttagacattattaagggcacgaaagttgaattgagcacagtaaatgtacaaacaacaaagccacccaacagaagttcacttaaaagctacaactggcgggcctcaaagagctttaggacatgctccaaagaagagaaatgagcccctgagtcctgagttggtggcagctgcatctgctgctctgttttgacaagcaaacaagccagaactgctcaggcagctccgtagcatgaggaagagtcaggggcacagagagatggagagagacctagttagagaaatgacccaccatcaacgaaaagaaagaaaggcgtaggctg

SEQ ID NO: 460777 - DNA, 640 bp, Homo sapiens
gctgttcaccggatggtggattaaagcaaggtcacggcagagaggaattgctttaatccaccatcctgttcaccggacgttcggttgagaaagaagaatgcaaggcactgaggaaagttctggagcagaaaagcctttgtttacaaataacttgggaacctgctagaggaaaacttgtatgacttgaaatcacattacttaatgttcatatgatattttcattttttccggttctatttagtagagaaaagtagtttagtccataaaaaaagaatttagaattatttttaaaattagccctccagtttataaactggattttaatctgccagtaagtttattcaagtaaatatgtaaattgatgcataaaacagttgattatcaagtttgcaagaaaatgttacctgttaactctgatattaatttcaatggttaaaaagtcatgtaaagaaagttaattattttacagaatgattgctttatgaaagggaatgttgtgatttacctatataatcttttgtaattataatttgtaattaaacattgcagtgtttcctgcccttaaaaacaagtgttgactctttttaacagcttcttttaattataatttgtaattaaacattgcagtgtttcctgccct

SEQ ID NO: 460778 - DNA, 2570 bp, Homo sapiens
gtgtttggcgtggggcgcactgttcagttgctctcctggatggctttatgtctccgcggtgtttcctagagtctcggcgtttctacctcttcgcaccctttcctgccaccctttgtcccctggaagcccggagacatcagcggctgcaattttgctactcgctgctcggcgtggaactgtcaggacaaaaaataatatccaaagatattttggcactaacggcgctatctgtagcaagaaagttgagcagtgtgaactgttgagacttccaaggagacttcagacaaccaagacagtgtaaaggaaaacagagaaaaagacttgttagacattattaagggcacgaaagttgaattgagcacagtaaatgtacaaacaacaaagccacccaacagaagttcacttaaaagctacaactggcgggcctcaaagagctttaggacatgctccaaagaagagaaatgagcccctgagtcctgagttggtggcagctgcatctgctgctctgttttgacaagcaaacaagccagaactgctcaggcagctccgtagcatgaggaagagtcaggggcacagagagatggagagagacctagttaggaaaaatatattcagggggaagagatgtaatagatttcacattatggcagttactaaagaagcacgtgaacagacacatcaccttcactttgggatatggaatttgataagcagttagccacagaatatgaacaaccccttgagaatgagattgaagaactgatccaggggaccaaaagaggggaaactgagagttcccaattaataatgaagcagcttcatatctaagatctctggtggactttttctgcccgtggacgccgctgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttccggtgggaatgacaactttcggtcgtggaggaaacttcagtggtcgtggtggctttggtggcagccgtggtggtggtggatatggtggcagtggggatggctataatggatttggtaatgatggaagcaattttgaaggtggtggaagctacaatgatttgggcaattacaccaatcagtcttcaaattttggacccatgaagggaggaaattttggaggcagaagctctggcccctatggcggtggaggccaatactttgcaaaacacaaaacccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaa

SEQ ID NO: 460779 - DNA, 1745 bp, Homo sapiens
caaacacaaacccacatacggctaggacgaggctggtttgaatcggaagaggttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttccggtgggaatgacaactttcggtcgtggaggaaacttcagtggtcgtggtggctttggtggcagccgtggtggtggtggatatggtggcagtggggatggctataatggatttggtaatgatggaagcaattttgaaggtggtggaagctacaatgatttgggcaattacaccaatcagtcttcaaattttggacccatgaagggaggaaattttggaggcagaagctctggcccctatggcggtggaggccaatactttgcaaaacacaaaacccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaa

SEQ ID NO: 460780 - DNA, 499 bp, Homo sapiens
gaatttttacatagaatatttcacttaaatttttttctcataattttgttgacagtttatattcattaaaatgttcttttttttaggaaaaatatattcagggggaagagatgtaatagatttcacattatggcagttactaaagaagcacgtgaacaggtttgttaagaataactatttctcaggtggaaaaatattccatcttttcaagatgtccttagtgttctgatggtgtaatagttggatattttaatattccctcctgtcattggcctggattcgaatcatgaatgtggcggttgttagaaggaaaacttgggactgtaaattgggaaggcattgagagaccaaagaataatttgggcaagaccagcttgatgaatagatgagtttactaggacttacctactggacatttctgggcagctctagagtcaccctgcctcttatctctaaactgcttttaagcttatatgctggctgtttgcctacatgtgtg

SEQ ID NO: 460781 - DNA, 2497 bp, Homo sapiens
gtgtttggcgtggggcgcactgttcagttgctctcctggatggctttatgtctccgcggtgtttcctagagtctcggcgtttctacctcttcgcaccctttcctgccaccctttgtcccctggaagcccggagacatcagcggctgcaattttgctactcgctgctcggcgtggaactgtcaggacaaaaaataatatccaaagatattttggcactaacggcgctatctgtagcaagaaagttgagcagtgtgaactgttgagacttccaaggagacttcagacaaccaagacagtgtaaaggaaaacagagaaaaagacttgttagacattattaagggcacgaaagttgaattgagcacagtaaatgtacaaacaacaaagccacccaacagaagttcacttaaaagctacaactggcgggcctcaaagagctttaggacatgctccaaagaagagaaatgagcccctgagtcctgagttggtggcagctgcatctgctgctctgttttgacaagcaaacaagccagaactgctcaggcagctccgtagcatgaggaagagtcaggggcacagagagatggagagagacctagttagacacatcaccttcactttgggatatggaatttgataagcagttagccacagaatatgaacaaccccttgagaatgagattgaagaactgatccaggggaccaaaagaggggaaactgagagttcccaattaataatgaagcagcttcatatctaagatctctggtggactttttctgcccgtggacgccgctgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttccggtgggaatgacaactttcggtcgtggaggaaacttcagtggtcgtggtggctttggtggcagccgtggtggtggtggatatggtggcagtggggatggctataatggatttggtaatgatggaagcaattttgaaggtggtggaagctacaatgatttgggcaattacaccaatcagtcttcaaattttggacccatgaagggaggaaattttggaggcagaagctctggcccctatggcggtggaggccaatactttgcaaaacacaaaacccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaa

SEQ ID NO: 460782 - DNA, 1497 bp, Homo sapiens
cccagggcggaggcctcgcgcaaaacccaggcgccgcggctccgcgctccggctgagggtccgcgccgccgcccgcccgctccttcccgctcggccgcggcctcagggacggatactccagcgcgcggttccaaccgaggcccgtggtgggtttagccccacgaagatgaactgggcacccgcaacgtgctgggctctgctactggcggccgccttcctctgcgacagcggcgcagccaagggcggccgcggaggtgcgcggggcagtgcccggggaggggtccgcgggggtgcgcgcggggcctcgagggtgcgcgtgaggccggcgcagcgctacggtgccccgggctcctccctgcgcgtggctgccgccggggcggcagccggggcggcggcgggagcggccgcgggcctggcggcgggctcgggctggagaagggccgcgggacccggggaacgcggcctggaggacgaggaggacggggtgcccggaggcaacgggacaggccccggcatctacagctaccgggcgtggacttcgggcgctggacccacgcgcggcccgcgtctctgtctcgtgctgggcggcgccctcggagccctggggctgctgcggccctaggcctggctgggctcggggaccacatctggcccccggcccgcgccatcccccaggatcctccggcctgggctcccccttcctcccttgcccacggtcttggagccccactgggtgcaggagctgctggctgtccctgtggacccgccatccaccgtcctgcccacgccgcctcagcctgccacctcccacctagaggagaccatgggccctgccccacccactccaggatgttagggtcccctcagccaaaaaggcagctgcctgtggctcctggcacagcaactgccaatcccgctgaagaggcctccctgggcacagcacaggctgcacggtgcacgcatttccctgaaggcagccccttcttcggaagcagctgttccaggcctcggaacagggcctgggctgatgagtgtgtggggtatggggcagcagaggcagccagccagcaaagaggggccactgagcaccagggccctggtggaggctgctgtgggacggtcaggccaccaccgcaaagaggcagccggagcttctgcacaggatgtccctggccccaggtcctgcagcaccttagaagctccgggagaaccaagcatgcggagctgctcagggacgtccactgggaagcctggtgtccactcccacctgcttgggccctgcaactggggtccctggagctggccaggctgtggggcgccagagagcacagcaccctagtgaccagcatggagcttctggaccggccggggggtggccccgcaggacgtcgaggtccagcatcacggaacccagcagcccacggcggaaagtctgcaggaagtcacgggctgccgcaggatagttaggctgaataatgttcacgttacctgggggac

SEQ ID NO: 460783 - DNA, 7996 bp, Homo sapiens
cctccctccaccttcgttccttctgagcagtctgtgcttgtcctctcctgcagaccaagtccggaacagctactacatcggggccgatggctccttgcggctgctgctggccaacggcatggaggtggcgctgcagactgagccccacttgctggctggcaccgtcaaccccaccgtgggcaagaggaatgtcacgctgcccatcgacaacggcctcaacctggtggagtggcgccagcgcaaagagcaggctcggggccaggtcactgtctttgggcgccggctgcgggttcacaaccgaaatctcctatctctggactttgatcgcgtaacacgcacagagaagatctatgatgaccaccgcaagttcacccttcggattctgtacgaccaggcggggcggcccagcctctggtcacccagcagcaggctgaatggtgtcaacgtgacatactcccctgggggttacattgctggcatccagaggggcatcatgtctgaaagaatggaatacgaccaggcgggccgcatcacatccaggatcttcgctgatgggaagacatggagctacacatacttagagaaggcaggtgtctgtctccctgcatcactggccttgccatacagaaggccaatcattcacggccaagcccagcctggtggcctcagtgggctgtatctgacccatgtcaccaaaaggaaatgttcaggaaagtctgccacagagggcatggggtcccaagaggcatcaggatggatcagggagatagcatggcaggtggtgtccatggtgctgctactacacagccagaggcagtatatctttgagttcgacaagaatgaccgcctctcttctgtgacgatgcccaacgtggcgcggcagacactagagaccatccgctcagtgggctactacagaaacatctatcagccccctgagggcaatgcctcagtcatacaggacttcactgaggatgggcacctccttcacaccttctacctgggcactggccgcagggtgatatacaagtatggcaaactgtcaaagctggcagagacgctctatgacaccaccaaggtcagtttcacctatgacgagacggcaggcatgctgaagaccatcaacctacagaatgagggcttcacctgcaccatccgctaccgtcagattgggcccctgattgaccgacagatcttccgcttcactgaggaaggcatggtcaacgcccgttttgactacaactatgacaacagcttccgggtgaccagcatgcaggctgtgatcaacgagaccccactgcccattgatctctatcgctatgatgatgtgtcaggcaagacagagcagtttgggaagtttggtgtcatttactatgacattaaccagatcatcaccacagctgtcatgacccacaccaagcattttgatgcatatggcaggatgaaggaagtgcagtatgagatcttccgctcgctcatgtactggatgaccgtccagtatgataacatggggcgagtagtgaagaaggagctgaaggtaggaccctacgccaataccactcgctactcctatgagtatgatgctgacggccagctgcagacagtctccatcaatgacaagccactctggcgctacagctacgacctcaatgggaacctgcacttactgagccctgggaacagtgcacggctcacaccactacggtatgacatccgcgaccgcatcactcggctgggtgacgtgcaatacaagatggatgaggatggcttcctgaggcagcggggcggtgatatctttgagtacaactcagctggcctgctcatcaaggcctacaaccgggctggcagctggagtgtcaggtaccgctacgatggcctggggcggcgcgtgtccagcaagagcagccacagccaccacctgcagttcttctatgcagacctgaccaaccccaccaaggtcacccacctgtacaaccactccagctctgagatcacctccctctactacgacttgcaaggacacctctttgccatggagctgagcagtggtgatgagttttacatagcttgtgacaacatcgggacccctcttgctgtctttagtggaacaggtttgatgatcaagcaaatcctgtacacagcctatggggagatctacatggataccaaccccaactttcagatcatcataggctaccatggtggcctctatgatccactcaccaagcttgtccacatgggccggcgagattatgatgtgctggccggacgctggactagcccagaccacgagctgtggaagcaccttagtagcagcaacgtcatgccttttaatctctatatgttcaaaaacaacaaccccatcagcaactcccaggacatcaagtgcttcatgacagatgttaacagctggctgctcacctttggattccagctacacaacgtgatccctggttatcccaaaccagacatggatgccatggaaccctcctacgagctcatccacacacagatgaaaacgcaggagtgggacaacagcaagtctatcctcggggtacagtgtgaagtacagaagcagctcaaggcctttgtcaccttagaacggtttgaccagctctatggctccacaatcaccagctgccagcaggctccaaagaccaagaagtttgcatccagcggctcagtctttggcaagggggtcaagtttgccttgaaggatggccgagtgaccacagacatcatcagtgtggccaatgaggatgggcgaagggttgctgccatcttgaaccatgcccactacctagagaacctgcacttcaccattgatggggtggatacccattactttgtgaaaccaggaccttcagaaggtgacctggccatcctgggcctcagtggggggcggcgaaccctggagaatggggtcaacgtcactgtgtcccagatcaacacagtacttaatggcaggactagacgctacacagacatccagctccagtacggggcactgtgcttgaacacacgctacgggacaacgttggatgaggagaaggcacgggtcctggagctggcccggcagagagccgtgcgccaagcgtgggcccgcgagcagcagagactgcgggaaggggaggaaggcctgcgggcctggacagagggggagaagcagcaggtgctgagcacagggcgggtgcaaggctacgacggctttttcgtgatctctgtcgagcagtacccagaactgtcagacagcgccaacaacatccacttcatgagacagagcgagatgggccggaggtgacagagaggaccaaggacttcttgccaaagacagctactcttttgtggccgcatacctgactgtgttgtacttttaaaaaaatgattttttaacaagtgcagaaacaaaaagatactggttgcattgtaactcatgcaacatccttttttttagaaaagaaaaacacagatttggccttcgcacattttttgcaaagaacagaaggtatttttttctgtagtgtgatcacaatgaaaactttattgtcttttgttccctttttccttgaggatttttcccttgtcgtttggggtatgtatctcctctctgagatgcatctcctggggtgtgtcctcgtctgtccctaggtacccagtgtgatgtgggacatgaatgtctgtgctaacttgtctcatgtgcaaccctttcttcttcgactggggtcgggcaggagtaaagggagtgatgggccagtacaacaccccttccaagggggcctgggaggagggtctgtaggacctgaggctccttggcagggctcctgcagaagagtggtggatttcttctcaccttgttctctgcctccagaggatcatagatggcttcatcttgctccagggaatttcatggtgttgttcagcaccttttttaagctgccccaaactcctgttcaagctttctattttgatgctgaatgaaaccccctaccacttttgcaaatcctgtgtagttgtcggtgccacccccatgctgggatagagaaagtgtctcccaggtcctttcccccagaccagtgacataacatcctgggctcagagtcccatcctcccgggagggaaagcacccaggatgcctgtgattggttggtcctccatgatgttcctgttcatctcctcctttctcccaaagccagatgtgagaacgagcactgcacagcaagccttcaatgtgggcaccatgtccacagaacagaaggccacccatggcaaaggcatggcagtggtggcgagggcaccagcctgccttccgaggcaaagccctctctctatgactttgagtatcttccctccaccactcagccgccaccactgagacgtaggaatgtggagggaggtgcttggtggcctttgattctggaaaaatgcttaacaaaaaaagccagccaaagagaggaaggcataagctaagcatccttctaaccagttcccaaagtcccatctgcctccatgtaccagctgatcgcagagctggactggggcaggctgggcttccaggaaattcctgaagttctgaaacagcttcccctctagagaagcccacccaatgtgttttttagtgacaggaagaaaggagggaagagctgatgtggtgtggcctgcccatatcatacaaccccaccaggagcagggcagttcccaaggtgggtgcccgtagatctgggaggccaggctggcatgattcctgtgaagaactgtgcctgtgtcgtcagggagaggcctgagccctctcagaagcagggacagcccacacctgaagagcacgcccaagctgaggcagcagccagcaggctgggggagcagtgagggcagggggagtcacagccagagctgggagccccttgttcaaggattccattcctggttcatccgcctaattaccattgtcattaccactcacaggaggctctgggagatgggaggggaagccaaatgcttccttttaagctgggcttcttagaaaatggaacttttatgggttacatttacattaagtgtggaaaatgaattctgagtctgagctattccccgtggaaaccttgttggactgataagctcatggcacctctatagccttactcacatagtcttcagaatattacacaagttaatgaaactgagaaggtctgactgcatgaggatcggagcagcatgtagtctgggttctgcctggcagagggaggcaaccaaaacttcttggggagaggagatttcgccttaacgtcatcccactgggattagaggatgtgtttcgctaagtgctcttcctgtttccaaaaaaaaagccaccctgctgcagcagtgcgctttggcctgcttgtccactggttgcccattgcccctggatccagagctctactgagtcagatacagtgctctgcaggcctgctgtgggaggcatgagctggagatgggggctcccatctggcaggatcattcttggatgagatggaaaacagtttggcctgaagaacacaagttttgtcctccagaagggacttacgcctctcaaaatgtactcttcataccaagggcccttgggcaaagtgctcctgcccagttgatcagtcccatcctggctgcctgacatcagtgaagacctgctggggatgtctgctcagaggtcaggaacggcatgcggtccacaggaaccagctccctacgcttcccccacgccctgtccctcctccacagccccctccccaaaggaatagggtggacttttagggatcaaaaacagaattattgggtgtttcatttctttttttctttctttcttttttttttcatagagatggggtctcactatgttgcccaggctgttctcaaactcctggcctcaggcgatccaccttggcctcctgaagtgctggggttacaggtgtgagccactgcgcctggactgagtgtttgtttctttaaaggatcttatatttttcctgtgctacataccaccacagcagcccagcttctgtggggagagaagttgaaggatcccgaagctttagaaaaaggatctcagctgtggcacaggcagtgttatgcgcctcactgccacattggtgctgttgtattgaaggtggtgcttctggccttggcccttttgagttggtttccatttgggctgcaggtgactcagtgactccctcctcaagctgtcctcctgctaagaccagcagtcacaaacccatggcaagggtgagtgtgaaggcctaaccctgtgcctatgtaataggctccaagcatcgactcccatcctgagaggaccggcccttttgacactcaccaaccaaatctgttcattcgatagagtgaccaggcctccctcacctgcccaggtgtatgatcctacagttcctgccttctctcctaccccgcacagctgccaactggtcctacatcctcagcccctctgccaccaccttaaataggactttactgattccccaactttgtttttttgtaggatgagatttcctttttatcccacccccccacaccccaaacagacattgctggagggcagactggaggaaggggaaggcatgcaggtaaattactgccttgtcagcctctgaccctcatctctcagaattgttggctgagaattaacccaaggaccacaccagtgcctgatttctacttagggagagaggattggaaacgatccctaagaaactgactgagggtgagaatggccaggaggtgtgtgtccaaataaccaggagggggcacagaagatgatggcaaggcagactgggcagtgttttgtagacacagaacaaagaatcagaatttgaaaaaagaagaaaaacaaatcttcgcagctgcaactttaaagtatcacctttatagatggcagggatttccattatgcaaatggaatctaagatttcaatgtgaaatcttagaatgcagttttaccacttgcagtcttgtatttgtggtggccatgtggtgagggcggtgatgctgagctttctgcccaggaggaatgagctttcaagctctcagcagggtgtcaggcttggggatttgagcatccactgctcaaagtccaggctattctccagtcctcacggcagccactaagcccaggagccagacctggcccggggacacatctcctgagggatcccagaaagaacccagtctttcctttcccttggggtccttgttagaatgaaaacctctctatttaaggcacatcattcccagctaggtttatacacttgtctatattttactggaggaaagggaattaaaaaagaactctgcagttcaaggccctttcatttaaccttccaaaaacagcaaactcattttaaagactcattgctgaggtgatagagagaaaccttatcctctccaacctttacattcacaaaaaccatccttgtgtacttgactgccctagacagtggtgactcttaggtttcattacgaatgtggaatatcagagtgtgggaaggcccaggcgagggccaatgttgtgtttcttaccccctctggaatgccaaaggcaaggtactaggtgacctcctggtccccaagaaaatgtgatttattctgagggcgaacagccaagggaggactagtctggagcacgctcggccgtcctggcaggagctgagcctcaggtgtctggcggtgccccagcagccctggattcacccaacaccagaatcccacttttctaaatccacctgttgttctgagcacctctgaacccgcagcttcggcaaaaggagtctgtaccaagctgcttctggatgaccaacactggagactctggccttaccatgtggaaatcattttcctgaagtctggaactaattttgagaagtttttttctcaacacttttgtgtttctaacactgtatcttgactgtgtaaataccaacaaggctgtaaataaatgcagatgtagataccttct

SEQ ID NO: 460784 - DNA, 1733 bp, Homo sapiens
  misc_feature (20)..(20): n is a, c, g, or t
cggcacgagggttaccattntgatgttggagcggcctccctcacctgcccaggtgtatgatcctacagttcctgccttctctcctaccccgcacagctgccaactggtcctacatcctcagcccctctgccaccaccttaaataggactttactgattccccaactttgtttttttgtaggatgagatttcctttttatcccacccccccacaccccaaacagacattgctggagggcagactggaggaaggggaaggcatgcaggtaaattactgccttgtcagcctctgaccctcatctctcagaattgttggctgagaattaacccaaggaccacaccagtgcctgatttctacttagggagagaggattggaaacgatccctaagaaactgactgagggtgagaatggccaggaggtgtgtgtccaaataaccaggagggggcacagaagatgatggcaaggcagactgggcagtgttttgtagacacagaacaaagaatcagaatttgaaaaaagaagaaaaacaaatcttcgcagctgcaactttaaagtatcacctttatagatggcagggatttccattatgcaaatggaatctaagatttcaatgtgaaatcttagaatgcagttttaccacttgcagtcttgtatttgtggtggccatgtggtgagggcggtgatgctgagctttctgcccaggaggaatgagctttcaagctctcagcagggtgtcaggcttggggatttgagcatccactgctcaaagtccaggctattctccagtcctcacggcagccactaagcccaggagccagacctggcccggggacacatctcctgagggatcccagaaagaacccagtctttcctttcccttggggtccttgttagaatgaaaacctctctatttaaggcacatcattcccagctaggtttatacacttgtctatattttactggaggaaagggaattaaaaaagaactctgcagttcaaggccctttcatttaaccttccaaaaacagcaaactcattttaaagactcattgctgaggtgatagagagaaaccttatcctctccaacctttacattcacaaaaaccatccttgtgtacttgactgccctagacagtggtgactcttaggtttcattacgaatgtggaatatcagagtgtgggaaggcccaggcgagggccaatgttgtgtttcttaccccctctggaatgccaaaggcaaggtactaggtgacctcctggtccccaagaaaatgtgatttattctgagggcgaacagccaagggaggactagtctggagcacgctcggccgtcctggcaggagctgagcctcaggtgtctggcggtgccccagcagccctggattcacccaacaccagaatcccacttttctaaatccacctgttgttctgagcacctctgaacccgcagcttcggcaaaaggagtctgtaccaagctgcttctggatgaccaacactggagactctggccttaccatgtggaaatcattttcctgaagtctggaactaattttgagaagtttttttctcaacacttttgtgtttctaacactgtatcttgactgtgtaaataccaacaaggctgtaaataaatgcagatgtagataccttctagaaaaaaaaaagcataaaaacaaaaccagaagtgatcccgtgtagccttcgttgacaaataaagactattttgtgttta

SEQ ID NO: 460785 - DNA, 8076 bp, Homo sapiens
cctccctccaccttcgttccttctgagcagtctgtgcttgtcctctcctgcagaccaagtccggaacagctactacatcggggccgatggctccttgcggctgctgctggccaacggcatggaggtggcgctgcagactgagccccacttgctggctggcaccgtcaaccccaccgtgggcaagaggaatgtcacgctgcccatcgacaacggcctcaacctggtggagtggcgccagcgcaaagagcaggctcggggccaggtcactgtctttgggcgccggctgcgggttcacaaccgaaatctcctatctctggactttgatcgcgtaacacgcacagagaagatctatgatgaccaccgcaagttcacccttcggattctgtacgaccaggcggggcggcccagcctctggtcacccagcagcaggctgaatggtgtcaacgtgacatactcccctgggggttacattgctggcatccagaggggcatcatgtctgaaagaatggaatacgaccaggcgggccgcatcacatccaggatcttcgctgatgggaagacatggagctacacatacttagagaaggcaggtgtctgtctccctgcatcactggccttgccatacagaaggccaatcattcacggccaagcccagcctggtggcctcagtgggctgtatctgacccatgtcaccaaaaggaaatgttcaggaaagtctgccacagagggcatggggtcccaagaggcatcaggatggatcagggagatagcatggcaggtggtgtccatggtgctgctactacacagccagaggcagtatatctttgagttcgacaagaatgaccgcctctcttctgtgacgatgcccaacgtggcgcggcagacactagagaccatccgctcagtgggctactacagaaacatctatcagccccctgagggcaatgcctcagtcatacaggacttcactgaggatgggcacctccttcacaccttctacctgggcactggccgcagggtgatatacaagtatggcaaactgtcaaagctggcagagacgctctatgacaccaccaaggtcagtttcacctatgacgagacggcaggcatgctgaagaccatcaacctacagaatgagggcttcacctgcaccatccgctaccgtcagattgggcccctgattgaccgacagatcttccgcttcactgaggaaggcatggtcaacgcccgttttgactacaactatgacaacagcttccgggtgaccagcatgcaggctgtgatcaacgagaccccactgcccattgatctctatcgctatgatgatgtgtcaggcaagacagagcagtttgggaagtttggtgtcatttactatgacattaaccagatcatcaccacagctgtcatgacccacaccaagcattttgatgcatatggcaggatgaaggaagtgcagtatgagatcttccgctcgctcatgtactggatgaccgtccagtatgataacatggggcgagtagtgaagaaggagctgaaggtaggaccctacgccaataccactcgctactcctatgagtatgatgctgacggccagctgcagacagtctccatcaatgacaagccactctggcgctacagctacgacctcaatgggaacctgcacttactgagccctgggaacagtgcacggctcacaccactacggtatgacatccgcgaccgcatcactcggctgggtgacgtgcaatacaagatggatgaggatggcttcctgaggcagcggggcggtgatatctttgagtacaactcagctggcctgctcatcaaggcctacaaccgggctggcagctggagtgtcaggtaccgctacgatggcctggggcggcgcgtgtccagcaagagcagccacagccaccacctgcagttcttctatgcagacctgaccaaccccaccaaggtcacccacctgtacaaccactccagctctgagatcacctccctctactacgacttgcaaggacacctctttgccatggagctgagcagtggtgatgagttttacatagcttgtgacaacatcgggacccctcttgctgtctttagtggaacaggtttgatgatcaagcaaatcctgtacacagcctatggggagatctacatggataccaaccccaactttcagatcatcataggctaccatggtggcctctatgatccactcaccaagcttgtccacatgggccggcgagattatgatgtgctggccggacgctggactagcccagaccacgagctgtggaagcaccttagtagcagcaacgtcatgccttttaatctctatatgttcaaaaacaacaaccccatcagcaactcccaggacatcaagtgcttcatgacagatgttaacagctggctgctcacctttggattccagctacacaacgtgatccctggttatcccaaaccagacatggatgccatggaaccctcctacgagctcatccacacacagatgaaaacgcaggagtgggacaacagcaagtctatcctcggggtacagtgtgaagtacagaagcagctcaaggcctttgtcaccttagaacggtttgaccagctctatggctccacaatcaccagctgccagcaggctccaaagaccaagaagtttgcatccagcggctcagtctttggcaagggggtcaagtttgccttgaaggatggccgagtgaccacagacatcatcagtgtggccaatgaggatgggcgaagggttgctgccatcttgaaccatgcccactacctagagaacctgcacttcaccattgatggggtggatacccattactttgtgaaaccaggaccttcagaaggtgacctggccatcctgggcctcagtggggggcggcgaaccctggagaatggggtcaacgtcactgtgtcccagatcaacacagtacttaatggcaggactagacgctacacagacatccagctccagtacggggcactgtgcttgaacacacgctacgggacaacgttggatgaggagaaggcacgggtcctggagctggcccggcagagagccgtgcgccaagcgtgggcccgcgagcagcagagactgcgggaaggggaggaaggcctgcgggcctggacagagggggagaagcagcaggtgctgagcacagggcgggtgcaaggctacgacggctttttcgtgatctctgtcgagcagtacccagaactgtcagacagcgccaacaacatccacttcatgagacagagcgagatgggccggaggtgacagagaggaccaaggacttcttgccaaagacagctactcttttgtggccgcatacctgactgtgttgtacttttaaaaaaatgattttttaacaagtgcagaaacaaaaagatactggttgcattgtaactcatgcaacatccttttttttagaaaagaaaaacacagatttggccttcgcacattttttgcaaagaacagaaggtatttttttctgtagtgtgatcacaatgaaaactttattgtcttttgttccctttttccttgaggatttttcccttgtcgtttggggtatgtatctcctctctgagatgcatctcctggggtgtgtcctcgtctgtccctaggtacccagtgtgatgtgggacatgaatgtctgtgctaacttgtctcatgtgcaaccctttcttcttcgactggggtcgggcaggagtaaagggagtgatgggccagtacaacaccccttccaagggggcctgggaggagggtctgtaggacctgaggctccttggcagggctcctgcagaagagtggtggatttcttctcaccttgttctctgcctccagaggatcatagatggcttcatcttgctccagggaatttcatggtgttgttcagcaccttttttaagctgccccaaactcctgttcaagctttctattttgatgctgaatgaaaccccctaccacttttgcaaatcctgtgtagttgtcggtgccacccccatgctgggatagagaaagtgtctcccaggtcctttcccccagaccagtgacataacatcctgggctcagagtcccatcctcccgggagggaaagcacccaggatgcctgtgattggttggtcctccatgatgttcctgttcatctcctcctttctcccaaagccagatgtgagaacgagcactgcacagcaagccttcaatgtgggcaccatgtccacagaacagaaggccacccatggcaaaggcatggcagtggtggcgagggcaccagcctgccttccgaggcaaagccctctctctatgactttgagtatcttccctccaccactcagccgccaccactgagacgtaggaatgtggagggaggtgcttggtggcctttgattctggaaaaatgcttaacaaaaaaagccagccaaagagaggaaggcataagctaagcatccttctaaccagttcccaaagtcccatctgcctccatgtaccagctgatcgcagagctggactggggcaggctgggcttccaggaaattcctgaagttctgaaacagcttcccctctagagaagcccacccaatgtgttttttagtgacaggaagaaaggagggaagagctgatgtggtgtggcctgcccatatcatacaaccccaccaggagcagggcagttcccaaggtgggtgcccgtagatctgggaggccaggctggcatgattcctgtgaagaactgtgcctgtgtcgtcagggagaggcctgagccctctcagaagcagggacagcccacacctgaagagcacgcccaagctgaggcagcagccagcaggctgggggagcagtgagggcagggggagtcacagccagagctgggagccccttgttcaaggattccattcctggttcatccgcctaattaccattgtcattaccactcacaggaggctctgggagatgggaggggaagccaaatgcttccttttaagctgggcttcttagaaaatggaacttttatgggttacatttacattaagtgtggaaaatgaattctgagtctgagctattccccgtggaaaccttgttggactgataagctcatggcacctctatagccttactcacatagtcttcagaatattacacaagttaatgaaactgagaaggtctgactgcatgaggatcggagcagcatgtagtctgggttctgcctggcagagggaggcaaccaaaacttcttggggagaggagatttcgccttaacgtcatcccactgggattagaggatgtgtttcgctaagtgctcttcctgtttccaaaaaaaaagccaccctgctgcagcagtgcgctttggcctgcttgtccactggttgcccattgcccctggatccagagctctactgagtcagatacagtgctctgcaggcctgctgtgggaggcatgagctggagatgggggctcccatctggcaggatcattcttggatgagatggaaaacagtttggcctgaagaacacaagttttgtcctccagaagggacttacgcctctcaaaatgtactcttcataccaagggcccttgggcaaagtgctcctgcccagttgatcagtcccatcctggctgcctgacatcagtgaagacctgctggggatgtctgctcagaggtcaggaacggcatgcggtccacaggaaccagctccctacgcttcccccacgccctgtccctcctccacagccccctccccaaaggaatagggtggacttttagggatcaaaaacagaattattgggtgtttcatttctttttttctttctttcttttttttttcatagagatggggtctcactatgttgcccaggctgttctcaaactcctggcctcaggcgatccaccttggcctcctgaagtgctggggttacaggtgtgagccactgcgcctggactgagtgtttgtttctttaaaggatcttatatttttcctgtgctacataccaccacagcagcccagcttctgtggggagagaagttgaaggatcccgaagctttagaaaaaggatctcagctgtggcacaggcagtgttatgcgcctcactgccacattggtgctgttgtattgaaggtggtgcttctggccttggcccttttgagttggtttccatttgggctgcaggtgactcagtgactccctcctcaagctgtcctcctgctaagaccagcagtcacaaacccatggcaagggtgagtgtgaaggcctaaccctgtgcctatgtaataggctccaagcatcgactcccatcctgagaggaccggcccttttgacactcaccaaccaaatctgttcattcgatagagtgaccaggcctccctcacctgcccaggtgtatgatcctacagttcctgccttctctcctaccccgcacagctgccaactggtcctacatcctcagcccctctgccaccaccttaaataggactttactgattccccaactttgtttttttgtaggatgagatttcctttttatcccacccccccacaccccaaacagacattgctggagggcagactggaggaaggggaaggcatgcaggtaaattactgccttgtcagcctctgaccctcatctctcagaattgttggctgagaattaacccaaggaccacaccagtgcctgatttctacttagggagagaggattggaaacgatccctaagaaactgactgagggtgagaatggccaggaggtgtgtgtccaaataaccaggagggggcacagaagatgatggcaaggcagactgggcagtgttttgtagacacagaacaaagaatcagaatttgaaaaaagaagaaaaacaaatcttcgcagctgcaactttaaagtatcacctttatagatggcagggatttccattatgcaaatggaatctaagatttcaatgtgaaatcttagaatgcagttttaccacttgcagtcttgtatttgtggtggccatgtggtgagggcggtgatgctgagctttctgcccaggaggaatgagctttcaagctctcagcagggtgtcaggcttggggatttgagcatccactgctcaaagtccaggctattctccagtcctcacggcagccactaagcccaggagccagacctggcccggggacacatctcctgagggatcccagaaagaacccagtctttcctttcccttggggtccttgttagaatgaaaacctctctatttaaggcacatcattcccagctaggtttatacacttgtctatattttactggaggaaagggaattaaaaaagaactctgcagttcaaggccctttcatttaaccttccaaaaacagcaaactcattttaaagactcattgctgaggtgatagagagaaaccttatcctctccaacctttacattcacaaaaaccatccttgtgtacttgactgccctagacagtggtgactcttaggtttcattacgaatgtggaatatcagagtgtgggaaggcccaggcgagggccaatgttgtgtttcttaccccctctggaatgccaaaggcaaggtactaggtgacctcctggtccccaagaaaatgtgatttattctgagggcgaacagccaagggaggactagtctggagcacgctcggccgtcctggcaggagctgagcctcaggtgtctggcggtgccccagcagccctggattcacccaacaccagaatcccacttttctaaatccacctgttgttctgagcacctctgaacccgcagcttcggcaaaaggagtctgtaccaagctgcttctggatgaccaacactggagactctggccttaccatgtggaaatcattttcctgaagtctggaactaattttgagaagtttttttctcaacacttttgtgtttctaacactgtatcttgactgtgtaaataccaacaaggctgtaaataaatgcagatgtagataccttctagaaaaaaaaaagcataaaaacaaaaccagaagtgatcccgtgtagccttcgttgacaaataaagactattttgtgttta

SEQ ID NO: 460786 - DNA, 8230 bp, Homo sapiens
  misc_feature (8093)..(8093): n is a, c, g, or t
cctccctccaccttcgttccttctgagcagtctgtgcttgtcctctcctgcagaccaagtccggaacagctactacatcggggccgatggctccttgcggctgctgctggccaacggcatggaggtggcgctgcagactgagccccacttgctggctggcaccgtcaaccccaccgtgggcaagaggaatgtcacgctgcccatcgacaacggcctcaacctggtggagtggcgccagcgcaaagagcaggctcggggccaggtcactgtctttgggcgccggctgcgggttcacaaccgaaatctcctatctctggactttgatcgcgtaacacgcacagagaagatctatgatgaccaccgcaagttcacccttcggattctgtacgaccaggcggggcggcccagcctctggtcacccagcagcaggctgaatggtgtcaacgtgacatactcccctgggggttacattgctggcatccagaggggcatcatgtctgaaagaatggaatacgaccaggcgggccgcatcacatccaggatcttcgctgatgggaagacatggagctacacatacttagagaaggcaggtgtctgtctccctgcatcactggccttgccatacagaaggccaatcattcacggccaagcccagcctggtggcctcagtgggctgtatctgacccatgtcaccaaaaggaaatgttcaggaaagtctgccacagagggcatggggtcccaagaggcatcaggatggatcagggagatagcatggcaggtggtgtccatggtgctgctactacacagccagaggcagtatatctttgagttcgacaagaatgaccgcctctcttctgtgacgatgcccaacgtggcgcggcagacactagagaccatccgctcagtgggctactacagaaacatctatcagccccctgagggcaatgcctcagtcatacaggacttcactgaggatgggcacctccttcacaccttctacctgggcactggccgcagggtgatatacaagtatggcaaactgtcaaagctggcagagacgctctatgacaccaccaaggtcagtttcacctatgacgagacggcaggcatgctgaagaccatcaacctacagaatgagggcttcacctgcaccatccgctaccgtcagattgggcccctgattgaccgacagatcttccgcttcactgaggaaggcatggtcaacgcccgttttgactacaactatgacaacagcttccgggtgaccagcatgcaggctgtgatcaacgagaccccactgcccattgatctctatcgctatgatgatgtgtcaggcaagacagagcagtttgggaagtttggtgtcatttactatgacattaaccagatcatcaccacagctgtcatgacccacaccaagcattttgatgcatatggcaggatgaaggaagtgcagtatgagatcttccgctcgctcatgtactggatgaccgtccagtatgataacatggggcgagtagtgaagaaggagctgaaggtaggaccctacgccaataccactcgctactcctatgagtatgatgctgacggccagctgcagacagtctccatcaatgacaagccactctggcgctacagctacgacctcaatgggaacctgcacttactgagccctgggaacagtgcacggctcacaccactacggtatgacatccgcgaccgcatcactcggctgggtgacgtgcaatacaagatggatgaggatggcttcctgaggcagcggggcggtgatatctttgagtacaactcagctggcctgctcatcaaggcctacaaccgggctggcagctggagtgtcaggtaccgctacgatggcctggggcggcgcgtgtccagcaagagcagccacagccaccacctgcagttcttctatgcagacctgaccaaccccaccaaggtcacccacctgtacaaccactccagctctgagatcacctccctctactacgacttgcaaggacacctctttgccatggagctgagcagtggtgatgagttttacatagcttgtgacaacatcgggacccctcttgctgtctttagtggaacaggtttgatgatcaagcaaatcctgtacacagcctatggggagatctacatggataccaaccccaactttcagatcatcataggctaccatggtggcctctatgatccactcaccaagcttgtccacatgggccggcgagattatgatgtgctggccggacgctggactagcccagaccacgagctgtggaagcaccttagtagcagcaacgtcatgccttttaatctctatatgttcaaaaacaacaaccccatcagcaactcccaggacatcaagtgcttcatgacagatgttaacagctggctgctcacctttggattccagctacacaacgtgatccctggttatcccaaaccagacatggatgccatggaaccctcctacgagctcatccacacacagatgaaaacgcaggagtgggacaacagcaagtctatcctcggggtacagtgtgaagtacagaagcagctcaaggcctttgtcaccttagaacggtttgaccagctctatggctccacaatcaccagctgccagcaggctccaaagaccaagaagtttgcatccagcggctcagtctttggcaagggggtcaagtttgccttgaaggatggccgagtgaccacagacatcatcagtgtggccaatgaggatgggcgaagggttgctgccatcttgaaccatgcccactacctagagaacctgcacttcaccattgatggggtggatacccattactttgtgaaaccaggaccttcagaaggtgacctggccatcctgggcctcagtggggggcggcgaaccctggagaatggggtcaacgtcactgtgtcccagatcaacacagtacttaatggcaggactagacgctacacagacatccagctccagtacggggcactgtgcttgaacacacgctacgggacaacgttggatgaggagaaggcacgggtcctggagctggcccggcagagagccgtgcgccaagcgtgggcccgcgagcagcagagactgcgggaaggggaggaaggcctgcgggcctggacagagggggagaagcagcaggtgctgagcacagggcgggtgcaaggctacgacggctttttcgtgatctctgtcgagcagtacccagaactgtcagacagcgccaacaacatccacttcatgagacagagcgagatgggccggaggtgacagagaggaccaaggacttcttgccaaagacagctactcttttgtggccgcatacctgactgtgttgtacttttaaaaaaatgattttttaacaagtgcagaaacaaaaagatactggttgcattgtaactcatgcaacatccttttttttagaaaagaaaaacacagatttggccttcgcacattttttgcaaagaacagaaggtatttttttctgtagtgtgatcacaatgaaaactttattgtcttttgttccctttttccttgaggatttttcccttgtcgtttggggtatgtatctcctctctgagatgcatctcctggggtgtgtcctcgtctgtccctaggtacccagtgtgatgtgggacatgaatgtctgtgctaacttgtctcatgtgcaaccctttcttcttcgactggggtcgggcaggagtaaagggagtgatgggccagtacaacaccccttccaagggggcctgggaggagggtctgtaggacctgaggctccttggcagggctcctgcagaagagtggtggatttcttctcaccttgttctctgcctccagaggatcatagatggcttcatcttgctccagggaatttcatggtgttgttcagcaccttttttaagctgccccaaactcctgttcaagctttctattttgatgctgaatgaaaccccctaccacttttgcaaatcctgtgtagttgtcggtgccacccccatgctgggatagagaaagtgtctcccaggtcctttcccccagaccagtgacataacatcctgggctcagagtcccatcctcccgggagggaaagcacccaggatgcctgtgattggttggtcctccatgatgttcctgttcatctcctcctttctcccaaagccagatgtgagaacgagcactgcacagcaagccttcaatgtgggcaccatgtccacagaacagaaggccacccatggcaaaggcatggcagtggtggcgagggcaccagcctgccttccgaggcaaagccctctctctatgactttgagtatcttccctccaccactcagccgccaccactgagacgtaggaatgtggagggaggtgcttggtggcctttgattctggaaaaatgcttaacaaaaaaagccagccaaagagaggaaggcataagctaagcatccttctaaccagttcccaaagtcccatctgcctccatgtaccagctgatcgcagagctggactggggcaggctgggcttccaggaaattcctgaagttctgaaacagcttcccctctagagaagcccacccaatgtgttttttagtgacaggaagaaaggagggaagagctgatgtggtgtggcctgcccatatcatacaaccccaccaggagcagggcagttcccaaggtgggtgcccgtagatctgggaggccaggctggcatgattcctgtgaagaactgtgcctgtgtcgtcagggagaggcctgagccctctcagaagcagggacagcccacacctgaagagcacgcccaagctgaggcagcagccagcaggctgggggagcagtgagggcagggggagtcacagccagagctgggagccccttgttcaaggattccattcctggttcatccgcctaattaccattgtcattaccactcacaggaggctctgggagatgggaggggaagccaaatgcttccttttaagctgggcttcttagaaaatggaacttttatgggttacatttacattaagtgtggaaaatgaattctgagtctgagctattccccgtggaaaccttgttggactgataagctcatggcacctctatagccttactcacatagtcttcagaatattacacaagttaatgaaactgagaaggtctgactgcatgaggatcggagcagcatgtagtctgggttctgcctggcagagggaggcaaccaaaacttcttggggagaggagatttcgccttaacgtcatcccactgggattagaggatgtgtttcgctaagtgctcttcctgtttccaaaaaaaaagccaccctgctgcagcagtgcgctttggcctgcttgtccactggttgcccattgcccctggatccagagctctactgagtcagatacagtgctctgcaggcctgctgtgggaggcatgagctggagatgggggctcccatctggcaggatcattcttggatgagatggaaaacagtttggcctgaagaacacaagttttgtcctccagaagggacttacgcctctcaaaatgtactcttcataccaagggcccttgggcaaagtgctcctgcccagttgatcagtcccatcctggctgcctgacatcagtgaagacctgctggggatgtctgctcagaggtcaggaacggcatgcggtccacaggaaccagctccctacgcttcccccacgccctgtccctcctccacagccccctccccaaaggaatagggtggacttttagggatcaaaaacagaattattgggtgtttcatttctttttttctttctttcttttttttttcatagagatggggtctcactatgttgcccaggctgttctcaaactcctggcctcaggcgatccaccttggcctcctgaagtgctggggttacaggtgtgagccactgcgcctggactgagtgtttgtttctttaaaggatcttatatttttcctgtgctacataccaccacagcagcccagcttctgtggggagagaagttgaaggatcccgaagctttagaaaaaggatctcagctgtggcacaggcagtgttatgcgcctcactgccacattggtgctgttgtattgaaggtggtgcttctggccttggcccttttgagttggtttccatttgggctgcaggtgactcagtgactccctcctcaagctgtcctcctgctaagaccagcagtcacaaacccatggcaagggtgagtgtgaaggcctaaccctgtgcctatgtaataggctccaagcatcgactcccatcctgagaggaccggcccttttgacactcaccaaccaaatctgttcattcgatagagtgaccaggcctccctcacctgcccaggtgtatgatcctacagttcctgccttctctcctaccccgcacagctgccaactggtcctacatcctcagcccctctgccaccaccttaaataggactttactgattccccaactttgtttttttgtaggatgagatttcctttttatcccacccccccacaccccaaacagacattgctggagggcagactggaggaaggggaaggcatgcaggtaaattactgccttgtcagcctctgaccctcatctctcagaattgttggctgagaattaacccaaggaccacaccagtgcctgatttctacttagggagagaggattggaaacgatccctaagaaactgactgagggtgagaatggccaggaggtgtgtgtccaaataaccaggagggggcacagaagatgatggcaaggcagactgggcagtgttttgtagacacagaacaaagaatcagaatttgaaaaaagaagaaaaacaaatcttcgcagctgcaactttaaagtatcacctttatagatggcagggatttccattatgcaaatggaatctaagatttcaatgtgaaatcttagaatgcagttttaccacttgcagtcttgtatttgtggtggccatgtggtgagggcggtgatgctgagctttctgcccaggaggaatgagctttcaagctctcagcagggtgtcaggcttggggatttgagcatccactgctcaaagtccaggctattctccagtcctcacggcagccactaagcccaggagccagacctggcccggggacacatctcctgagggatcccagaaagaacccagtctttcctttcccttggggtccttgttagaatgaaaacctctctatttaaggcacatcattcccagctaggtttatacacttgtctatattttactggaggaaagggaattaaaaaagaactctgcagttcaaggccctttcatttaaccttccaaaaacagcaaactcattttaaagactcattgctgaggtgatagagagaaaccttatcctctccaacctttacattcacaaaaaccatccttgtgtacttgactgccctagacagtggtgactcttaggtttcattacgaatgtggaatatcagagtgtgggaaggcccaggcgagggccaatgttgtgtttcttaccccctctggaatgccaaaggcaaggtactaggtgacctcctggtccccaagaaaatgtgatttattctgagggcgaacagccaagggaggactagtctggagcacgctcggccgtcctggcaggagctgagcctcaggtgtctggcggtgccccagcagccctggattcacccaacaccagaatcccacttttctaaatccacctgttgttctgagcacctctgaacccgcagcttcggcaaaaggagtctgtaccaagctgcttctggatgaccaacactggagactctggccttaccatgtggaaatcattttcctgaagtctggaactaattttgagaagtttttttctcaacacttttgtgtttctaacactgtatcttgactgtgtaaataccaacaaggctgtaaataaatgcagatgtagataccttctagaaaaaaaaaagcataaaaacaaaaccagaagtgatcccgtgtagccttcgttgacaaataaagactattttgtgtttaaaaaaaataaaataatnttaattattatttaattttatattttttttattttaaaaaaataaaccggcccaagggggggcccgttcccatttgccccttttgggagttgttttacccgccctaattggccgtgtttttaaaacttttgtaatgg

SEQ ID NO: 460787 - DNA, 997 bp, Homo sapiens
tgacacatgcctacaccttgggaaggtatgctgatgaagaaaagaatagggaatccaagtgccatgaaaaactatctgagcccaacaagtggaagagaaacttcccactcttatatatgttcccccaggtttcgcactgtcccctttgtgtctttcccttcagaaggatgtcaggaacagctgtttcagctacgcaaagcaggagatagtactgccttggaaacacgtttcttggccatgaatcagactaccaaggcctcatataagtactggctactggagaaacaagaggaagttgcttgtaaagttcaaaggaccaaagttccaagaaggtgctttactagagaaaaggccccagggtcaagggtcaaaccaatagatgattccatggcagttggcagtcctgacagcaggctggccctgatagataacggaagtgaggaagggtgagagttatctatcttctctgttttatagactacttcagcttctgctgttaccaatgcctcagcaaccactgaaagttcagatatcacccttcttgtaactaatcaaatcaaggaagagatctacaaaatagtggtggtggttccagctagaaattttcactcacaatggtgcatgtttcaaatagaagtatccagggtatgaacatacttttctcctcctgggccgtagtcttaatggtgatgggaatcaccttagataaatgggttgaattgatttcagaagatgaaagagccaagatgaaccacagtccttggatgatgtgttgccctgctctttggccagaagatgacctgaaagtggtcaggattatgatgacgtcgagccttggcctttccttcctccttaacttaatcctgggtatgaaattcacctatctgattcctcaaaataaatatatacaactcttcactaccatcctcagtttcttctcaggtaacttcctggctcccctaacacaagcttgtaggtgtactttgatgggtgggtt

SEQ ID NO: 460788 - DNA, 2518 bp, Homo sapiens
gagtttgacccagcagcaggggtcggtgtgtccctttgaatctgagatctatgaggcaggagctgaggacaggatggcaggagcgcccatggctgctgctgtacagcctgctgaggtgactgttgaagttggtgaggacctccacatgcaccaggttcgtgaccgggagatgcctgaagctttggagtttaacctttctgccaatccagaggcaagcacaatattccagaggaactctcaaacagatgctttggagtttaacccttctgccaatccagaggcaagcacaatattccagaggaactctcaaacagatgttgtagaaataagaagaagcaactgtacaaaccgtgtatctactgagcgtttcagtcaacaatacagctcgtgttcgacaatattccttgatgacagcacagccatccagcattatcttacaatgacaataatatcagatgcagatagatctttgagcatacctgatgaacagttacactcatttgcggtttccaccgtgcacattatgaagaaaagaaatggaggtgggagtttaaataactattcctcctccattccaccgactcccagcaccagccaggaggaccctcagttcagtgttcctcccactgccaacacacccacccccatttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccagtatctccagcaccaccagccccaagctcaacccacccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaacgctggatccattccaaatatgaggagaagctctttctggccccactaccctgcactgagctgtctctgggccagcagctgctgcgggccaccgctgatgaggacctgcagacagccatcctgctgctggcacatggctcccgtgaggaggtgaacgagacctgtggggagggagacggctgcacggcactccatctggcctgccgcaaggggaatgtggtcctggagcagctcctgatctggtacggggtggacgtcatggcccgagatgcccacgggaacacagcgctgacctacgcccggcaggcctccagccaggagtgcatcaacgtgcttctgcagtacggctgccccgacgagtgccttttgctacccaagaccaagaggctctggcaagacggtggttttccgaatgccagactgaggtgccttatgaaggcagctgccgatggttccagatgtagagagataggtgatgcaggagggaaagctggattggaaaagggagaggacaagcccccagaagagtggctactagagtgggaggaggaaaagcagaaggagaaagagttgaagataggcgaggctgtggtcccagtgctgaattctgccaagcaccttaaaaaggaaggaaattctaacacatgctacaacatggatgaacatcgaggacattacgctaagtgaaataagccagttagaaaaagacaaatacggtgttccttcacttatgtgaagcgtccagactgagtaagcaaactaatagaaacagaaggtagaacgggggttgccagggacatggggaagggagaaaatgggaagttgcttagtggatatagagttttggttttgtcagatgaaaaagttccggagattggttgcatggcaatgtgaatataccctaca

SEQ ID NO: 460789 - DNA, 2453 bp, Homo sapiens
gagtttgacccagcagcaggggtcggtgtgtccctttgaatctgagatctatgaggcaggagctgaggacaggatggcaggagcgcccatggctgctgctgtacagcctgctgaggtgactgttgaagttggtgaggacctccacatgcaccaggttcgtgaccgggagatgcctgaagctttggagtttaacctttctgccaatccagaggcaagcacaatattccagaggaactctcaaacagatgctttggagtttaacccttctgccaatccagaggcaagcacaatattccagaggaactctcaaacagatgttgtagaaataagaagaagcaactgtacaaaccgttgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccaccgactcccagcaccagccaggaggaccctcagttcagtgttcctcccactgccaacacacccacccccatttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccagtatctccagcaccaccagccccaagctcaacccacccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaacgctggatccattccaaatatgaggagaagctctttctggccccactaccctgcactgagctgtctctgggccagcagctgctgcgggccaccgctgatgaggacctgcagacagccatcctgctgctggcacatggctcccgtgaggaggtgaacgagacctgtggggagggagacggctgcacggcactccatctggcctgccgcaaggggaatgtggtcctggagcagctcctgatctggtacggggtggacgtcatggcccgagatgcccacgggaacacagcgctgacctacgcccggcaggcctccagccaggagtgcatcaacgtgcttctgcagtacggctgccccgacgagtgccttttgctacccaagaccaagaggctctggcaagacggtggttttccgaatgccagactgaggtgccttatgaaggcagctgccgatggttccagatgtagagagataggtgatgcaggagggaaagctggattggaaaagggagaggacaagcccccagaagagtggctactagagtgggaggaggaaaagcagaaggagaaagagttgaagataggcgaggctgtggtcccagtgctgaattctgccaagcaccttaaaaaggaaggaaattctaacacatgctacaacatggatgaacatcgaggacattacgctaagtgaaataagccagttagaaaaagacaaatacggtgttccttcacttatgtgaagcgtccagactgagtaagcaaactaatagaaacagaaggtagaacgggggttgccagggacatggggaagggagaaaatgggaagttgcttagtggatatagagttttggttttgtcagatgaaaaagttccggagattggttgcatggcaatgtgaatataccctaca

SEQ ID NO: 460790 - DNA, 2312 bp, Homo sapiens
ggtgttgccttctgtgcacgggattcctggggatggaaggctgagagagaaaacccacctgcaggtgaacatggaatatggatgcagacatttattcagccaaatatgctatgtcattgctcagaggctgatggtcttcaaggccatagagcttcttaatggcaaagctgagattccagaccagccccattcaacatggtgctacgatgacgtctcccttcctctctgttttgggaacgcattcatggaggggttactggaagtcaaaaggttcactgtcctgggtctccatcattcagtagataagccagaagtcccacagagctggaagtccccagataggcactactgcataaagtacagagcccaggactcagacacatgctcagtgaccctagttagtgctggctcatcagccactcaggtccatgcatcagggacaccaaatatctaaaatctcaggccacagctgcccaaagtgtgttggtgggagaggacaaactaaatccctgttttcatttcttcccccaaatggagctcacgtaaagcctttaaaccattggcttttatctgtttttagtgtccaatttagggctttgcaggggctccctccagggctttctcaatggatttatatcacagccagatagcatcttcgaaagctcatctgagctggaaaatagagaaacatccttctctattgtcaagtgacaagtgatggcacccaggcaactggcttgagtgcacagggaacccactctggatgccatggctggggtggtccctgtcttgagagggggctagccagagaggggaagaagggagaggccacagcagggttctgaattgtcttcctacttctgagagcagagactccgactctgaaagcttttcaacaaagcactaactgtcctctcggcccgtcacctgtgggcatgaagatgtcatctccctggccaaccaccaggtgccatttgcagacacagatcgaggtcctaatgagtattcataggatttccaggacattcctagtttatacttgttgtcctggcaacattttcattctaaaaatgtcacagtttggatgtcaaataggcatagatcagaactgtttctgaaaacctatgaatactatattcatagggcacgtgtcacccagggctggaattctgttttgtgatgcagagtcagcatgcctggtgcatctttgcgagtatacatggtgaagaagtgttgtgcagagtgtgcgtgttgctccatcgtgtcactagacatattgaaagtgacttggtgattggacatagtggtcatagacacaatagagagcatttctggactgaagtccagaaagggaaaggagaggagtaaagaggaaaagagaacagtggtgggtgcctataaagagccacacaccttgctgcatgctctatatgtgggctattgtttgttctcacaatgaatctgagtagtagatatagcatgcccattttccaggtaattgctgaaggatttttgcttcaaacaggctcttgtttgcatcaagtgtggggtgcagcaaagtggactcgggactggccgatgtctggccagaaatgccaggcaagggaaacagtgactctagtggggtcaggagaggggcatctgctggcccaggagcgcaaggcagagggacttcattgtcccccttataggtgaggcgactctgaggcaggaggtccaagtttgctggacaatggcagaaacagaattcaaacacctgtcttctaggagaagttctggtctctcctcggtgctgcggctgccccgggaagagtttccaggagctgacaagcattcagatgagtaaagatgggatcggattgagaaaaggagaagggagagcatattcgttctctttccacctccctcccacagcctttcatgctgatctcatctgacgaagctgcctcctcctccctggactctacaagcccctgtcatgatgtttctcagatcctgaattccagcgaaacagatgatactaacaagtttgaagacccccacagaggaatggaatcagtatgagaacacagtttcttcatctccctgtcccagaacttcaccctggactcctcgaccaatcaacaatctccacacttcggcccactccaaaactcctaaaatcccaagctccaaactcctctgggagatggatttgaggcttcctcccgtttccttgtgtggaagccctgtcattaaacctctttctctgctgcaacctgatgtacttggtgtattgacttgccatgcacattgggcaagggatctattac

SEQ ID NO: 460791 - DNA, 890 bp, Homo sapiens
agtcaaaggtgctatgagaaggaaggcactccccaatctagaaatagcacacatactttgcctcaggctctgctttctagggaagtcaggctaaggcagatctagggatccctggttactcctgaattactcccatcatccaaagctgctctcttctgcttatatataatttgagggaagcacaattctaagaagttacgaaccacccctaagttatgacttttctaaacattccaagtattatgatgactttcagactggagatttgtgctatctgcccagtcaaagtcagccagccatgggaagaaaatcatctcttctctcttcctccttcggctcctgttggccggtgccttcctgaacctgaagaatatctttgctctttccaactcccacattcaaaacagagtcttacaactcagccacattttctgctgagccagccagtgggaacaaacaccaagagacctggagccacagaaacactcatacatgagccaagaagaaaaaaattgtgtggcagctgcccagctctgctctgcaaccatgcgcttcctgtttactgactaagacctgatgaacctgtatctactactgcccagggcacattaaagtcaccacaacccctgctagatgactattttgatatggaggggaaagaattgctcccctcagcccatggggataaatttaggaccatcactggccagccttatgtccttgcctgaggagttggaactgggaaccaaaagggaaagttcacctgacttggaaacgtgcacacaagcagtctctcaacactgtgacgtttatagtgaaggaagcatcaccgaagagagttgcgtttcattcggatggcctggccataataaactgtcctgaatggaaca

SEQ ID NO: 460792 - DNA, 485 bp, Homo sapiens
tctgctgttaatggaaaccaaataagcatctgctatctctggagggtcttgaagaaagaagaaattctgtattatccaaacagatggttatgaggatctactttcaaccttccacgttatgtgctgtgaatcaagtcttcaccctaccatttatccattgtctccaagagcttttgatatatcaggaaatagggaagccctacatatggaaaagtgtaaggattgtagtggtgagatgtgtgttccagactctctggattcaaatcccagctctgctactcataacagtacatgctgcccatgcataaacaatcaaagttaaaccgagaaaagatggatacacatggagctgctaccgattgggaaaggatttggttattttattatttcataatgctgagctgtgatggacctgacgacatctgagaaaaaaaaaattgcccaaatgaaaaaataaatagccttagaaaaaatgcataagttgc

SEQ ID NO: 460793 - DNA, 1176 bp, Homo sapiens
tctgctgttaatggaaaccaaataagcatctgctatctctggagggtcttgaagaaagaagaaattctgtattatccaaacagatggttatgaggatctactttcaaccttccacgttatgtgctgtgaatcaagtcttcaccctaccatttatccattgtctccaagagcttttgatatatcaggaaatagggaagccctacatatggaaaagtgtaaggattgtagtggtgagatgtgtgttccagactctctggattcaaatcccagctctgctactcataacagatataggaaatattaatatttataccacccatgggacactggggtatggctgcttctagcaggaggtcatcagccagcctcccaggaggttcagctcccaggctccgtccagctgcccagtggctgaggctcagcatctccactgcctgtaacctactcacggcacactgcacccacggcacacagcacccgggcaccgctcacggcacagagcacctgggcacggtggctgggaggctctgacctctgcagcagacacagagctccacttcttattctctgttaattgatgctgccctgtttcattttaagcattccaaggagcccgtgctcagaacgggcaagtgccatttctgtcttgttgatattagagaaatgggtggtgggtgaacaatgggtcacaatacccataaagaagaatccatgggagctgctgcgactctgcggtcctcctgtcttgagcatgaaacgaccattgatggcccttccctgccaccagcccatggcaggcactgaccacagtgctgggagaacttctctctcttgccgaaatgtgggtgatgagtcagttgaggaagctcagctgggcagcccatccccttcgcacacagtggcagctatgccagccacagagccctggggaggacggcgaacgattactgtgcatgacctgaaagggatcagagaccagtacatgctgcccatgcataaacaatcaaagttaaaccgagaaaagatggatacacatggagctgctaccgattgggaaaggatttggttattttattatttcataatgctgagctgtgatggacctgacgacatctgagaaaaaaaaaattgcccaaatgaaaaaataaatagccttagaaaaaatgcataagttgc

SEQ ID NO: 460794 - DNA, 1978 bp, Homo sapiens
tggcagcagtgggctgttcagagtggccgctgccatcacaccagctgcagtaaggaagcgtgagctgtggcagcaggagtggctgcaggagcagcagtggcggcagtaggtcccctgtgccctgcgtccctgagggagccaaaaaccccaccctcacacggcctggtaggatccgctcccagacctgaagcctctgccacagtcttaacctcgctctccgctgtatcccaggggcctgcgagcacccagctgatggcacagctgggacttatgggactggccctggaagcgtcaggttcatttgtgtggggttgactggggctgccgtaccacctgcaccttgcccgccaccctgggagccactgtgacagggccaagctgaatcgtccgctggtagggaagcagtgtggtcggtcatggagaggcaggcagagaggggcactgaggcagagctgggcccagggcagtgccacactctacagtgtcagcagaagcatggagcaggcaggagtcccacccttctgggcatggctgcagccacccaaattgcagctgcagatgcagacatctctgcactccctgggccccccttactcccacaggctcagaggtgtctgctccagctccctggcctctccctgctgtcagcacccactcagatcatggagcaaagttgaggatgagcctgggaactattgcaacccagccggatgtgtgcacgctcagggcagcactgacacacaagtcccctgccacttcagccgcctccggactttgggtgaagacaaacatgggagggagaccaagggggtgctgaagacagcttggcactgccctgcaggtgcccgttggtacaaacctgggcaccatgaaaggcagcaggaggcagacatgctcctaggcagaaggggtaggtcccaggtgaagcccaatcttcaagccagggaaggcctgaggcctgagggccaggctgtgggtcccgcagactggagtgggaacttttccaggcctgcccatggattaatcagcatgcacttcctcccctctgaggctcataaaaactccggactcagccagacttgaggagacaacaggacaagctgcagagaggagctaccctctctgctgagagctgaacactcatcaagataccctggctacggagaggagctgcccactgtgagtctcctctgagctgttctattactcaataaagttcccctttgtcttgctcaccctccacttgtctgcgtacctcattcttcccggatgcaggacaagaactagggactcactgaatggcaaggctaaaagagctataacacaaacagggctgaaacatgctgtttgcccaccatgtcgcagcagacaagaggagagaagaaggaagagaagagctgtggccctttggggagcccagacctaggagcaaccccaagccagacactttctgcccagcagtggatgcttaattaatacgtggggaatggccagaatgcaaaaggaactcagaaagagtgggacccactcagcctggggaagccaaggagtacttcataaacctgtgctattttagttgggtatgaaagattattaggagtgtgttagtgaaaaaaaagagggaaggacactccagacaagaggaatggcatgaactgaagctcagagttgaaacaggttatggcttgtacagaaatctgggagaagttaggacacctgggacatgggctatgcggcaggagatgcgtctgggagcgaggcagacaggagtctggaattatcctggaagccaacagacatctttctaaaggaaagtgatgagtcagatttgttttttctgaagaaactttttatatgaactcacaaagatatcatgaggctattgaaagtcaaggaaatctcctcatccccccaacagccctgagggagcagaagagagacaagcccataatattcttcgtacttttagaaagaaaga

SEQ ID NO: 460795 - DNA, 660 bp, Homo sapiens
gatcctccaacaaagtttgaggagagagaagtcctcgtttcagatgaaggccgacccaatggaccagccccaggtagggctgaggggtagcaccgggctcctccatagcgcgaaggctgctctggcggtcaccacagtaacactggccacaacaaacggtggagaacacgcagccttgggcagcgctggtcccagcccgacccgcttcagttctggcagttttcacatcacatattttgaagcactttttgatgtgttacaacttgtccacataccttcacaaatcagaaaagaactaaataggattatatcaacatttgcactctatgtacctattctgaagaataacacaggaaagagattacttggaagagacaagatctttctatgttgcccagactggtctgaaactcctggactcaaaacatatgaatatccagccctggaagctaaaaacaagctttgtgcccaaaaaaagtttatatttttgatttttctacaactaaatggaacagggtttaactgagaacagttttcaaacacaagtcttagagaagataaggattacaggcgtgagccaccgtgctctgctggacatcatttagcatatatgacaaggtaactgacgaaggacaattcaaccaaaaaatgattaaaagc

SEQ ID NO: 460796 - DNA, 2077 bp, Homo sapiens
ttaagctggtgtaaatcggccgaggttctgagctcgggtcaccctgccccatctccatctcctatgagatgagtgactcccaagaccccaccacttcccctgtagttaccacccaggtagagctggggggctgcagccggcaaggtgggggcaatgggttcctccgttttcgccagcaccaggaggtccaggccttcctcagccttctggaggacagttttgtccaggaattcctctccaaagacccctgcttccagatttcagataagtatctcctggccatggtgctggtctacttccagcgcgcccacctgaagctcagcgagtatacccacagcagcctgttcttggccctgtaccttgcaaacgacatggaggaggacctggagggccccaaatgtgagatttttccatgggccctgggaaaagattggtgtttacgagtggggaaattcctgcaccagagggataagctttgggcacggatgggtttccgggctgttgtgagccgccagtgctgtgaggaggtcatggcaaaggagccattccactgggcttggactcgggaccggcgcccccaccatggtggggttcagagggtctgtccacaggtccctgttcgccttccccggggccctggcctctcgccgccccactgttccccctgtggtttgccccagcactgcagcagccacttgcttaagcctgtgtcatccaagtgcccttctctgacctctgaatgtcatcgccctccctcccaaaattatctctcaagggtcaaaaacgcctggggtggggactttctcatcgtcttgcctccccagatgcaactggaaccaggcacctactccctccgcaacaatgggaataccagtcggcaggttcagctccatgatagcctcttcagagagaccctccagatgcttggcaatgccccggaggctgttgccatgggctgcaatcagtacacgtttcccctccttgatctggggaactatttcttcattccagaaggtcagagctctggcaatagtgtccttcagactctcacaggagggcctcccaaagtgttaggattataggaatgagcgaccacacccagaacatgattttttatatatgtatatggagaaaaatactcctttaagatgttaattgtaaatgttttcttcagtccatcattttgacataactgtatggatttttaatgtagtaaaaaatgcaattttatgacttttgggttttgtgattacaggcatgagccaccgtgcccagccagcttctggctgtattttcgttttcatttttgtacgtttaaatattgaaggttaacatttaatttttatttttatttatttattttttttgagacgttgtctcactctgtcgccgaggctggaagtgcagcggtgctcactgaggccttgaacccctaggctcaagagagcctcccacctcaggctccgaaaatgctgggattacaggtggtgtgagataccacaccagacctagagtttttattttttaatttttaaaaaaatttttatttatttttttgagacggagtctcactcttttgctcaggctggagtgaagtggtgcaatctcggctcactgcaacctccgccccctgggttcaaacaattctcctgcctcagcctcccgagtagctgggattacaaacgcctgccacccaccatgcccagctttttttttttttttttttgtatttttagtagagacgaggtttcaccatattggccgggctggtcgtgaactcctgacctcaggtgatccatctaccttggcctcccaaagtgctaggattacaggtgttagccaccacacccagcctttttaaatgtttttttcattaggaacaacatattccaaacctataaattgagttcatctgtaattttttctaagatacaaattatgaatccaacttactttttttccagattgctcccttttcttcctaatgtcttttattaactcatcttttctcaacagattagaaatggtacttttatcatctactacattcctgcctgtatttgaatctgtttctaaa

SEQ ID NO: 460797 - DNA, 2100 bp, Homo sapiens
gctatataagcgcactcgcggcggcgttggtgttatgctctgggccattcctgagctcgggtcaccctgccccatctccatctcctatgagatgagtgactcccaagaccccaccacttcccctgtagttaccacccaggtagagctggggggctgcagccggcaaggtgggggcaatgggttcctccgttttcgccagcaccaggaggtccaggccttcctcagccttctggaggacagttttgtccaggaattcctctccaaagacccctgcttccagatttcagataagtatctcctggccatggtgctggtctacttccagcgcgcccacctgaagctcagcgagtatacccacagcagcctgttcttggccctgtaccttgcaaacgacatggaggaggacctggagggccccaaatgtgagatttttccatgggccctgggaaaagattggtgtttacgagtggggaaattcctgcaccagagggataagctttgggcacggatgggtttccgggctgttgtgagccgccagtgctgtgaggaggtcatggcaaaggagccattccactgggcttggactcgggaccggcgcccccaccatggtggggttcagagggtctgtccacaggtccctgttcgccttccccggggccctggcctctcgccgccccactgttccccctgtggtttgccccagcactgcagcagccacttgcttaagcctgtgtcatccaagtgcccttctctgacctctgaatgtcatcgccctccctcccaaaattatctctcaagggtcaaaaacgcctggggtggggactttctcatcgtcttgcctccccagatgcaactggaaccaggcacctactccctccgcaacaatgggaataccagtcggcaggttcagctccatgatagcctcttcagagagaccctccagatgcttggcaatgccccggaggctgttgccatgggctgcaatcagtacacgtttcccctccttgatctggggaactatttcttcattccagaaggtcagagctctggcaatagtgtccttcagactctcacaggagggcctcccaaagtgttaggattataggaatgagcgaccacacccagaacatgattttttatatatgtatatggagaaaaatactcctttaagatgttaattgtaaatgttttcttcagtccatcattttgacataactgtatggatttttaatgtagtaaaaaatgcaattttatgacttttgggttttgtgattacaggcatgagccaccgtgcccagccagcttctggctgtattttcgttttcatttttgtacgtttaaatattgaaggttaacatttaatttttatttttatttatttattttttttgagacgttgtctcactctgtcgccgaggctggaagtgcagcggtgctcactgaggccttgaacccctaggctcaagagagcctcccacctcaggctccgaaaatgctgggattacaggtggtgtgagataccacaccagacctagagtttttattttttaatttttaaaaaaatttttatttatttttttgagacggagtctcactcttttgctcaggctggagtgaagtggtgcaatctcggctcactgcaacctccgccccctgggttcaaacaattctcctgcctcagcctcccgagtagctgggattacaaacgcctgccacccaccatgcccagctttttttttttttttttttgtatttttagtagagacgaggtttcaccatattggccgggctggtcgtgaactcctgacctcaggtgatccatctaccttggcctcccaaagtgctaggattacaggtgttagccaccacacccagcctttttaaatgtttttttcattaggaacaacatattccaaacctataaattgagttcatctgtaattttttctaagatacaaattatgaatccaacttactttttttccagattgctcccttttcttcctaatgtcttttattaactcatcttttctcaacagattagaaatggtacttttatcatctactacattcctgcctgtatttgaatctgtttctaaa

SEQ ID NO: 460798 - DNA, 4485 bp, Homo sapiens
aaaagacaaacagtaacaaatgctggccagcaaggcattggctgctctgctcacggctgagaggcagagctgctgattcgctctggaaaggctgtggctgtccccattggaccctggaggtccttggcagctcccacttctgtatatgtgactctgggctgtgacctctgccattgccccagctaagcagcgagagcttgctgaagcccagagggctgtgggaccatgagggcagctctctggaccctgggactcgggccccttcttctgaatctctgggcagtccccattggtggaccaggtgctctgaggctggcgtacagacacagcacgtgcgacggagtggtgttggtccgacaccacggggcatggggatacgtgtgcaaccaggagtggacgctggcagaggcctctgtcgtgtgcaggcagctgggctgcggccctgccgtgggcgcccccaagtatgtcccgctgcctggagagatggcccagccctggcttcacaacgtgtcctgccggggcaacgagtcctccctctgggagtgcagccttggctcatggtgccagagcccgtgcccccacgcatgggtggtggtcgcgctgtgctccaacggcactttccgggagctccggctggtgaagggccgcagtccctgcgcgggactccccgagatcagaaacgtgaatggggtggaccgcctctgtgtcctgcatgtggaggaggccatggtgttctgccgggagctggggtgcggccctgtgctccaggccccccgccgggacgtgggcgtcgtcaggaagtacctggcctgcaggggtaccgagcccaccatccgcagctgcagactggacaacaacttccgcagcggctgcgacctgcggctggacgcagaggtggtctgctcaggacacaccgaggcccgactggtgggcggcgagcacccctgcgccgggcgcctggaggtgacctggggcaccgtctgtgatgcggccctggacctggccacggcccacgtggtgtgccgggagctgcagtgtggggcggtcgtgtccacgcccgagggcgcccgcttcggccggggctcggggccggtgtggacggaggccttccgctgtgcgggcaacgagtcgctgctgttccactgcccacgggggcgtgggagccagtgtgggcatggtcacgacgcggggctcaggtgctcagagttcaggatggtcaacggcagcagcagctgtgagggccgcgtggagttccaggtgcaggggtcctgggcacccctctgtgccacccactgggacatagcagatgccaccgtcctctgccaccagctcaactgtggcaacgcggtggccgcacctggaggaggccattttggggacggggacgctgccatctggcctgatgcctttcactgtgaggggacagagtcctacttgtggaattgcccagtaagcaccctgggggccccggcctgtgccccgggaaacacagcctccgcggtctgctcaggtctggcccacgccctgcgactgagggaaggacagagccgctgtgacggccgcgtggaggtctccctggatggcgtgtggggccgcgtcctggacgatgcctgggacctgcgcggcgcgggcgtggtgtgccggcaactcgggtgcagaggggcccagcaagcctatgacgcacctgcccccagccgcggatccgtccaggtggcgctgagccgcgtgcgctgtctgggcaccgaaacccgcctgactcagtgcaacgtgtccgcgaccctgcaggagcccgcggggacctcgcgggacgccggcgtggtgtgctccggtgaggtcggaaccgcgtcccccatggcccgtcgccacgggatcccgggcgccctgactctgtctctccacagggagcctcagggtgcggctggccgcggggccggggcgctgcacgggggcgcgtggggcaccgtgtgtgacgatgcctgggacctgcgggacgcgcacgtggtctgcaggcagctgggctgtggccgcgccctgagcgccctgggggccgcacacttcggagccggggcagggcgcatctggctggacgagctgggctgccagggccacgagtctgcgctgtggcagtgcccgtcggcgggctgggggcggcacgactggaggcacaaggaggacgccggcgtcttctgctcagagtcggtggctctgaggctgcgaggtgggacctgctgctgtgctgggtggctggacgtgttctacaatgggacctggggcgccatgtgcagcaatgccctgaaggacctctccttgtccatcatctgcaagcagctggggtgtggggtgtggggagtggggctggctggagaacaggcccttcccctctgcgggcaccgggaccgcctgggtggacaacatcgagtgccgcaggctgcccaactccactctgtggcaatgcccttcccacccatggcacccgcactcttgcgaccttcgagagcaggtctggattacctgtgcagagcctgggcctgggggtcactaggatccacagccttccttgtgaagcttctctgggcaccgaagctctcagagctgctgtttaacccgcaggattgtcagaggacaggccacaggctgctggggagcccctcaactgctcctcctggctcggctgcccaggtacccctctgtccttgtcgctgtcctccttcccatcccggtccagcccccgcagtgaccgcagccccttttgcagaggagggcgcactgcgcgtgcgcgggggcgaggaccgctgctccgggcgcgtggagctctggcacgcgggctcctggggcaccgtgtgcgacgatggctgggacctggcggacgcggaggtcgtgtgccgccagctgggctgtggtcgggccgtcgccgccctgggggccgccgcctttggccctggctccgggcccgtgtggctggacgaggtggggtgccggggcagcgaggcgtccctgtggggctgccctgcggagcggtggggacgcggagaccgcgcgcacgaggaggacgcgggcgtgcgctgctgggagcctggcccaggccccccactgcctgcagctcccttccggacattctgggtggtcagtgtcgtcctgggatcccttcttggtcttctccttctgggcctcatggcttttctgattctgcctcgagtcacacaagccatgcagagggccctcaagactgagctcaaccctagaaggttcccccaggcagcacattggggcccactgggaagcatcatgtggtttgctggcaagggacggtggccagggatgggagggcactgggagtctggctatgttgccgtggtccctccatcccagcccacagcatcctgcctctttgctgcctggctggggttcctgcctggagttgctgtcctcccttgcctgtggccacatccacactgagggcctgtgtgtgaccatgctcaccttgcctcaggtctgggaagatccgaggtatctcctggagaagccatctatgatgtcattggggaaatgccgccagcaggactgtacgaggaaatcatggaggccgaggctgtgctccaagatgaggaggacggaagtgtggtgaaggtggacacagaagccgcagtttcaggggaggtgtctaacctcctggagggacagtctatacgtgcggagggaggacacagcagacctgtttctcagggatatgacgaggctgcgtttcctctggaggagatgacgttgtaaagcaacctgaggatgagatacaccagctggctgtcgaaatcacagctcttcattttcttgtacaattgtagtggatttcgtgagaacaccttggatgcctttctcttgcaatgtcctccatgtccatgtaaaatccagtccttccaggccctgcctggctctaaacctcatccccttcgagggccatctgctgtggacagttgtgctgtgtaaccttcagatttcccacacattacagcaaatgcaaatacacatagaaatcagtggttccatttgtggtttagagacacatggtgccatcttcatcttccgctccacagctcgcttctggcacccagcagtgggttgcagagctccccatgccagaaccttcctcttttttcttaaaaactcttcttaattgaatccaaagtatcttttaaatgttctacttgtgtaatcatgtcatctgtgaatattcagatttatcttctccttccaatccgtgtacatttaatctctttttctgtgccttatttcgggggctgggacccttcagtccagtgttgaagagaggcagccagtggaggtcttgtctcattcaaggactcagagcaaatgtgttccacatttaatttcactatgaaatataatatttgatgttcagttttgtagatgctatttatcagatcaaggaaagcccagtctatacctaatttgttaagggttttgcttttt

SEQ ID NO: 460799 - DNA, 1359 bp, Homo sapiens
aggcgttcctgcgcatgcggcagcccaggagccagagcacaactgcgtttcctgtcagcccgacaagggaaacgatgcacgtcagcaccatcagagactcacagagaataagtcacctatcaaaaggtgggggtcctcaaatccagtttgaaatccagttcttgctgactctgaagcctgacctctctctactgccacacaagttctgtgctaacatgggaataacattaggatcaaaacacccccactcatctagccagggctgtggacccgatgattactctatcctgggcctgaaattttctctcagggggaggaattcaggtatgcaaagaggtggttgtgacaccctcatgaccaggactgatcatccatggacaggaaaggagaccatgcattatgaaccagaggaaaatgtgaccttcgctaggataagtgtgaaaatggctgggcctgtggtgaagacttcccttgtgctaaaggtggagggcctttctgggattcagtgacttcagagaacccttctgtgttgcttaattcaggagatgcatacaggagctggagtcaaagctggtgagcgatccaggcttatgaagatgctggacagacttgttatttcctgtatgaggactatggacaaatcagtggccagaggtattggagacacaaaccctacctgagatgattcttggcctctgtcccatatccaatagagataagcctctcccatcacattccatcttgttcaacttgcttgataaaaacagtggcgcagtttgagagaatggactcccattttaaaagaagttctattgtgtataaaatgctatgcaaatagcattgcatgctacattaaaatctttcataaaaggatgagtcagttgatgtggcagacttcactgttgtcttgttttaagatattggcacagcctgtcttaccttcagcagccacttcagcagccatcaatatcaagcaagaccctccagcagcaaaacgtttggcttgataaagtttctgatgatggttaccatttcttagtgaaaaagtatttttttaagtaatgcatgcacattgctttagacataatgccattgagactcaatagagtacagtatagtgtaagcataaattttacatgtacccgggacaccaaaaattcatgtgattcactttattgtaatatttgctttattgcagtagtggaagtggacttctaatatcttcaatgtatgcctattatgataaaggttgtatatcaaagtagtgtgtaaaacaggcacaattgaatgaatgggattgggacaactgagtttctgtgtgaaataagtaaaggtggaaacatactttacatatgattt

SEQ ID NO: 460800 - DNA, 1215 bp, Homo sapiens
cccctggtctccggacttcacttcccaggaggcctcgcgcgcgactggaagtgctccgagcctataagaaggcgaggcggcaacccgtgctctgctctggggcggcattgcagccggctgtaggcattcaggggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtggccccctggccctgccccacagcatcatgatggggaaactccccctgggggtcgtctccccttatgtgaagatgagttcggggggctacacggaccccctgaaattctacgccaccagctactgcaccgcctacggtcgggaggatttcaagccccgtgtgggcagtcacgtaggcaccggctacaaatcaattttccagcccgtggtctcatgccaagccagtctggaggccttagacaacccggccaggggggaacaagcccaggaccatttccagtctgtggccagcaagacgtaccgccccctggaggtcgtgacggcaagcatcccctgccctggagatgcgccagaccagctcaggctatgggcgggagaagcccagtgcggtccccccaccaaggagttggtcaaggtggaggtgacagggcatggagcagccaccttgtagggatggggtccactcatctttctcccctttgtcctcatccttgtccccaccatccccaccacctctattccctgccccagccccaccattacctccacctccatttccatccccatccctgtccccattcccatgagcctcacactcccgtccacacctgcaagccccatcactgtccctactaccaccactgtccccccaccatggacatcctcaccccatcttttt

SEQ ID NO: 460801 - DNA, 1027 bp, Homo sapiens
  misc_feature (969)..(969): n is a, c, g, or t
  misc_feature (976)..(976): n is a, c, g, or t
  misc_feature (998)..(998): n is a, c, g, or t
cccctggtctccggacttcacttcccaggaggcctcgcgcgcgactggaagtgctccgagcctataagaaggcgaggcggcaacccgtgctctgctctggggcggcattgcagccggctgtaggcattcaggggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagcccgccatcctctctctgtccatcgcatccgtcatttcgggcattactgagaagcttttcttcagtttgaaaaacaccaccaggcataccacagctgcccagtgaggcggtctttgcaacagcaccggatgctngtggtgnctttgggctgctggtgctctanttccttctggcttcatctggagcgcccga

SEQ ID NO: 460802 - DNA, 1061 bp, Homo sapiens
actagaaaacccctttcgtttatattatagagtaacacattcattcacgtggttcaaaattcaaaaggtacaaaaggatactcagtcattttctgcctaggaagcaaccagtgctaccagtttctggtatatttttcagaaaaattttacacatatctttattaaagagcattgtgcaatgaagacctttctacgtacatcattctccacatatgtgaatatatttgtgccctagccaatggtacggctgggtcctgtctactttgacttatgtgttctccatgccagtattgtatagtggagtcaacaccctgttgactctaaagtaagcatatgagataaatcacatcacctgaatggctgttttttcatacattgccgaactgttccttggggggatattggattatggaccactggattatagcattaccctcctattgtttctgcttcctctcaccgccatgcagcttattctccatctagcaaccagtgtatcagatcaaaacatgaatcagatcatgtcttgtcttttcttcacaaccttcctgtggcttcccatctcattagcgtcaaatctggaagagaggatgatgagctactctgcggtaacagagagaaggtcactgatgagtcagcttgggctgccacagcaaaataccacagactgggcggtgcaagcaacagaaattttctcacagctctggaggctggaagtcctccaggtgctatcaggattgggttttggacatatgaatttgggggaacacaaatattcagtccatgacagcgacaattctggagagtatttgaagataaaatcagcacaagttggtcccaaagctttgaaaacctgaggtataaacaaaacaacatattccaatgagatattgatatctaaactagttttcttaaatctgtcattcaaaggttgagaatttcttcctgaaatttagacaatatattatggaaatgcggtttgtctttttgtaaatttaggatgattctttttaaaaataattataggcattgtttattctgtatattagtgtaatagtcaa

SEQ ID NO: 460803 - DNA, 2813 bp, Homo sapiens
ggtccagcgaaggcagagccccagcttcactccctgaggtctgtcctggggagacactgctgctccggggggctgacctggcggggagtggccgcgcagtctgctccggcgccgctttgtgcgcgcagccgctggcccctctactcccgggtctgccccccgggacacccctctgcctcgcccaagtcatgcagccctacctgcctctccactgtggacctttgggaaccgactcctcacctcgggggctcgggccttgactgtgctgggagccggtaggcgtcctccgcgacccgcccgcgcccctcgcgcccgccggggccccgggctccaaagttgtggggaccggcgcgagttggaaagtttgcccgagggctggtgcaggcttggagctgggggccgtgcgctgccctgggaatgtgacccggccagcgaccaaaaccttgtgtgactgagctgaagagcagtgcatccagattctcctcagaagtgagactttccaaaggaccaatgactctgtttcctgtgccctttcattttttcctactctgtagctatgtctcgatcccgccatgcaaggccttccagattagtcaggaaggaagatgtaaacaaaaaaaagaaaaacagccaactacgaaagacaaccaagggagccaacaaaaatgtggcatcagtcaagactttaagccctggaaaattaaagcaattaattcaagaaagagatgttaagaaaaaaacagaacctaaaccacccgtgccagtcagaagccttctgacaagagctggagcagcacgcatgaatttggataggactgaggttctttttcagaacccagagtccttaacctgcaatgggtttacaatggcgctacgaagcacctctcttagcaggcgactctcccaacccccactggtcgtagccaaatccaaaaaggttccactttctaagggtttagaaaagcaacatgattgtgattataagatactccctgctttgggagtaaagcactcagaaaatgattcggttccaatgcaagacacccaagtccttcctgatatagagactctaattggtgtacaaaatccctctttacttaaaggtaagagccaagagacaactcagttttggtcccaaagagttgaggattccaagatcaatatccctacccacagtggccctgcagctgagatccttcctgggccactggaagggacacgctgtggtgaaggactattctctgaagagacattgaatgataccagtggttccccaaaaatgtttgctcaggacacagtgtgtgctccttttccccaaagagcaacccccaaagttacctctcaaggaaaccccagcattcagttagaagagttgggttcacgagtagaatctcttaagttatctgattcttacctggatcccattaaaagtgaacatgattgctaccccacctccagtcttaataaggttatacctgacttgaaccttagaaactgcttggctcttggtgggtctacgtctcctacctctgtaataaaattcctcttggcaggctcaaaacaagcgacccttggtgctaaaccagatcatcaagaggccttcgaagctactgcaaatcaacaggaagtttctgataccacctctttcctaggacaggcctttggtgctatcccacatcaatgggaacttcctggtgctgacccagttcatggtgaggccctgggtgagaccccagatctaccagagattcctggtgctattccagtccaaggagaggtctttggtactattttagaccaacaagaaactcttggtatgagtgggagtgttgtcccagacttgcctgtcttccttcctgttcctccaaatccaattgctacctttaatgctccttccaaatggcctgagccccaaagcactgtctcatatggacttgcagtccagggtgctatacagattttgcctttgggctcaggacacactcctcaatcatcatcaaactcagagaaaaattcattacctccagtaatggctataagcaatgtagaaaatgagaagcaggttcatataagcttcctgccagctaacactcaggggttcccattagcccctgagagaggactcttccatgcttcactgggtatagcccaactctctcaggctggtcctagcaaatcagacagagggagctcccaggtcagtgtaaccagcacagttcatgttgtcaacaccacagtggtgactatgccagtgccaatggtcagtacctcctcttcttcctataccactttgctaccgactttggaaaagaagaaaagaaagcgatgtggggtctgtgaaccctgccagcagaagaccaactgtggtgaatgcacttactgcaagaacagaaagaacagccatcagatctgtaagaaaagaaaatgtgaggagctgaaaaagaaaccatctgttgttgtgcctctggaggatttgatggaaacatagagaaattgtatgaaatgtgtttttgcagagatttcccctatgcctcttttggctagttgcatgtcttttttggcagtcacagatttaaaaattaagagtggaacaaattcattaactccatagcagcctgaaaaaccagaggaattaaacatctttccttttgaaagaacacagttgcatccctaatcttgaaactttgttttggagacatagcaataatacagcttttgtctcaacttttgtggctttactgttattttttaattcgccattgtcattggacatttattgacagaaatcaaattgctgtgtttctgggcaaagc

SEQ ID NO: 460804 - DNA, 3931 bp, Homo sapiens
catgaggagtcttcaggggattaaatgagtacgctagagcggtcttatttgttgaagatcaatggaaaagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctcgatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggtatgaatagatttctctgcttattggtaattattgaaatccaaattgaaaggaatcaatcatgatcttcaagtcatcatttaaatggttatcaataaaatggtttgagaaaaagaggtagtctgtctcatttggtacagaatgttgcttttcctgttcagtaatgttttctccttttctttaaaatctgttgacacaaaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaacgaagtctctgtcgcccaggctggagtgcagtggtggaatcatggctcactgcaacctctgcctcctaggttcaagcgattctcctgcctcagcctcccaagtagctgggattacaggtgcctgccaccacgcccggctgttttttgtatttttagtagagacagggtttcaccatattggccaggctcctgacctcaggtgatccgcctgccttggcctcccagggtgctaggattacatgcatgagccaccgtgcctggcctcagacatcaataatttttaaagattcttttggtgattccaaagtatatcaaaatttgggggatcatagatagaaagactgaaattaagagagtcaagcttaattaaaaatcatggttgacgactgatagtccaaaagacagagtcacaaatcgtgtaaatatttgcaactaagagtcaagaggcatttatttgcagatagaggtgtctggctaaatgttggtctgcttagcaacacagatgaagagtcctataacagttccatatttaatgacagaaactgtagcattagccagtctgtgtgttttaatgaaagttaaccctaggcctaagaaaacctgattttggattccaaagggagtttgaaatcctagcttatttaaagggttttatctcattgcttcccttggtccctgtgaattacagcccttattttttgtgttttctgcaaaactcaagggtcatttattgctgcttagctctgacttttcctttctttaagtgcctctagaagaatgaatgtttgggtcataaatcaattaaaaaattaaaaaattggtttatgaccaacaaaaaagggatgctgaaattactatcaccagattgatatttggttggttagatgggggttttgttcaactttctaaatagtcttggtaaacttgataaggatcatatcatatgatactgaatggtaaggtcagatctggcaggaagtaaaatgaagatcaaagcttgtgtcactattctattaatcatacactgctttctttaactggagtaaagtaaacattgggttttccttctttagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgattgtatgagattaattttgtcatttactttcatataaaagtcaaatttgaaaaacacattttctgttctttgagaattcagggaggaaattatatgcctttttcttttcttttcctttctgtagtaaaatatacctaatatacaatttaccattttacccatgtttaaacataaaattcagtggcttaagcacattcatagtgttatactaccatcaccactatttgtttccagaacttcatcatcccaaacagaaactctgtatcaataagaacattaactccccctttcccctccaagtccctggtaacctctattctactttctgtctctatgaatatgcctcttctagggacttccatagtgcatctattggttgacttgacggtgttccatagctggttggttggttggttgaaacatggaccaaaatttgccttaagtgaagttgaaatgccagtcctgccttggtatactatagaggaagtagttcaaaggcttagggagatc

SEQ ID NO: 460805 - DNA, 1758 bp, Homo sapiens
gatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagatcgagtcatgtttgacaaaattacatctcgaatccagaagctttgttatggactcaatatggattttgttgatcctgctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtgatgtgatggaagacctctataactacataaatccacataatggcaaacactctcccatggtggccaagtcaacattggatattgttctggccaataaagatcgcctgaattctgctattatctatgaccgagatttctcttacaattacttcggctttaagacgctagagcggtcttatttgttgaagatcaatggaaaagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctcgatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggtatgaatagatttctctgcttattggtaattattgaaatccaaattgaaaggaatcaatcatgatcttcaagtcatcatttaaatggttatcaataaaatggtttgaga

SEQ ID NO: 460806 - DNA, 1047 bp, Homo sapiens
cttctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcactgtcctctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggacagccctggaaagtgcccaatcaacggtcgctctgaggaggcaacagcagatggtcacacaaatggacgaacaaaaaaattcatgtcttctcccctcactttccacagcgatgacaagagtggcagcgtggtgatctttggtggcattgactcttcttactacactggaagtctgaactgggtgcctgttaccgtcgagggttactggcagatcaccgtggacagcatcaccatgaacggagagaccatcgcctgtgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcaggtgaggaggctctggaccatccactagagaggttcacacagaatgtggacacagagtccccttctgcagagggaaagtacacttccac

SEQ ID NO: 460807 - DNA, 1125 bp, Homo sapiens
tcaattgtaagatccttaagatcagagagtgagtctcatccatccatatgctctgccatgctaagcacggtgcccagtacagaaggtttacattgccatggggattttgagaacgtctggtcaatgggaggtttggtgaaaacaatgtgggtcgtggatgaaagaatcccagataaacagccatatccagtgcccctgcaggggagagttttatggggaatatatgattcgccacaaagaatccagacaatatttatcttccttcaactggcaacaactccaaatttcatcaaagggcatggaaagaaagcatgtactgtcaaaagagaaaaaaattcaagatgtcaggtgagtgattattggggtgagatccatctccgatttgtttacatcttctgcttttctgattttggaaggaggcccaggactgtgcacaccacagggctggctgtgctgtacgagagttctcataatcgagatgccctgaaggtcctgctgtcatctactgttaaagctcagcccagccaccctcttgagaaaggggagaatggccatcagcaatgcagagttcattttataagcatctctcttgtatgtgatctctcatttccttttgaagataaaaggcgagtgatgagtgtccccttggtctagttttcctgtcttctttctgttgtctttcacctaaaaacctagctatgaaaaagcaaggactcagctgggcacatggtgcattagaattcacattccatctgaataatattaaatctccctcttggcatcctgtttatgctaatctttttcgggacttaatgatgtttatcaggacttccatttcctcttctttagaaatgtgctcagctaatgaaggaaggttggttttcttgagaaagaaagattcataagaagagtatgcagcagattcttattctgagcattgcaggttcagcctctcactgcggtgacttcatattcatcaggaataggtataatctattctgtgcacagttgatttagggcagaaataaaagctcagacaacaaagcaaggctcctcttacacactactatgtctgaatacaaatggttcataattgaaggctaaacttcctcatctcacccacag

SEQ ID NO: 460808 - DNA, 1516 bp, Homo sapiens
gctggcacagagcggttcttgctacacccttagaagtgagatttttcgaaccatgccttgtacatatcagcacccctttctctggagcctctgccccctgcccccagcatcaccatcattcagagttccacgaagccaggttcctgtgagaagtgacatggcccacggaatctggtttttcatctcctgggtgaaagcgctgccgggagacgccaccgccaccaggagccctgtactaccagccatggtcaaccccaccatgttcttcaacatcgccatcaacagcgaggccttggggcacgtctccttcgaactgtttgcagacaagtttccaaagacagaaaactttcgtgctctgagcactggagagaaaggatttggttataagggttcctgctttcacagaattattctagggcttttgtgtcagggtggtgactttacatgccataatggcactggtggcaagtctgtctacagggagaaatttgatgatgagaacttcattctgaagcatacaggtcctggcatcttgtccatgaagcatacaggtcctggcatcttgtccatggcaaatgctggacccaacacaaacgattcccagattttcatctgcactgccaagaccgagtggttggatggcaagcatgtggtctctggcagggtgaaagaaggcatcaagattgtggaggccatgaagcgctatgggtccaagaatggcaagagcaggaagaagatcaccactgctgactgtggacaactctaataagtttgacttgtgttttatcttaaccaccagaccattccttttgtagctcagaagaacaccctccaccccatttgctcgcagtatcctagaatctttgtgctctcactgcatttccctttgggttccatgttttccttgcccccttccatgcctagctggattgcagagttaagtttatgactatgaaataaaaactaacaaaaaataataataatctacccataaaattgtgaaaaaggaaaaatacctttgtgcataggctatgaagtttaggagtgggtactagccatggttttaggcatctcctgggagacttggaacgccttcttgaggataaggggcacctactgtatactgtttgtattcatctgttgtcatttgaaaggaactgaatgtctttccaggtcaccacacagcctgcacctgagtcaggtcaattggctggccatcccgtcatgtggttctacacagggtaccattatttatttagtcccctattgctggaccctcatggccaaggctgccagtgggccccttcttccacagtgacagtttgttctgggcacctggagggccccactcatccctcctgctggctgggatatgtgtaccagtggtaggaagtcatcccacagcacctgcaccaagccagcatcctgggggcaggggagacaggacagagggagccagccctgctgtcattttagggcacaaattccccactgagggatgcagagaccttttcac

SEQ ID NO: 460809 - DNA, 848 bp, Homo sapiens
ggacgcagatgagggacgggcggatgacttccttccggacgcagatgagcgacgggcggatgacttccttccggacgcagatgaggaagggattccttccggacgcagatgagggacgggcggatgattccttccggacacacctctcaatgtgcacgtgctgctcctgccaggcggatgacatcaggaatgctcatcaacttgagggcgaagaaatgcttggcggtcttctccttcaccgggtgcacccgcccgaacgtcccagtgcccacggtggccagtgtgtcgaagtcctgcaggcgctgattcacaactcaagtagcacagtgaaggtggacaatttggactgcctaagcatcccagcatcgtctgttctacatatcactattccaaatggcatgctgctgtgtttgtgaatccagcctcccacattgggtatgtcaccattggcctataacaactggaatgacacatcttcactagaggcaggccttggccatcctccacagcagactattgagtaacaaaataagcagtactatttatttacttcttactatgctgtttaaaaaaaaagcctctgatgaaatcctggtggcttcttctctgttcttaccaatccaggaagtgtagagagctgttgagccctgtttccaaatccccaggtgaagctgcgctgacatgccttctgtccatacagccctttccaagactcagctatttgtgatcacccccaaatgttaccctgattctattaccaatttgtaataaaactcacttgtatggtggaaaggctgttgccaattaattttattttcgtcacccattttcccttccatgtaatcgtc

SEQ ID NO: 460810 - DNA, 659 bp, Homo sapiens
ggacgcagatgagggacgggcggatgacttccttccggacgcagatgagcgacgggcggatgacttccttccggacgcagatgaggaagggattccttccggacgcagatgagggacgggcggatgattccttccggacacacctctcaatgtgcacgtgctgctcctgccaggcggatgacatcaggaatgctcatcaacttgagggcgaagaaatgcttggcggtcttctccttcaccgggtgcacccgcccgaacgtcccagtgcccacggtggccagtgtgtcgaagtcctgcaggcgctgattcacaactcaagtagcacagtgaaggtggacaatttggactgcctaagcatcccagcatcgtctgttctacatatcactattccaaatggcatgctgctgtgtttgtgaatccagcctcccacattgggaagtgtagagagctgttgagccctgtttccaaatccccaggtgaagctgcgctgacatgccttctgtccatacagccctttccaagactcagctatttgtgatcacccccaaatgttaccctgattctattaccaatttgtaataaaactcacttgtatggtggaaaggctgttgccaattaattttattttcgtcacccattttcccttccatgtaatcgtc

SEQ ID NO: 460811 - DNA, 1896 bp, Homo sapiens
agcgagctggatgtcaggcagtgggcaaagtagtgaactggaggtgagaaaacaatgacacaaactcagggcttctcttcccaagtatttggctgagaagagagatgtagtattaaagggagatatgtggtaaaggaagccttttatttcaagattcaacaaaagcgtgagtatacttctatgttaaagggaaagagccaatagagaaaacacatttttgaggttagaagagaaggaagaactaatgcagaagggccccaaaaggcacaggtgcgtgcaatccggatcagggacagattagctttggattcctacaaaagcaagaagggagaaaggaccatgtgacactagagatatttctggtaaaggaaaggtttaggaaaatatcttttgatgacctttattttaacataatttttttttttttttttttgagatggagtcttgctctgtcacccaggctggagtgcattttagaggaagaggaaaaaataataagaaaattatatgcagttgcaaaatgtgtgactatttacaaactctaacatataactacaaaacggaccagaagaatcattatcataggaagcaaagggtcatttcaaaaatcagaggagggatgattcatatttaatttaattctgtggaaaacatttaagtaacctttgaggacaaaaataggtgatatgttgaaatgcgggaaaccacagtggaaggaaaaagaattcaagaaagctcagtttcagtaaccagtatctagtaaaatcttcaggacctagaggctacaatctgcattaatagtgtctgaagacctagaaatgtcattaaataccattttggataattcttgtagacttgagatgatgtctatttaaagttacaagacagtgcctgtatttctgtattcataacagaaaacaattggatatggaaaagaaactaacatgctatgccacaatctctaaagaaagattagggaagtttcagcttaaagcaagaataatcacaataaagttttacaaccctttgcaagcatatatgaaaaacttacaaaaagtttgtaatgatcttttcttaagctaagagaatggaaaaaatgagaaaaattaaattataaaatgaaactttggtttagaggtaagaaacatttgatgacagtcaagagatcagggttgtacagtgtattatgtgaatgttgcagcgataaagggagtaaaaaaacacagccatggatcgggagactaaggtacctccagaggagtccagtgggtccagaagccctttggatgttggtcagaggctcctcttgggcagagatcacagcagcagccaacagaaacccaacgtgtataacctattttttctatgttcttctaacatttattcaacttctctcatctgatatcttgccaaatcattcaaagagaaaatatatcccattaggcaagagccgaccatattcccatcacctgagaaaatcatatgcacaggatgcacccacctcacctttctctgcctcatcatgtcagaaaaagtacccctccttttgccacaaggcaaatctgagataaaagatttagatggcctgtaattccagcacttggggagaccaatgcaggcagattatttgagtctaagagttcaaaagaagcctaagcaacttagggaaactgcatctcttaaacaaatacaaaccattagcctagcatggtggtgtggtggcacatgcctgtagtcccagctactcagggtggggagcactgaggtgggaggatcacctgagctggaaggttgtggctgcagtgagccgtgatcacgtcactgcactccagccagggtaacagatattttttaaaggatcttctctgttaaaaataatccaataaacaggtggcc

SEQ ID NO: 460812 - DNA, 1571 bp, Homo sapiens
aagtggaagaggaggatggtgacgccagcgaatgaatgaatgaggacacagatgctgcactgggtaacaaaaatactcccatgagccaggaaccaagcaaggactgcacaactaccaaaaaactgaatcagacatgccggctgctgcagcagggcgggcagctgcaggtgctggcacaggcactggctctctgcgaggccggaccaggtgcaccacaagcagctttcacagctggcactggggaacacgtggcgctcagaagcttggagatgccagcaaccacagggctccaaggagggagtcacagccctggctcagggagctcccagcagggagaagccaggcagcaggagcagacacctctgagcctgcgagggctggggcagccttcctgggccccacaagagtacacagatgcctgggtccgcagtcacagtttgggcggccgtaactgcactcggaagagcggagctcctgcttgctccgtggagcaagaggcctagatccacagccatgacttgggcaccgccccaactcggaaggggcagggctcccacttgtccctggctctgactggctctggccacgcctccctgctgcagccagagtgatggcagcggccaatccagatggcccacgatttcatttatatgaaatgactagaatagacaaatcataggacggaaagatgattagtgggtgctaagggctgggagatgacagtatggggagtgactacttatggaagtaactagcattaaaagtttggcacatatttttcaagactattttcagagaatttgcacacttacatctttatgtattaatgtaaataatatacttttatcttcagtttgtacgtaattgagactatctctatatattgccctgtgacttttttttaattaccatcttagagctgtttccagtacatgtagacgttcctcattcttttttaacaatgtccagaatatggataccatattatttatatttttgagattattagagaaaagtttcttgaaagatgtaacacttgagctgggacatgcagattaagatttttatttatttaacggaggaaggtcatttctggctggggtaataatgttgttgacagagttcttttttttgttttttttgagacggagtctcgctctgtcacccagactggtgcgatcttggctcactgcaacctccacctctcaggctgaggcaggagaatggtgtgaacctggcaggcagagcttgcagtaagctgagatcgggccacagcactccagcctgggcgacagagcgaggctctatctcaagaaaaaaaaaaagaaaaaaagaaaacaggaagaaatgttgtcatttatttgtagaatctgaaacatttgaactcatagaagcagaggaatatattgtgttttgagatctattgcatagcatggtagattgctaagagtaaatttcaaatgttctcaacccaaaaaatgttaagcatttgaggtgatggatatgttaactggcttcatttaattattccatattgtatttataagtcacaataggactttgtggcccat

SEQ ID NO: 460813 - DNA, 693 bp, Homo sapiens
tagaggcagggaggaaacaaaatgtctgcagcctcagctcaggctttgattcggctggaatgcgttcattcattcttgaagttggagtttttcaatcaaaatgaaacctactgctctgactctaatggaaaacaaccaaattatacaccgggtaattatagcttccagcctcatgtcaggagtcccctgctcaacagcgtgctcctggtgatactgccacccgtaacgggtactggctttgctaacatcctgacgagacgtcggggagagacgggaagtggcagagatgggatctcactgtgttgcccacgctggtttcaaactcctagcctcaagcaatcctcctgcctcagcctcctgaagccctgggattacaagcataagccaccgcccccggccagatcacatgattctttacatctctgctgacagatttcatcactggtgctgagtgcagggagtcccgcagccacttacacgtgttgcattgccgggcaatacaggcctgtgtgacttgctattctatggctgggcttctgcctgcagatgcctggtttctccactgccaaggctcatggtctgacacatccaggaaattcaacagtgaggatgcaatgacaatgagtcgtgcatgagggttcccgggcctcgctcccctgcccatcagagaaggcttggcatctcagctgactc

SEQ ID NO: 460814 - DNA, 1674 bp, Homo sapiens
gctcggtacccataggttcgcagggcattgtagctcacgcctgtaatcccagaactacttgggagcctgaggcaggaagatcactttagccaggaggctacagtgagccatgattgtgccactacttgggcaacagagtgagacttgtactcttaaaaaaataaataataaacccaggagcctcttaacctagatcttctttttaatttagttaagtaatcaatgcatattttcctttgtgcacattttttgggggattatttattaacaagtaaaaatgcatatattggtctataacatgacattttgatgtaaattgtagaatggcatacagaacttcttgatagtatgattttacctcagttgggtttcattgcgtctatattgatataagtgtttttactcctgtactgagttcaggctgtcttttgattacaatttgttattagaatgcagtagtgacagcttggtctctggagccagatagacagggtttgattctggttctgcctcttactggttggacatccctgcctctcactggttggacatccctgcacctcagcttctgtaccatgggaatgatacctacctcaggagttgttggagttaaaacacatgaagtgcttagcacaggtgcttagaacaatgcttagaactattgaataataaggttcagtaaatgtttgttgttattatttaggaaataaagtgtggttaaaagttatctttttgactaggcatggtggctcacaactgtaatctggcactgtgggaggccaaggttgggtggatcacttgaggccaggagttcgagaccagcctggccaacatgacaaaaccccatctctaccaaaaatataaaaattagccaggtgtggtggcatatacctgtaatcccagctactcaggtggctgaggcatgagaatctcctgaacatgggaggcagaggttgccatgagccaagattgcgccattgcactccaccctaggtgacagaacaagactctgtctcaaaaaaaaaaaaaaaaattttttttcagtaaggtcttctctgaccctaaatataatggcaactcttgttttaattcttcattccttaattaccttgctgtgtttttctacatggcttaccattacttgatattatatatttatgggtttgtcttcccctactggattttaaactctgagggcaagaactttgttttattcatagctgtgttcattctaatgcctaaaacagtatctggttgatagctggtgttcaataaatatttaaagatgaataaatgaaagtatataaataccactaaatgccctttgtttggggagggggtcgtctatttgattattttaacgagttactgccttttgtgagggagcgtattttgttttggcagtgcctcagtattgatcttttgttgccaaaagtacctaaaaccttacccttcttttttgttaagctatatgtgagacagagcctgaacagcctgttcgacattacccattatgggtaaaagtagaaggtgaagtagatccagaaccagtttatatccccacgccttctgtcattgagcctatgaaaccattgttattgcctcagccagaagttttatctcctactgtgaagggcaaactgctcactggaattaaatctccacggtcatata

SEQ ID NO: 460815 - DNA, 5000 bp, Homo sapiens
cccgcccccagcgggatgtgaaggactccgggtgaggccggccacgccccgcacggatgggaaggccattgtgactatgtggtgattacagttgtcttactactgagtttcctactgaaatcatggaggagaaacagcagattatattggctaatcaagatggtggaacagtggcaggagcagcacctaccttctttgtcatcttaaagcagccaggaaatggcaaaactgatcaaggaattttggttactaatcaggatgcctgtgctttggctagtagtgtgtcatcaccagtaaaatctaaagggaagatttgccttccagctgattgtactgtgggtggaatcactgttaccctcgataacaatagtatgtggaatgagttctatcatcgaagcacagagatgattctgaccaagcaaggaagacgcatgtttccttactgtcgttattggataacaggtttagattcaaatttgaagtatattcttgtcatggatatatctcctgtggataaccatcgttataagtggaatggtcgttggtgggaacctagtgggaaggctgaacctcatgttttggggagggttttcattcatccagaatctccttccacaggtcattattggatgcatcaaccagtatctttctataaactcaaacttaccaacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataagccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatgtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggaagctctagacattcatgcagttgatgggacaacagaagaatcttctagtctccaggcatcaaccacaaatgactcaggttacagagcaagaatttcccagttggaaaaggaattgatagaagatttgaagactttgcggcacaagcaggtgatacatcctggtcttcaagaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaagttgtacttgttaaaggaggatccaaaactaagcattttcagaggaaggctgctcatcgagatccagtattttatgatactctgggagaggaggcaagggaggaggaagaaggaatcagggaggaggaggaacaattgaaagagaaaaagaagagaaagaagctagaatacagtcttctaagtgtaatgcttttcatttatggtgcaactactatggacactgctaggagtgaggagctacttgggagcctgaggcaggaagatcactttagccaggaggctacagtgagccatgattgtgccactacttgggcaacagagtgagacttgtactcttaaaaaaataaataataaacccaggagcctcttaacctagatcttctttttaatttagttaagtaatcaatgcatattttcctttgtgcacattttttgggggattatttattaacaagtaaaaatgcatatattggtctataacatgacattttgatgtaaattgtagaatggcatacagaacttcttgatagtatgattttacctcagttgggtttcattgcgtctatattgatataagtgtttttactcctgtactgagttcaggctgtcttttgattacaatttgttattagaatgcagtagtgacagcttggtctctggagccagatagacagggtttgattctggttctgcctcttactggttggacatccctgcctctcactggttggacatccctgcacctcagcttctgtaccatgggaatgatacctacctcaggagttgttggagttaaaacacatgaagtgcttagcacaggtgcttagaacaatgcttagaactattgaataataaggttcagtaaatgtttgttgttattatttaggaaataaagtgtggttaaaagttatctttttgactaggcatggtggctcacaactgtaatctggcactgtgggaggccaaggttgggtggatcacttgaggccaggagttcgagaccagcctggccaacatgacaaaaccccatctctaccaaaaatataaaaattagccaggtgtggtggcatatacctgtaatcccagctactcaggtggctgaggcatgagaatctcctgaacatgggaggcagaggttgccatgagccaagattgcgccattgcactccaccctaggtgacagaacaagactctgtctcaaaaaaaaaaaaaaaaattttttttcagtaaggtcttctctgaccctaaatataatggcaactcttgttttaattcttcattccttaattaccttgctgtgtttttctacatggcttaccattacttgatattatatatttatgggtttgtcttcccctactggattttaaactctgagggcaagaactttgttttattcatagctgtgttcattctaatgcctaaaacagtatctggttgatagctggtgttcaataaatatttaaagatgaataaatgaaagtatataaataccactaaatgccctttgtttggggagggggtcgtctatttgattattttaacgagttactgccttttgtgagggagcgtattttgttttggcagtgcctcagtattgatcttttgttgccaaaagtacctaaaaccttacccttcttttttgttaagctatatgtgagacagagcctgaacagcctgttcgacattacccattatgggtaaaagtagaaggtgaagtagatccagaaccagtttatatccccacgccttctgtcattgagcctatgaaaccattgttattgcctcagccagaagttttatctcctactgtgaagggcaaactgctcactggaattaaatctccacggtcatata

SEQ ID NO: 460816 - DNA, 1941 bp, Homo sapiens
agttccacgagaatagtcaggcctttctggaagcccagtgccacagtctgcactgagcttggctcaggaaagaagggaaatccaggcggggcctgttgggcccaggtcttgagctcttttggctccagagttcccaacacagtcatggatcaaaactcagtgcctgaaaaggctcagaatgaggcagacaccaataacgcagataggttctttcgctctcactcatcacccccacaccacaggccaggccacagcagagctctccaccattacgagttgcaccatcacggcgtgccccaccaacgtggtgaatctcaccaccctccggagttccaagacttccacgaccaagccttgtcctcccatgtccaccaatctcaccaccacagcgaggcacggaatcacggcagagcccatggccccacaggctttggtctggctccctctcaaggcgccgtcccctcccaccgttcctacggtgaggactaccatgatgagctccaacgtgatggcaggaggcatcatgatgggtcccaatacagtgggttccatcagcagagtgactcccattaccatagggggtctcaccatggcagaccccaatatctcggtgagaatttatcccactattcctctggcgtgccccaccacggtgaggcttcccaccatggtgggtcctacctcccccatggacccaatccctacagtgagtccttccaccacagcgaggcttcccaccttagcgggctccaacacgatgagtcccagcatcaccaagtcccccaccgtggctggccccaccatcaccaagtccaccaccatggcaggtcccgtcatcatgaagcccaccagcatggaaagtctcctcatcacggagagaccatttcccctcattcctctgtggggtcctaccagcgtgggatatctgactatcacagcgagtaccaccaaggtgatcaccaccccagtgagtaccaccatggcgaccatccccaccacacacagcaccactaccaccagacccaccggcaccgagactaccatcagcaccaagaccaccacggcgcgtatcattccagttacctccatggcgactacgtccagagcacttcccaactctctatcccacacacatcccggagcctgattcacgatgcccccggccctgctgcttctcgtacaggagtcttcccctatcacatagcacacccacggggctcggctcacagcatgactcggtcctccagcacaatccgctcacgtgtcacccagatgtccaaaaaagtccatacccaggatatctccaccaaacattcagaagactggggcaaagaagaagggcaatttcagaaacgcaaaagtgagtctttgctgggccccccatgccaactcctgctgcctggcgcaggatccagacctgatctcggccccgcactgtccttccgcagatcgtaaggcccgaccctcctgcacaggtcccccactggctattcactctcctgactgttcatggtcccatcttttattccttgaattatgtacctctttaggccatgaggtgtttgttcattcagtcactgccttatttattcatatgtctaccagtcaaacattgatactcatccaatgtgggtgtgtggcctgcctgggccatggcagcatggggaaaaattcaacacagtcgctgccctcgaggggcccaaaactaggggtggtcacttagctgaccacagatcatcctgtgctcggggcctgccctcagaacatttaccatggtggatcctatctgtccagatttctcccactcacctgtgagctgcttgagaacagagattaggaactaatgcctgaatgagggccttattggagggcaaggagggaccatggcctttagctcatacgccaccaaactttcttcctagtagttcaataaacatgaca

SEQ ID NO: 460817 - DNA, 199 bp, Homo sapiens
tactactactaaattcgcggccgcgtcgaccagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaataa

SEQ ID NO: 460818 - DNA, 3543 bp, Homo sapiens
tgctggtactgccccgggattaacgggcagcgcagtgctcttggccgggaggaggctgtgctgcaccagcacctcttgctccacatctccagagagcccagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagggcgggccgggatgtgggcagtgcggagctggcactgttggtagccccaggcaagccccgacctggcaagccgctgcccccgaagacacgtggagagcagaggcagagcgccttcacggagctgccgaggatgaaggaccggcaggtggatgctcaggcccaggagagggagcacgatgaccccacaggccaacctggtgccccacagctgacccagaacatccccagaggcccagctggcagcaaagtcttctctgtgtggcccagcggagcacgaagtgagcaaagaagcgcctttagcaaaccaaccaagcgaccagcagagaggcctgagctaacctcagtcttccctgcaggggaatctgcagatgccctgggggagctgtctggactcctcaacactacagacctcgcttgttggggtcgactttcaactcccaagcttttggttggtgatttgtggaacttgcaagcattgccacagaatgctccactctgtagcacttttctgggtgcccctacactgtggctggagcatacccaggcccaggtgcccccaccctcatcatcctccaccacttcgtgggccctcctgccacccaccctcacctccctgggcttgtccacccagaactggtgtgcaaagtgcaacctgtcctttcgcctaacgtccgacctggtctttcacatgcgatcccaccacaaaaaggagcatgcggggcctgacccacattctcagaagcggagagaagaggcccttgcctgccctgtgtgccaggagcacttccgggagcgccaccacctctcccggcacatgacttctcacagctagcaggtgaccgcagaatgacctgctgggtgcagcagccagcctttggcagaggggggctccctgggcctgcgttgagggggctgtcatggtcctttgcagagctgctgcttttggcattcatagataaacagctcaggcataatttgaaaaagccacacctgcatgatgtgttttgaaggaaatgaagtcctgaaataaagtgatgggctttgcaaatccagggtagaggccctaacaggcacagagagcaggggcaactcctggcacacatcatgggctttggaggcacacaagcctggattcgaatctgggctctttcacatactagctgtgaccctggacaaagagctttaacctgctgagtccccattttctcatctgtgaaatggagatgataacactgtgtcttaggttggcattcaggtcacatgaaaggtgtgtggaaagtggccagcattctgcctgcagaccctgagcactgagtcaacaaggtttgtgatgatgtctgtactagttagctattgttattaacaagatctccatggcagacaagctaaagcatctgcctaagtcgtgagtctgtgggttggctcaggttaagctgagcttggctgggcttggcagcaagtctcagatttgatcaagtcatattcgttttcttcttcggctggtgggctacccagagcgagcacgcttctctcgtggtcatgccaagaacacaggagggtgagtctaacaagcacacctcaagcctctgcttgggtcacattgccaatgtcctctcagcccatacaagtggcaggaccaggcccaatattaaggagtggaaaagtgtaggctgcccttggtgaagctgtgacaagggagtgaccatccatcccctccacaggagggtgaggaattgggacaggtaattccagccaatacctggtccatagttcttcacattgtgagtatatgaatacggggaaatagaaccccctccccaccacctacacacatgctgttttaccttccaagaataggacatgtgcaaaaactaggcttccagatcgtgaggctggggagcattctaggtaccatttattatctactgcgtttcggtcagtagctgttgtaggtacccgcatcagcccttgttcctaaggatgtgtggagcccaggctgtactctttgacattccacaggtcagtctgcgtgaaagccctttgtggggagtttccaagccagtgtcgtttttgcactggtttccacctcactgtcagatattgttcttttgatatgcagtttccagccctccaatgagtccccagcacagatctcaggcttgtggctgggaataagcccagctgagcaggtggggatctcagccagcctcccagactgcacctcttctattgctctcctctgtccaccgttccaggcagcagcactcccacctggctgctctgatgtcctcgctccctccattcctgcctctcaccatgcacgcatccattgtccacacacacacaaccagataatcttctgaaagtgtaactcagatgatgcctccaaccctgtggctgcccttcacacttacaggcctaaccccagcaggacctgccagctgcttcatgaacaagtccctgcctcatgttaattgcaagcactcatttcactctccctgtgtgccaggcaatagcataagcactggaagaatacagatgttatagtgagtcctacaatagccctggaaggcaagagctgtttcctttccatttctacaatgagtcaattgcagatgatgctataacacttccagtgtttctgacacttccctgaagctatacctgctaccttcatgggccgagcttgcccttatgaggcccacaggtggcagtgggcagaggggaccccgctataccacctcgctgctgttccactgtctgctcccgtgttctgaccacagctctggtgccgtttctcaagcctgggcttcattcaacattttctatctagctcttcatggtgctgctcctgctatggttccacagggcttcttctcgcaggtcagctccttagagaggtctcccagattccccgtaaagcagccctgcagcctctgcctctctcagccgcatcaccctgttgcttccttcacagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaataa

SEQ ID NO: 460819 - DNA, 3437 bp, Homo sapiens
tgctggtactgccccgggattaacgggcagcgcagtgctcttggccgggaggaggctgtgctgcaccagcacctcttgctccacatctccagagagcccagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagagcgccttcacggagctgccgaggatgaaggaccggcaggtggatgctcaggcccaggagagggagcacgatgaccccacaggccaacctggtgccccacagctgacccagaacatccccagaggcccagctggcagcaaagtcttctctgtgtggcccagcggagcacgaagtgagcaaagaagcgcctttagcaaaccaaccaagcgaccagcagagaggcctgagctaacctcagtcttccctgcaggggaatctgcagatgccctgggggagctgtctggactcctcaacactacagacctcgcttgttggggtcgactttcaactcccaagcttttggttggtgatttgtggaacttgcaagcattgccacagaatgctccactctgtagcacttttctgggtgcccctacactgtggctggagcatacccaggcccaggtgcccccaccctcatcatcctccaccacttcgtgggccctcctgccacccaccctcacctccctgggcttgtccacccagaactggtgtgcaaagtgcaacctgtcctttcgcctaacgtccgacctggtctttcacatgcgatcccaccacaaaaaggagcatgcggggcctgacccacattctcagaagcggagagaagaggcccttgcctgccctgtgtgccaggagcacttccgggagcgccaccacctctcccggcacatgacttctcacagctagcaggtgaccgcagaatgacctgctgggtgcagcagccagcctttggcagaggggggctccctgggcctgcgttgagggggctgtcatggtcctttgcagagctgctgcttttggcattcatagataaacagctcaggcataatttgaaaaagccacacctgcatgatgtgttttgaaggaaatgaagtcctgaaataaagtgatgggctttgcaaatccagggtagaggccctaacaggcacagagagcaggggcaactcctggcacacatcatgggctttggaggcacacaagcctggattcgaatctgggctctttcacatactagctgtgaccctggacaaagagctttaacctgctgagtccccattttctcatctgtgaaatggagatgataacactgtgtcttaggttggcattcaggtcacatgaaaggtgtgtggaaagtggccagcattctgcctgcagaccctgagcactgagtcaacaaggtttgtgatgatgtctgtactagttagctattgttattaacaagatctccatggcagacaagctaaagcatctgcctaagtcgtgagtctgtgggttggctcaggttaagctgagcttggctgggcttggcagcaagtctcagatttgatcaagtcatattcgttttcttcttcggctggtgggctacccagagcgagcacgcttctctcgtggtcatgccaagaacacaggagggtgagtctaacaagcacacctcaagcctctgcttgggtcacattgccaatgtcctctcagcccatacaagtggcaggaccaggcccaatattaaggagtggaaaagtgtaggctgcccttggtgaagctgtgacaagggagtgaccatccatcccctccacaggagggtgaggaattgggacaggtaattccagccaatacctggtccatagttcttcacattgtgagtatatgaatacggggaaatagaaccccctccccaccacctacacacatgctgttttaccttccaagaataggacatgtgcaaaaactaggcttccagatcgtgaggctggggagcattctaggtaccatttattatctactgcgtttcggtcagtagctgttgtaggtacccgcatcagcccttgttcctaaggatgtgtggagcccaggctgtactctttgacattccacaggtcagtctgcgtgaaagccctttgtggggagtttccaagccagtgtcgtttttgcactggtttccacctcactgtcagatattgttcttttgatatgcagtttccagccctccaatgagtccccagcacagatctcaggcttgtggctgggaataagcccagctgagcaggtggggatctcagccagcctcccagactgcacctcttctattgctctcctctgtccaccgttccaggcagcagcactcccacctggctgctctgatgtcctcgctccctccattcctgcctctcaccatgcacgcatccattgtccacacacacacaaccagataatcttctgaaagtgtaactcagatgatgcctccaaccctgtggctgcccttcacacttacaggcctaaccccagcaggacctgccagctgcttcatgaacaagtccctgcctcatgttaattgcaagcactcatttcactctccctgtgtgccaggcaatagcataagcactggaagaatacagatgttatagtgagtcctacaatagccctggaaggcaagagctgtttcctttccatttctacaatgagtcaattgcagatgatgctataacacttccagtgtttctgacacttccctgaagctatacctgctaccttcatgggccgagcttgcccttatgaggcccacaggtggcagtgggcagaggggaccccgctataccacctcgctgctgttccactgtctgctcccgtgttctgaccacagctctggtgccgtttctcaagcctgggcttcattcaacattttctatctagctcttcatggtgctgctcctgctatggttccacagggcttcttctcgcaggtcagctccttagagaggtctcccagattccccgtaaagcagccctgcagcctctgcctctctcagccgcatcaccctgttgcttccttcacagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaataa

SEQ ID NO: 460820 - DNA, 3578 bp, Homo sapiens
tgctggtactgccccgggattaacgggcagcgcagtgctcttggccgggaggaggctgtgctgcaccagcacctcttgctccacatctccagagagcccagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagggcgggccgggatgtgggcagtgcggagctggcactgttggtagccccaggcaagccccgacctggcaagccgctgcccccgaagacacgtggagagcagaggcagagcgccttcacggagctgccgaggatgaaggaccggcaggtggatgctcaggcccaggagagggagcacgatgaccccacaggccaacctggtgccccacagctgacccagaacatccccagaggcccagctggcagcaaagtcttctctgtgtggcccagcggagcacgaagtgagcaaagaagcgcctttagcaaaccaaccaagcgaccagcagagaggcctgagctaacctcagtcttccctgcaggggaatctgcagatgccctgggggagctgtctggactcctcaacactacagacctcgcttgttggggtcgactttcaactcccaagcttttggttggtgatttgtggaacttgcaagcattgccacagaatgctccactctgtagcacttttctgggtgcccctacactgtggctggagcatacccaggcccaggtgcccccaccctcatcatcctccaccacttcgtgggccctcctgccacccaccctcacctccctgggcttgtccacccagaactggtgtgcaaagtgcaacctgtcctttcgcctaacgtccgacctggtctttcacatgcgatcccaccacaaaaaggagcatgcggggcctgacccacattctcagaagcggagagaagaggcccttgcctgccctgtgtgccaggagcacttccgggagcgccaccacctctcccggcacatgacttctcacagctagcaggtgaccgcagaatgacctgctgggtgcagcagccagcctttggcagaggggggctccctgggcctgcgttgagggggctgtcatggtcctttgcagagctgctgcttttggcattcatagataaacagctcaggcataatttgaaaaagccacacctgcatgatgtgttttgaaggaaatgaagtcctgaaataaagtgatgggctttgcaaatccagggtagaggccctaacaggcacagagagcaggggcaactcctggcacacatcatgggctttggaggcacacaagcctggattcgaatctgggctctttcacatactagctgtgaccctggacaaagagctttaacctgctgagtccccattttctcatctgtgaaatggagatgataacactgtgtcttaggttggcattcaggtcacatgaaaggtgtgtggaaagtggccagcattctgcctgcagaccctgagcactgagtcaacaaggtttgtgatgatgtctgtactagttagctattgttattaacaagatctccatggcagacaagctaaagcatctgcctaagtcgtgagtctgtgggttggctcaggttaagctgagcttggctgggcttggcagcaagtctcagatttgatcaagtcatattcgttttcttcttcggctggtgggctacccagagcgagcacgcttctctcgtggtcatgccaagaacacaggagggtgagtctaacaagcacacctcaagcctctgcttgggtcacattgccaatgtcctctcagcccatacaagtggcaggaccaggcccaatattaaggagtggaaaagtgtaggctgcccttggtgaagctgtgacaagggagtgaccatccatcccctccacaggagggtgaggaattgggacaggtaattccagccaatacctggtccatagttcttcacattgtgagtatatgaatacggggaaatagaaccccctccccaccacctacacacatgctgttttaccttccaagaataggacatgtgcaaaaactaggcttccagatcgtgaggctggggagcattctaggtaccatttattatctactgcgtttcggtcagtagctgttgtaggtacccgcatcagcccttgttcctaaggatgtgtggagcccaggctgtactctttgacattccacaggtcagtctgcgtgaaagccctttgtggggagtttccaagccagtgtcgtttttgcactggtttccacctcactgtcagatattgttcttttgatatgcagtttccagccctccaatgagtccccagcacagatctcaggcttgtggctgggaataagcccagctgagcaggtggggatctcagccagcctcccagactgcacctcttctattgctctcctctgtccaccgttccaggcagcagcactcccacctggctgctctgatgtcctcgctccctccattcctgcctctcaccatgcacgcatccattgtccacacacacacaaccagataatcttctgaaagtgtaactcagatgatgcctccaaccctgtggctgcccttcacacttacaggcctaaccccagcaggacctgccagctgcttcatgaacaagtccctgcctcatgttaattgcaagcactcatttcactctccctgtgtgccaggcaatagcataagcactggaagaatacagatgttatagtgagtcctacaatagccctggaaggcaagagctgtttcctttccatttctacaatgagtcaattgcagatgatgctataacacttccagtgtttctgacacttccctgaagctatacctgctaccttcatgggccgagcttgcccttatgaggcccacaggtggcagtgggcagaggggaccccgctataccacctcgctgctgttccactgtctgctcccgtgttctgaccacagctctggtgccgtttctcaagcctgggcttcattcaacattttctatctagctcttcatggtgctgctcctgctatggttccacagggcttcttctcgcaggtcagctccttagagaggtctcccagattccccgtaaagcagccctgcagcctctgcctctctcagccgcatcaccctgttgcttccttcacagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaataaacaagcacactaggaacagaagccagacaacaaaa

SEQ ID NO: 460821 - DNA, 5176 bp, Homo sapiens
gtgtttgacaccatattaatctcaggtccctcttctgcagttctgctgcagtttgctgtggttcccctccagaccccgtttgcctgggtatcaccagcagaggctgcagaacagcgaagattgctgcctgctccttcctctggaagcttcatcccagaggggcacccgccacatgccagccagagctctccagtatgaggtgtctgtcaacccctgctaggagcccctgactggggctgcagcctttctttcagagatgtcttgcccagagaggaggaatctagagaggcagtctggctaccgtggctttgcggtgctgtgatgggctccacccagtttgagcttcctggaggctttttttactctgtgaggggaaaaccgcctactcaagcctcaataatggtggacaccccttcccacaccaagctcaagtgtcccaggttgacttcagtctgctgtgctggcagcaagaatttcaagccagtggatgttagcctgctgggctccatgggggagacacaatgtaattgtaaacatccatctagacactgggaaaattttccctctgggaaagaacttaaattgtttctctttgtctttgttgcagaacccatcttttacttcggtgatgtggaatactctgtggatgagagtgctggctatgtggaagtgcaggtgtggagaacgggcactgacctgtccaagtcttctagtgtcacagtgaggtctcggaaaacagatcctccctctgcagatgctggaacagactatgtgggcatcagccgtaatttagattttgcacctggagtcaacatgcagcctgttcgtgttgtcattctggatgaccttggacaaccagcgctggagggaattgagaaatttgaactggtgcttcgcatgcctatgaacgcagcccttggcgagcccagcaaagccacagtgtccataaatgactctgtctccgatttgcctaagatgcaattcaaagaacgaatatatactggcagcgaaagtgatgggcagatagttacaatgatccataggactggggatgtccagtacagatcttcagtgagatgctacacccggcaggggtctgcacaggtgatgatggactttgaagaacgcccaaacactgatacctccatcatcacattcctccctggtgagacagaaaagccctgcattcttgagctgatggacgatgtgctctatgaggaggtagaggagctccgcctggtactcggcactccacaaagcaactctccctttggggctgcagttggtgaacaaaatgaaactctcataaggatccgagatgatgctgataagactgttattaaatttggagaaaccaaatttagtgtcactgaacccaaagaacctggagagtcggtggttataagaattccagtgattcgccaaggagacacttcaaaggtttccattgtgagagtccacaccaaggatggctcggccacctctggagaagactaccaccctgtgtcagaagaaattgagtttaaggaaggggaaacccagcacgtggttgaaatcgaagttacctttgacggggtgagagagatgagagaggccttcactgttcacctaaaacctgatgaaaatatgatagcagagatgcagttgacgaaagccattgtgtacatagaagaaatgagcagcatggcagatgtcacttttccttctgtccctcaaattgtatccctgttgatgtatgacgacacttccaaagctaaggagagtgctgaacccatgtctggctatcctgtcatctgtatcacagcttgcaaccccaaatattcagactacgataaaacaggctctatctgtgcaagtgagaacatcaatgacactttgacgcggtaccggtggctgattagtgcacctgcgggccctgacggtgtgaccagccctatgagagaagtggacttcgacaccttttttacgtcatccaagatggtcacactggactccatatactttcagcctggctcccgggtacagtgcgcagctcgtgctgtgaacaccaatggggatgaaggcctggagctcatgagccctattgtaaccatcagcagagaagaaggtctttgtcagccccgtgtacctggggttgttggagcagagccgttctcagctaaattgcgctacacaggccctgaggatgcagactacacaaaccttatcaagctcactgtcacaatgccacacatagatggcatgctccccgtgatctccactagagagctttccaactttgagctcaccctcagccctgatggcacaagagttggaaaccacaagtgctccaacctcctggattatactgaagtgaagactcattatggtttcttgactgatgctaccaaaaatccagaaataattggagagacatatccttaccagtacagcttgtccatcagaggttccactaccttgcgcttctaccggaacctgaacctagaggcctgtttatgggagttcgttagctactatgacatgtcagaactccttgctgactgtggtggcaccattggaacagatggacaggtcctaaacctagtgcagtcctatgtgacccttcgagtccctctgtatgtttcctacgtgttccattcccccgtgggggtaggaggctggcagcattttgacttgaagtcagagcttcgtctaacttttgtgtacgacaccgccatcttgtggaatgatggaattggcagccccccagaggctgaacttcaaggttctctctatccaaccagcatgcgcatcggtgatgaggggcgcttggccgtgcacttcaagacagaggctcagttccatggcttatttgtgctgtcacatcccgcatcctttacaagctcagtgatcatgtcagctgatcatccaggcctgacattttccctccgcctcataaggagtgaaccaacctataaccagccagtacagcagtggagctttgtctctgactttgccgtacgtgactactcagggacctatactgtgaagctggtgccatgcactgccccatcacatcaggaataccgcctgccagtcacctgcaaccccagagaacctgtcacctttgaccttgacatccgattccaacaggtcagtgatccagtggctgctgagtttagcttgaacacccaaatgtacctgctctctaagaagagtctctggttgtctgatggatccatgggattcgggcaagagagtgatgttgcttttgcagaaggtgatataatttatggtcgtgtcatggtggatcctgtccagaatctgggtgactccttttactgcagcattgagaaggtgtttctatgcactggagctgatggctatgttcccaagtatagtccaatgaatgcagaatatggctgcttagccgactctccttcactcttatatagatttaaaattgtggacaaagctcagccagagacacaagcgaccagttttggaaatgtcctatttaatgccaaactagcagtggatgaccctgaagccattctcttagtgaatcagcctggatctgatggatttaaagtcgactcaacaccactctttcagaaaccaagatacaaattcctgactcagggatcaaaggtggagggaaacacaggcagctgccacaacactgagcaaatgccacaaatttcaagaggtgcttacactgcaaatctctgccgaagcaaatcgaaagacaatgccaatcgaggtattggcaaaagaagtgtggagtaccattctctggtgagtcaaggaaagccccaatccaccaccaagagccggaagaagagagagatcaggagcacaccctcactggcatgggagattggtgctgaaaacagtcgaggaacaaacatccagcacattgccctggaccgcaccaagaggcagatcccccatgggagagcacctccagatggcatcctcccctgggagctcaacagccccagctctgcagtcagcctggtcactgtggtgggaggcaccacggtagggttactcaccatctgcctcactgtcattgcagtgctgatgtgcaggggcaaggaaagtttcagggggaaggatgccccgaaaggctccagcagcagtgagcccatggtgcccccacagagccatcacaatgacagctcagaagtttgatgactgcaggtagaattcaaccttttccatgctggctagaatcccctttgacttctagccataagctggccacattggacatcttggtcactgcagaattttaaaaggcaaacttctcagaacagatgtgcacatcttaatttggtgtctggtctagttttatcatacatttactaagttactacatattggtggatattgacgtttattcctgggaatctaattttgcaaacaatttggagccattcagtcataaattcatgtcaacaataagtcttgctgccgcttgtgtttcataactacgcttgctttccttcaaaatataccaagtgtgtaatataaataaagcccatatcaatataaatgttcaaatggccaagttattctggtgcattctgtaacttaattttttatgctaaaatcacagattcccataggctacaatgaatgtcagttattttctttctggttctggagccttaaacttagttctctggactgggacctgtgcttccactgccactcatactgatggtaaaactttgcctctccccagtagaatccacctgcagggtcctggcatctgcccactagttataaagagtgtagccagaggctcatcagaggcaaatgtgtattttaaggaaacaacatatttggactaactaattctttgtcccaggaagcagtgtgactagactttgctatagttaggaactcctgcccagtgcactgatgaggatgaattaactaatctggtctttactgccaatgtagtctggtcacctcagttaatgatcaattgatttgttataaggtcagatttttaacatgaggccaccactgtttaataccaaaaggaaatgcaaagacatcttgtttaagacattgaagaatatcccaagaaaaggacaaaatacaaaaaagaaggtgaagtggaagaaaaataattgctatgtcaaagatcttctagcactttcaagactggggagagaaaaac

SEQ ID NO: 460822 - DNA, 2986 bp, Homo sapiens
aacggggggccgttaacgctcggggatgacaggtgccacaggtagactggcatgctccccgtgatctccactagagagctttccaactttgagctcaccctcagccctgatggcacaagagttggaaaccacaagtgctccaacctcctggattatactgaagtgaagactcattatggtttcttgactgatgctaccaaaaatccagaaataattggagagacatatccttaccagtacagcttgtccatcagaggttccactaccttgcgcttctaccggaacctgaacctagaggcctgtttatgggagttcgttagctactatgacatgtcagaactccttgctgactgtggtggcaccattggaacagatggacaggtcctaaacctagtgcagtcctatgtgacccttcgagtccctctgtatgtttcctacgtgttccattcccccgtgggggtaggaggctggcagcattttgacttgaagtcagagcttcgtctaacttttgtgtacgacaccgccatcttgtggaatgatggaattggcagccccccagaggctgaacttcaaggttctctctatccaaccagcatgcgcatcggtgatgaggggcgcttggccgtgcacttcaagacagaggctcagttccatggcttatttgtgctgtcacatcccgcatcctttacaagctcagtgatcatgtcagctgatcatccaggcctgacattttccctccgcctcataaggagtgaaccaacctataaccagccagtacagcagtggagctttgtctctgactttgccgtacgtgactactcagggacctatactgtgaagctggtgccatgcactgccccatcacatcaggaataccgcctgccagtcacctgcaaccccagagaacctgtcacctttgaccttgacatccgattccaacaggtcagtgatccagtggctgctgagtttagcttgaacacccaaatgtacctgctctctaagaagagtctctggttgtctgatggatccatgggattcgggcaagagagtgatgttgcttttgcagaaggtgatataatttatggtcgtgtcatggtggatcctgtccagaatctgggtgactccttttactgcagcattgagaaggtgtttctatgcactggagctgatggctatgttcccaagtatagtccaatgaatgcagaatatggctgcttagccgactctccttcactcttatatagatttaaaattgtggacaaagctcagccagagacacaagcgaccagttttggaaatgtcctatttaatgccaaactagcagtggatgaccctgaagccattctcttagtgaatcagcctggatctgatggatttaaagtcgactcaacaccactctttcagaaaccaagatacaaattcctgactcagggatcaaaggtggagggaaacacaggcagctgccacaacactgagcaaatgccacaaatttcaagaggtgcttacactgcaaatctctgccgaagcaaatcgaaagacaatgccaatcgaggtattggcaaaagaagtgtggagtaccattctctggtgagtcaaggaaagccccaatccaccaccaagagccggaagaagagagagatcaggagcacaccctcactggcatgggagattggtgctgaaaacagtcgaggaacaaacatccagcacattgccctggaccgcaccaagaggcagatcccccatgggagagcacctccagatggcatcctcccctgggagctcaacagccccagctctgcagtcagcctggtcactgtggtgggaggcaccacggtagggttactcaccatctgcctcactgtcattgcagtgctgatgtgcaggggcaaggaaagtttcagggggaaggatgccccgaaaggctccagcagcagtgagcccatggtgcccccacagagccatcacaatgacagctcagaagtttgatgactgcaggtagaattcaaccttttccatgctggctagaatcccctttgacttctagccataagctggccacattggacatcttggtcactgcagaattttaaaaggcaaacttctcagaacagatgtgcacatcttaatttggtgtctggtctagttttatcatacatttactaagttactacatattggtggatattgacgtttattcctgggaatctaattttgcaaacaatttggagccattcagtcataaattcatgtcaacaataagtcttgctgccgcttgtgtttcataactacgcttgctttccttcaaaatataccaagtgtgtaatataaataaagcccatatcaatataaatgttcaaatggccaagttattctggtgcattctgtaacttaattttttatgctaaaatcacagattcccataggctacaatgaatgtcagttattttctttctggttctggagccttaaacttagttctctggactgggacctgtgcttccactgccactcatactgatggtaaaactttgcctctccccagtagaatccacctgcagggtcctggcatctgcccactagttataaagagtgtagccagaggctcatcagaggcaaatgtgtattttaaggaaacaacatatttggactaactaattctttgtcccaggaagcagtgtgactagactttgctatagttaggaactcctgcccagtgcactgatgaggatgaattaactaatctggtctttactgccaatgtagtctggtcacctcagttaatgatcaattgatttgttataaggtcagatttttaacatgaggccaccactgtttaataccaaaaggaaatgcaaagacatcttgtttaagacattgaagaatatcccaagaaaaggacaaaatacaaaaaagaaggtgaagtggaagaaaaataattgctatgtcaaagatcttctagcactttcaagactggggagagaaaaac

SEQ ID NO: 460823 - DNA, 1881 bp, Homo sapiens
gccggcaaggcagtgattaagtgtgatgacaactaccaatttagtgaagggccatctgctgccaccaagccagggcactgggcctagagagctacatgtgggtcgtaatgagccatctggctgcctggcagaaggcatccatgggcaggtgtctgagacgctactgacattaccactgacctttgccaagaagcaggtttggttttatccagaatggcccagcgtggtgagccacgattcaattcacatagtcatctctagaggcaaagctctggtaaagggcttgatgactggtcactgtcgtcacgaacttgacctttcctgcagcactgcctggtactttcccagtacagtgttctgccctgacacagccaaggccaagggcagtgcaggcacagccaccgtgactctctgctgggaggttaacagctccatcagttcagggactgcctgacccagcctgaccaaattagagcaagtaatgggtgtgacataatttgacatgtacattgttaattgaacccaatgggagatgattttaaatagaggcgaataccacgctgtgaactatttgggttatgaagctcttattctcttatccttgcaggagaaagaattgtgccatgaaaaatggaaaactcctgagaagctgttccagcgtcaggagagcagcagacaagctggactggggaagattcttcctgcaagacctgcagagtgtatgacacataaccagcacccaagaaatgtctaccgaggaattaatgaatgagggtcccatacttcctagccatgctgttggcagggattaacatcattgcaattctctgggtagaccttgggaggtttaaaccaaccagtgacccctatcatcctagctccagagattggcttagggatagtcacccaatgcaggccaatgcaaggtgactttgccaggggcttctgggaaagaagtttcctttctctgaggaaatgtgaatgaggacatccataactcaggttgtgtctggcagccatcttgtgatcatctggcaagacagcccaagaataaagccgtcaccatggagactaagaagagacagaaagacactgggtcttcattgtctcgtccagctgttcatgaggccttatctgaagcccacgtgacctccggactactcacttacatgagagaataaagctcttttttgtttagaccaaataaatacataatacaattacataatcccttgattcctttttatgactgagctcagagactatattttgtcattttaaatcacctttgtcttacagtttatttaactgaaacaaataaacaaaccaaaacacgccagtttttcactcctctgtcaaagcctttccaagatcactaagcttgtgatgtcctgggtgaatgaagaagtaacagtgttttcaacaacatagaagcttatttctctctcatataaaagaaggctggagtctggctggtatgggagatacagcatcatcaaagttttatcttttcgtcctgccatccttagaatatggctttcatcttcaagatcacttcctaagctatgaggatgcaaaggtataagaatgacatagcggactttggggactcggtgtggggagaagttgggaggggtgagggataagagactacatattgggtacagtgtacactgctctaaaatctcagaaatcaccaccaaagaacctatccgtggaatcaaaaaccacctatacccccaaaaccactgaaataaaactaaaaattaattaaaaaaaaaaacaacataacttcatggtccaatgtgacagctagagcgccaatcatcatgttaaacttcctgttccagaaaggcatggaaggaagggagaaggagaaaa

SEQ ID NO: 460824 - DNA, 1463 bp, Homo sapiens
  misc_feature (88)..(88): n is a, c, g, or t
  misc_feature (173)..(173): n is a, c, g, or t
tgcgcgagcccaggtacgtagagtgatagatggtacatagctcgcgttgcattactgcatgactcgcgtgagtgctttaacatgacgncgcattcgagattccatcggacccagtcatgaaacacgaccccgtggggcaaaatcgaagaggctaacgtagaacaaaaatctgnagatgagtgaatacatagggggatcaattcactggagaacatatctaaccaggcagtccgagaacagaccgtcggaacatcgacatagttactggccgcaagcatgcttcctgcaagacctgcagagtgtatgacacataaccagcacccaagaaatgtctaccgaggaattaatgaatgagggtcccatacttcctagccatgctgttggcagggattaacatcattgcaattctctgggtagaccttgggaggtttaaaccaaccagtgacccctatcatcctagctccagagattggcttagggatagtcacccaatgcaggccaatgcaaggtgactttgccaggggcttctgggaaagaagtttcctttctctgaggaaatgtgaatgaggacatccataactcaggttgtgtctggcagccatcttgtgatcatctggcaagacagcccaagaataaagccgtcaccatggagactaagaagagacagaaagacactgggtcttcattgtctcgtccagctgttcatgaggccttatctgaagcccacgtgacctccggactactcacttacatgagagaataaagctcttttttgtttagaccaaataaatacataatacaattacataatcccttgattcctttttatgactgagctcagagactatattttgtcattttaaatcacctttgtcttacagtttatttaactgaaacaaataaacaaaccaaaacacgccagtttttcactcctctgtcaaagcctttccaagatcactaagcttgtgatgtcctgggtgaatgaagaagtaacagtgttttcaacaacatagaagcttatttctctctcatataaaagaaggctggagtctggctggtatgggagatacagcatcatcaaagttttatcttttcgtcctgccatccttagaatatggctttcatcttcaagatcacttcctaagctatgaggatgcaaaggtataagaatgacatagcggactttggggactcggtgtggggagaagttgggaggggtgagggataagagactacatattgggtacagtgtacactgctctaaaatctcagaaatcaccaccaaagaacctatccgtggaatcaaaaaccacctatacccccaaaaccactgaaataaaactaaaaattaattaaaaaaaaaaacaacataacttcatggtccaatgtgacagctagagcgccaatcatcatgttaaacttcctgttccagaaaggcatggaaggaagggagaaggagaaaa

SEQ ID NO: 460825 - DNA, 1160 bp, Homo sapiens
gccggcaaggcagtgattaagtgtgatgacaactaccaatttagtgaagggccatctgctgccaccaagccagggcactgggcctagagagctacatgtgggtcgtaatgagccatctggctgcctggcagaaggcatccatgggcaggtgtctgagacgctactgacattaccactgacctttgccaagaagcaggtttggttttatccagaatggcccagcgtggtgagccacgattcaattcacatagtcatctctagaggcaaagctctggtaaagggcttgatgactggtcactgtcgtcacgaacttgacctttcctgcagcactgcctggtactttcccagtacagtgttctgccctgacacagccaaggccaagggcagtgcaggcacagccaccgtgactctctgctgggaggttaacagctccatcagttcagggactgcctgacccagcctgaccaaattagagcaagtaatgggtgtgacataatttgacatgtacattgttaattgaacccaatgggagatgattttaaatagaggcgaataccacgctgtgaactatttgggttatgaagctcttattctcttatccttgcaggagaaagaattgtgccatgaaaaatggaaaactcctgagaagctgttccagcgtcaggagagcagcagacaagctggactggggaagattcttcctgcaagacctgcagagtgtatgacacataaccagcacccaagaaatgtctaccgaggaattaatgaatgagccatcttgtgatcatctggcaagacagcccaagaataaagccgtcaccatggagactaagaagagacagaaagacactgggtcttcattgtctcgtccagctgttcatgaggccttatctgaagcccacgtgacctccggactactcacttacatgagagaataaagctcttttttgtttagaccaaataaatacataatacaaaaaaaaaaaaaaaaaaattttgtgggggcttgggcccgggaaaagtttcaacacttgtggggggggggcccaggttatggaactggcaaggggtcccaggaaacgggtcgaatggggggtttcacaaaaaaggcggggaacgggttggaaaccaggggttggggttgggttaaagggccggca

SEQ ID NO: 460826 - DNA, 1069 bp, Homo sapiens
tgaacccgcagagagggcctgggagcacaatgctgagcgagaaagaattgtgccatgaaaaatggaaaactcctgagaagctgttccagcgtcaggagagcagcagacaagctggactggggaagattcttcctgcaagacctgcagagtgtatgacacataaccagcacccaagaaatgtctaccgaggaattaatgaatgagccatcttgtgatcatctggcaagacagcccaagaataaagccgtcaccatggagactaagaagagacagaaagacactgggtcttcattgtctcgtccagctgttcatgaggccttatctgaagcccacgtgacctccggactactcacttacatgagagaataaagctcttttttgtttagaccaaataaatacataatacaattacataatcccttgattcctttttatgactgagctcagagactatattttgtcattttaaatcacctttgtcttacagtttatttaactgaaacaaataaacaaaccaaaacacgccagtttttcactcctctgtcaaagcctttccaagatcactaagcttgtgatgtcctgggtgaatgaagaagtaacagtgttttcaacaacatagaagcttatttctctctcatataaaagaaggctggagtctggctggtatgggagatacagcatcatcaaagttttatcttttcgtcctgccatccttagaatatggctttcatcttcaagatcacttcctaagctatgaggatgcaaaggtataagaatgacatagcggactttggggactcggtgtggggagaagttgggaggggtgagggataagagactacatattgggtacagtgtacactgctctaaaatctcagaaatcaccaccaaagaacctatccgtggaatcaaaaaccacctatacccccaaaaccactgaaataaaactaaaaattaattaaaaaaaaaaacaacataacttcatggtccaatgtgacagctagagcgccaatcatcatgttaaacttcctgttccagaaaggcatggaaggaagggagaaggagaaaa

SEQ ID NO: 460827 - DNA, 1638 bp, Homo sapiens
gccggcaaggcagtgattaagtgtgatgacaactaccaatttagtgaagggccatctgctgccaccaagccagggcactgggcctagagagctacatgtgggtcgtaatgagccatctggctgcctggcagaaggcatccatgggcaggtgtctgagacgctactgacattaccactgacctttgccaagaagcaggtttggttttatccagaatggcccagcgtggtgagccacgattcaattcacatagtcatctctagaggcaaagctctggtaaagggcttgatgactggtcactgtcgtcacgaacttgacctttcctgcagcactgcctggtactttcccagtacagtgttctgccctgacacagccaaggccaagggcagtgcaggcacagccaccgtgactctctgctgggaggttaacagctccatcagttcagggactgcctgacccagcctgaccaaattagagcaagtaatgggtgtgacataatttgacatgtacattgttaattgaacccaatgggagatgattttaaatagaggcgaataccacgctgtgaactatttgggttatgaagctcttattctcttatccttgcaggagaaagaattgtgccatgaaaaatggaaaactcctgagaagctgttccagcgtcaggagagcagcagacaagctggactggggaagattcttcctgcaagacctgcagagtgtatgacacataaccagcacccaagaaatgtctaccgaggaattaatgaatgagccatcttgtgatcatctggcaagacagcccaagaataaagccgtcaccatggagactaagaagagacagaaagacactgggtcttcattgtctcgtccagctgttcatgaggccttatctgaagcccacgtgacctccggactactcacttacatgagagaataaagctcttttttgtttagaccaaataaatacataatacaattacataatcccttgattcctttttatgactgagctcagagactatattttgtcattttaaatcacctttgtcttacagtttatttaactgaaacaaataaacaaaccaaaacacgccagtttttcactcctctgtcaaagcctttccaagatcactaagcttgtgatgtcctgggtgaatgaagaagtaacagtgttttcaacaacatagaagcttatttctctctcatataaaagaaggctggagtctggctggtatgggagatacagcatcatcaaagttttatcttttcgtcctgccatccttagaatatggctttcatcttcaagatcacttcctaagctatgaggatgcaaaggtataagaatgacatagcggactttggggactcggtgtggggagaagttgggaggggtgagggataagagactacatattgggtacagtgtacactgctctaaaatctcagaaatcaccaccaaagaacctatccgtggaatcaaaaaccacctatacccccaaaaccactgaaataaaactaaaaattaattaaaaaaaaaaacaacataacttcatggtccaatgtgacagctagagcgccaatcatcatgttaaacttcctgttccagaaaggcatggaaggaagggagaaggagaaaa

SEQ ID NO: 460828 - DNA, 1535 bp, Homo sapiens
gccggcaaggcagtgattaagtgtgatgacaactaccaatttagtgaagggccatctgctgccaccaagccagggcactgggcctagagagctacatgtgggtcgtaatgagccatctggctgcctggcagaaggcatccatgggcaggtgtctgagacgctactgacattaccactgacctttgccaagaagcaggtttggttttatccagaatggcccagcgtggtgagccacgattcaattcacatagtcatctctagaggcaaagctctggtaaagggcttgatgactggtcactgtcgtcacgaacttgacctttcctgcagcactgcctggtactttcccagtacagtgttctgccctgacacagccaaggccaagggcagtgcaggcacagccaccgtgactctctgctgggaggttaacagctccatcagttcagggactgcctgacccagcctgaccaaattagagcaagtaatgggtgtgacataatttgacatgagaaagaattgtgccatgaaaaatggaaaactcctgagaagctgttccagcgtcaggagagcagcagacaagctggactggggaagattcttcctgcaagacctgcagagtgtatgacacataaccagcacccaagaaatgtctaccgaggaattaatgaatgagccatcttgtgatcatctggcaagacagcccaagaataaagccgtcaccatggagactaagaagagacagaaagacactgggtcttcattgtctcgtccagctgttcatgaggccttatctgaagcccacgtgacctccggactactcacttacatgagagaataaagctcttttttgtttagaccaaataaatacataatacaattacataatcccttgattcctttttatgactgagctcagagactatattttgtcattttaaatcacctttgtcttacagtttatttaactgaaacaaataaacaaaccaaaacacgccagtttttcactcctctgtcaaagcctttccaagatcactaagcttgtgatgtcctgggtgaatgaagaagtaacagtgttttcaacaacatagaagcttatttctctctcatataaaagaaggctggagtctggctggtatgggagatacagcatcatcaaagttttatcttttcgtcctgccatccttagaatatggctttcatcttcaagatcacttcctaagctatgaggatgcaaaggtataagaatgacatagcggactttggggactcggtgtggggagaagttgggaggggtgagggataagagactacatattgggtacagtgtacactgctctaaaatctcagaaatcaccaccaaagaacctatccgtggaatcaaaaaccacctatacccccaaaaccactgaaataaaactaaaaattaattaaaaaaaaaaacaacataacttcatggtccaatgtgacagctagagcgccaatcatcatgttaaacttcctgttccagaaaggcatggaaggaagggagaaggagaaaa

SEQ ID NO: 460829 - DNA, 3687 bp, Homo sapiens
agcaagcagcccagtccctgcccttgccaatcaccccagggtgactttgggcaggtgactcctggggctccctgctccataatcagccctcacctcctgccaccccaagcccaacctccctgggctctttgggcttgcgtctcccaggacctgggtcccccagccccaggccctgccctcaccagtcatccctgggtggctttgggctggtgactcccggggctccctactgcagactctgccctcccctcctgctgccccaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacagcgcccctaggaactgttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttaaaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggttgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgccgagaacagggagctaaacatcaccatcatctaagagcgggtcaagaaattgaaaaaaaaaaacaaaacatttaaggggttaatatcctacacaattcatttacttcatttgaatgttagagccacttatgtttgtgtttctaatttatagtttaaatttatttgtgtttctaatttatagtttaaatttatttgtttctaatttatagtttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctctggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctaggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaacgtttacaaactgcagcacaatctactgttcgtgaatgtcaaagtgtcatgaggaaagtgtctatacaatcacagagttatatttcctcacaaagttctttacaaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactatgacaataactatgacaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggta

SEQ ID NO: 460830 - DNA, 1826 bp, Homo sapiens
  misc_feature (1823)..(1823): n is a, c, g, or t
cccccacagctcagctgaggctgagccgccaagaacatttttcatggatatattaatcatttataagtgtaagctgtacctgctcttggccttatttttctggcaagaacatgttaacgaaacaccaggggcttggtcgtgtctggagtttgttccttctgatgttcagacgtgttcggagtttcttccttctggtggggttcgtggtcttgctggctcaggagtgaagttgcggaccttcgcgctagacataaaggttctccaagtccctaccagactcaggagcccagctggcttcacccagtggatcccccacagggctgcaggtggagctgcctgccagttcccggccgtgtgcccgcactcctcagcgcttgggtgtcgatgggactgggcccatggagtagggggcggcgctcgtctgggaggctcgggccacacaggagcccacggagcacagcagctgctggctgaggtgctaagcccctcactgcctgaggccagtggggccggccagctgctccgagtgcggggtccgccgagcccacgcccatccggaactcgcgctggcctgcaagcaccgcgcgcagccctggttcccgcccgcgcctctccctccacacctccctgtaagctgaaggagcccgctccggccttggccagcacagaaaggggctcccacagtgcagcctcgagctgaagggctcatcaagtgccgccaaagtgggagcccaggcaggggaggcgccgagagccagtgaggactgccagcaccgctgtcacctctcagaaatgctgggaagaatatgagagatccggaagggaacagaagacaaggaatgtgggcaccctctagaagttgcagaagccagagaaacagactctcccctggaatgttcagaaagtgtacaatcctgccaagacctcggtcatagctcagtgaaacccattttgaaattcggaccaccagaactctgttcccaagtgtcatttagacatgaaggaggcctacaataaaatagtatgctgaatgttctgaaatatgtttcttattgctgctctaacaaatcaccacaaacttagtggcttaaaactacaacactttagcatcttagatctctgggtgttagctgttcaaaaaatctgactggactcaaatcaaggtgttgcctggattgtgttcctttttaggatgcctaagcgggaatctgcttccttgccttttccagcttctaaaggctgcctacacaccctggctcctgtggccttcctccattttcaaagccaaaagacttgtaactctctgtgcttttttttatagtcatatcttcctctgacgctcccttctgcttacctctaccactttcaagggctcttgtgattttattgaggccaccctcaatgatccagaagaatctcctgatctcaggatctgtaacttagtcacgtctgaaaatttactttgctttgtgacatattcatgggttttgggaattaagacatgggcattgttgagggataattaagcctagctcaagagacatccgtctttcaaaatagaccttatactgtcttctggttaataagatagctctcttctctaatgaactttgtaaattaaaaatatgtaaatgacaggcatatataatttaaagaattataacaaaaggaaaacacctaccactcaggttaagaaacacaacattgtttcttatgcgacatttttaatccggtgttttcaagctcatataaccaaggataaacattaagggataatacagttttttagaaaatcatttacccctttgatccacaaactctantaa

SEQ ID NO: 460831 - DNA, 2238 bp, Homo sapiens
cggccctggagatgcaccatggttttagcagcagctgcagaactcgaatgttcctcacttggcaggtcctcagcgcccgacaagtcaggttccaactccacggtgggtcctcagagccaagcagcccagcagccatgccagccccagactctgccgccaaccctctggtccctggccccacatccagggctgtgttcttttagtgacacaaagtgccaatgtcaagactgctttccttcaaggataagcaaaaggctcttaactccctcccaaagtgttttctccttgtctctggggactcaccagggacaaggtaaaaataaacctcagtgtgcagataacggcacatccctgtttctcagtggactgaggctggctctttggcagatcaaacagaacttagggaagacctcagacccagaagcaccaccgagtgttgggatcccctccaggatcggaaactcagaaacgtgtaagtgccagaatccgcatttgggaatctgttatttctccctctgcgagtcaacctgatcaccctggaagcctcactgtctctcagcccttgttcccatttttctttccatgaacaccgcaatcagatacgagattccagtaatgatggttcttgaaaattaaacaaatcaaaaagaaagccagccaaggtatggagtgggggacctctaagttcccctggaggagacactggggccaggttccgaggtgcattcggagccagaatccctaatggaattgaacaattatcctgaagctgctctctgaaagccgcggttttcctaaaacactgtgcttggcgtgcctgggcttcttggcactggcccatgacccacagcagcaaatcgttcccaggaagctattgttatttgtgtatctgatagcattcagctgagtacactgacagcaacatttagaaaggaaaagaaaaaagaagcgtagagtgaaaaggacaaaaaggaggcttccaacatcctggtgggaacagaaaaccagcaaagcctcttttccagcccttatccttgtgagtttggactctgcagaactgtcatcccccaggcatagctgcagcttgtatgaagaaagtaacacacacagaagagaaggttataggattccatgctgcttggcaaaggcacaaaatatgtgcacatatttacatggaatatgagggtaaactagaaaattaagggtaatctaaaatagaaaaaaagaagaaaacaataagttaaaagtatgaaaagacatccagaatgagcaagttactgaggttgtgcctcaactttagcttgagtttcctggcagcaaaggtaaaaaggtgatcttacagctggaaaatcagtgggtgaaaacggagatacagcaactctgtcttggactacaccttaactgaagacgtctatgtaggtgacgaaaactcatggaaggacttgccacaattcaaacatgggcttttggggtttctgagaccaacagaaccaccatatactttgtgggtgtagggattctccctgcatgttgagcctgtcaccctaatgacaaccagctttgcattaactagagtcagccccaaaaatgcatctgttactccagagaaggacaaatccttattattactttataggattttctctactaggggcttccataaagtaaacatgctttcaggaaattaacagagtaattttaagccaaaatccatagcattaaaaacaaataaaccccaaatgatagcaatgtatttggggggaaaaaagcatgtaatcaactgcctgcataatttaaactaccaaagctttgaagctccttaacatcaccatcacctcccttttagacactgtcacccagtagaagaaattcacagccctgctgctctaatgagtatgtttcagtaaacacagaagaaatcattttcacagcccccatgcatttctcagcaagcactcaaatctttcaaacccattccagggggaagtttccatcccaatcttttccctcatatttcatctctaagagcacccctcccccatctgagatccacaagttacaaaaattactgtttcaggtttctcatcattatctgttaaaaaactaaaattacagatgagatagtattctacagtcccaggaactccaactgttcaggaaacgtgagtaacagaagtaacgcggtatacaatgaaaacaaacatcttcctgtctttggagcaactgagaagcaaacaa

SEQ ID NO: 460832 - DNA, 1116 bp, Homo sapiens
gtgcacatattttgtgcacatattccatgaaaatatgtgcacatatttacatggaatatgagggtaaactagaaaattaagggtaatctaaaatagaaaaaaagaagaaaacaataagttaaaagtatgaaaagacatccagaatgagcaagttactgaggttgtgcctcaactttagcttgagtttcctggcagcaaaggtaaaaaggtgatcttacagctggaaaatcagtgggtgaaaacggagatacagcaactctgtcttggactacaccttaactgaagacgtctatgtaggtgacgaaaactcatggaaggacttgccacaattcaaacatgggcttttggggtttctgagaccaacagaaccaccatatactttgtgggtgtagggattctccctgcatgttgagcctgtcaccctaatgacaaccagctttgcattaactagagtcagccccaaaaatgcatctgttactccagagaaggacaaatccttattattactttataggattttctctactaggggcttccataaagtaaacatgctttcaggaaattaacagagtaattttaagccaaaatccatagcattaaaaacaaataaaccccaaatgatagcaatgtatttggggggaaaaaagcatgtaatcaactgcctgcataatttaaactaccaaagctttgaagctccttaacatcaccatcacctcccttttagacactgtcacccagtagaagaaattcacagccctgctgctctaatgagtatgtttcagtaaacacagaagaaatcattttcacagcccccatgcatttctcagcaagcactcaaatctttcaaacccattccagggggaagtttccatcccaatcttttccctcatatttcatctctaagagcacccctcccccatctgagatccacaagttacaaaaattactgtttcaggtttctcatcattatctgttaaaaaactaaaattacagatgagatagtattctacagtcccaggaactccaactgttcaggaaacgtgagtaacagaagtaacgcggtatacaatgaaaacaaacatcttcctgtctttggagcaactgagaagcaaacaa

SEQ ID NO: 460833 - DNA, 990 bp, Homo sapiens
aataaaacatcgctgagtagtaagttataccaaccagaaaaagtcacttgaattcagttctgatcttctttataagatgctgcggatagctgatctaacaagagagcttcatgtgatgctatttgctttattaggtcttggactacaccttaactgaagacgtctatgtaggtgacgaaaactcatggaaggacttgccacaattcaaacatgggcttttggggtttctgagaccaacagaaccaccatatactttgtgggtgtagggattctccctgcatgttgagcctgtcaccctaatgacaaccagctttgcattaactagagtcagccccaaaaatgcatctgttactccagagaaggacaaatccttattattactttataggattttctctactaggggcttccataaagtaaacatgctttcaggaaattaacagagtaattttaagccaaaatccatagcattaaaaacaaataaaccccaaatgatagcaatgtatttggggggaaaaaagcatgtaatcaactgcctgcataatttaaactaccaaagctttgaagctccttaacatcaccatcacctcccttttagacactgtcacccagtagaagaaattcacagccctgctgctctaatgagtatgtttcagtaaacacagaagaaatcattttcacagcccccatgcatttctcagcaagcactcaaatctttcaaacccattccagggggaagtttccatcccaatcttttccctcatatttcatctctaagagcacccctcccccatctgagatccacaagttacaaaaattactgtttcaggtttctcatcattatctgttaaaaaactaaaattacagatgagatagtattctacagtcccaggaactccaactgttcaggaaacgtgagtaacagaagtaacgcggtatacaatgaaaacaaacatcttcctgtctttggagcaactgagaagcaaacaa

SEQ ID NO: 460834 - DNA, 542 bp, Homo sapiens
atgagcactggccttaataatacacagaacgttaataaggcacagagaaggagcagaatgtgtgtgaagaagattttagacaaagtcctaaaaacggaaagtaaaaaatcaagaagcccgatgtggctcatcaggaagggggaatgtgcacatagatgaggtaaaaaatattcaggagttaaaattaagagataatctcccatctaaaatgaaattgatagatgctaaattcttcatgaatacatcgaaggatatcatgaaaaccatgtggagataaactacttatattatgtggattcattttgattactaattgagtagggagaaaaatgttaccttttccttcagcagcttagtctggttcctgttcaactcgtatttcatgttcaaggtaactatccctgagccaacaaagacaaaccatttgatctgtgcccaagggtgaataccaaaggaacttatactctctaatttcacctgaattgtttataagggaatgccatatttgtccctggttcctcctctttcactcatcccaatga

SEQ ID NO: 460835 - DNA, 2006 bp, Homo sapiens
  misc_feature (2)..(3): n is a, c, g, or t
  misc_feature (7)..(8): n is a, c, g, or t
  misc_feature (11)..(12): n is a, c, g, or t
gnnattnnttnngagccaaatatgagtgaccatggcccatcacacagccctcagggggtcctgagaacatgtgcccaaggtgaaaggcgggacaattcaaagcgggggcttccaggttaccgaaagaaagtaagaaagaaagaaagaaagaaagtaagaaagaaagaaagaaagaaagaaagaaagaaagagagagagagagagagagagagagaaagaaagaaagaaagaaagaaagaaagaaagaaagagaaagagagagaaagagagaaagaggaaagaaaaaagaaagaaagagagaaagaaaagaaagaaagaaaagaaaaaagaaaaagagaaaggaagaaaaaagaaagaagaagaaagagagagaaagaaagaggaaagaaaggaaggaaggagaagaaagagaaagaaagaaggaaggaaagaaagaaagaaaaagaaagaagaaaggaaggaaagaagaaagaaaaagaaagaaagaaagaaaaagaatcatcaggggtgattaaagttcagattcttgggcaatgtcttaaacttactgattcacaattttcaaatttctggcagtggccctttaaaaatagcaccctacatatttcttaggcattctaaagtttactcagaatattgctgagtagttattttttaaaataatgtgttaatagatatgctcagagaattacaagcattgagaaaggacttgaaatgaatgtatttgttaattgtgttttcaaaggattttataggtatgagaaccacagttcaagtgcaaaaaaaagttatccacaggccacccgaatcctagttacactggagatgtttttccagtataaatttctagcccgtcaaatcagaatttctgaaggtggagctcaggaaattcattttaacaatatctccagatcatttgtatggactttaactgtggagactcagatgtcgagatgatttataaacgctcttgaaagtctaagattttataattttaagatcaatacctgtaaaaaaaaaaacatagtgtgaactaaggcattattaaagaacagcatacttcagacaacataacatgtcctaaatcatctttggcttagtcaccttcaatagtgtcttttcctgattgcacagtcaggccagaagtacattctcaggcaatttctgtttctccaatccattcagtttttcattagcaatattttgagccatattatttgtcaggcactattttagggactacagatattagtgaataagttgtccaaaatccttccatttatgaagttaactttcatgccaataaaaaagcaaaataatgaacttggtttagtatataataacatgatttcagagaataatataaagtaaataaaattgggtaagaagctagaatgtgacacaggtgaggtgtgagcatattcaagaatgttgaacagcttcaacttggatgcttcaggaaagctacttggtagaagtgacggatgagcagaaaagtaaaaggtgaagagaaggagcagaatgtgtgtgaagaagattttagacaaagtcctaaaaacggaaagtaaaaaatcaagaagcccgatgtggctcatcaggaagggggaatgtgcacatagatgaggtaaaaaatattcaggagttaaaattaagagataatctcccatctaaaatgaaattgatagatgctaaattcttcatgaatacatcgaaggatatcatgaaaaccatgtggagataaactacttatattatgtggattcattttgattactaattgagtagggagaaaaatgttaccttttccttcagcagcttagtctggttcctgttcaactcgtatttcatgttcaaggtaactatccctgagccaacaaagacaaaccatttgatctgtgcccaagggtgaataccaaaggaacttatactctctaatttcacctgaattgtttataagggaatgccatatttgtccctggttcctcctctttcactcatcccaatga

SEQ ID NO: 460836 - DNA, 2488 bp, Homo sapiens
gaggaactaagagaccagaatgttagaaggattgtacatgtggatattaaaatcatcaagaacagtcactaaagttatgttgaagaaacaaagccatcccaagaatccaaatgacaaacaccgtagcaaaaagtgcaaagatcccaaaccacgggtaaagaagttaaagtaccaccaatacattccaccagatcagaagggtgagaagaatgagccgcagatggactctaactacgcccgcctgctccagcagcagcagctgttcctgcaactgcagatcctgagtcagcagaagcagcactacaactaccagaccatcctgcctgcaccattcaagtacggcggggcccatgctatcctcaacgcgggagcttatcacacagtgtctgaagtccacatggtgagagtggcctgcattccattccagtttctgtcctccaaaataggttctgaatttttacaagttagaaatgccttttcacaattattcatccagatttgcctattattagaacaccaaaatagtactagatgctctgagaaaagcaaggctcgagaagggcctttccaggcacaggggaatgctgtgagcactagtacagaggaaggaatagataaaaagtggaagacaaaaatagagtacagccaatgtctaaggggacttgaagctgggcagaagaccttactcaacacagcagatagacaacggagtgcttcagagcaggctgctgacgcagtgaggccaaaatataagaaaaaacagctggatgctggtgttgaagggacgtctggagacaatgaagagctctggcagcagaattcaaatatcttgaggaagattaaacctattagtaattcagacctgattgtgaagtacttaaatctaaaacatcagggcatggagatgaagagagaaagaactttgtatccagttactattttaagagcaggcaggcccgagccactcaatgacaaaaatagtaacagtgggaattcagctttgaacaatgccacacctaacacaccaagacagaatacatctactcctgtatcagaactgaagacagaactgaagttaaggggtctgccagtgtcaggcaccaaaccggacctcattgagcgcctaaaaccctaccaggaagtgaacagcagcggccttgctgctgggggcatcgtggcagtgtcatcatcagccattgtcaccagtaacccagaagtcactgtggccttgccggttacaacactacacaacactgtgactagctcagtctctactctcaaggcagaattgccacctacaggaaccagcaacgcaacccgtgtggaaaatgttcattcccctctgcccatttcaccatctccctccgaacagtccagtctcagtactgatgacacaaacatggcagacactttcaccgagattatgaccatgatgtcgccttcacagttcttgagttcatctcctttgagaatgacaaataatgaagacagtctgagtcccaccagcagcactctgtcaaacctggaactggatgcagccgaaaaggatcgcaagcttcaggagaaagagaagcaaatcgaagagctgaagaggaaactggaacaagagcagaagctcgtggaagtgctgaaaatgcaacttgaggttgaaaaacgagggcagcagcagcggcccctggaagcccagcccagtgccccaggtcattctgtcaagtcagatcagaagcacggcagccttggctcctccatcaaagatgaggcctcactccctgactgctccagctccaggcagcccatcccagtagccagccacgctggacagccaccgcctgctgttgttgctcagccccaggctttactgaccacgcagactgctcagctgctgctcccagtgtccatccagggctcgagtgtcacctcagtgcaactccctgtaggcagcctcaaactccagacttcaccacaagcaggaatgcagactcagcctcagatagcaactgctgcacaaataccaactgctgccttggcctcaggcttggccccaactgtacctcagacacaagacacgttcccgcagcatgtgctcagtcagcctcaacaagtcagaaaggttttcacaaactcagcatcatcaaatacagttcttccatatcagagacatcctgccccagctgtccagcagccctttatcaataaggcctccaacagtgttcttcaatccagaaatgctccgcttccatccctgcaaaatggacctaacacacccaacaaggtaaccctgtgaggcttgtgcgtcagtgacagtgccgcaggggcatcaaatcattccaaagcctagtgctttgggcttggagtgactaatgttaatgggataaaattgttgaaaatacagtgataacttgtgaaggaggagctcagctattatcacagtgaagatgatcgttcgcacataaggtggccaccagtgctgtcagcctcacaggtgctt

SEQ ID NO: 460837 - DNA, 2879 bp, Homo sapiens
gaggaactaagagaccagaatgttagaaggattgtacatgtggatattaaaatcatcaagaacagtcactaaagttatgttgaagaaacaaagccatcccaagaatccaaatgacaaacaccgtagcaaaaagtgcaaagatcccaaaccacgggtaaagaagttaaagtaccaccaatacattccaccagatcagaagggtgagaagaatgagccgcagatggactctaactacgcccgcctgctccagcagcagcagctgttcctgcaactgcagatcctgagtcagcagaagcagcactacaactaccagaccatcctgcctgcaccattcaagtacggcggggcccatgctatcctcaacgcgggagcttatcacacagtgtctgaagtccacatggtgagagtggcctgcattccattccagtttctgtcctccaaaataggttctgaatttttacaagttagaaatgccttttcacaattattcatccagatttgcctattattagaacaccaaaatagtactagatgctctgagaaaagcaaggctcgagaagggcctttccaggcacaggggaatgctgtgagcactagtacagaggaaggaatagataaaaagtggaagacaaaaatagagtacagccaatgtctaaggggacttgaagctgggcagaagaccttactcaacacagcagatagacaacggagtgcttcagagcaggctgctgacgcagtgaggccaaaatataagaaaaaacagctggatgctggtgttgaagggacgtctggagacaatgaagagctctggcagcagaattcaaatatcttgaggaagattaaacctattagtaattcagacctgattgtgaagtacttaaatctaaaacatcagggcatggagatgaagagagaaagaactttgtatccagttactattttaagagcaggcaggcccgagccactcaatgacaaaaatagtaacagtgggaattcagctttgaacaatgccacacctaacacaccaagacagaatacatctactcctgtatcagaactgaagacagaactgaagttaaggggtctgccagtgtcaggcaccaaaccggacctcattgagcgcctaaaaccctaccaggaagtgaacagcagcggccttgctgctgggggcatcgtggcagtgtcatcatcagccattgtcaccagtaacccagaagtcactgtggccttgccggttacaacactacacaacactgtgactagctcagtctctactctcaaggcagaattgccacctacaggaaccagcaacgcaacccgtgtggaaaatgttcattcccctctgcccatttcaccatctccctccgaacagtccagtctcagtactgatgacacaaacatggcagacactttcaccgagattatgaccatgatgtcgccttcacagttcttgagttcatctcctttgagaatgacaaataatgaagacagtctgagtcccaccagcagcactctgtcaaacctggaactggatgcagccgaaaaggatcgcaagcttcaggagaaagagaagcaaatcgaagagctgaagaggaaactggaacaagagcagaagctcgtggaagtgctgaaaatgcaacttgaggttgaaaaacgagggcagcagcagcggcccctggaagcccagcccagtgccccaggtcattctgtcaagtcagatcagaagcacggcagccttggctcctccatcaaagatgaggcctcactccctgactgctccagctccaggcagcccatcccagtagccagccacgctggacagccaccgcctgctgttgttgctcagccccaggctttactgaccacgcagactgctcagctgctgctcccagtgtccatccagggctcgagtgtcacctcagtgcaactccctgtaggcagcctcaaactccagggaatgcacacaccgcttgcaagcagcaattgggacagttaggtctcacgagttgccttgctgttattcaagtattacagtacctgagctattatgtgtagaactgccttaggttcttattatttccatttccattttctcaaaattttcaaatgaaaaatcttagctacttaggaataataagagcatgcagtgactggtctgatgtttccctctctggtttagaatcattaaagttcagatttctgtgcagatgaagtgtgtatctgtaaccttggtcttatttcatttagatacaatccccaagtgaccagtgattctacacctaagttctgatttctaactttgattctgacaattaaattgatgtttttttcaattcacctcctagacttcaccacaagcaggaatgcagactcagcctcagatagcaactgctgcacaaataccaactgctgccttggcctcaggcttggccccaactgtacctcagacacaagacacgttcccgcagcatgtgctcagtcagcctcaacaagtcagaaaggttttcacaaactcagcatcatcaaatacagttcttccatatcagagacatcctgccccagctgtccagcagccctttatcaataaggcctccaacagtgttcttcaatccagaaatgctccgcttccatccctgcaaaatggacctaacacacccaacaaggtaaccctgtgaggcttgtgcgtcagtgacagtgccgcaggggcatcaaatcattccaaagcctagtgctttgggcttggagtgactaatgttaatgggataaaattgttgaaaatacagtgataacttgtgaaggaggagctcagctattatcacagtgaagatgatcgttcgcacataaggtggccaccagtgctgtcagcctcacaggtgctt

SEQ ID NO: 460838 - DNA, 5618 bp, Homo sapiens
gtacaggtgtcttcgcgcttttcctttcaggcttctgtggcttcaggtgcattgtcccagaggtgtcacctctagactaagacctatggctattgaatttgaagggacatggggcggaatagagtggcgaggactcctggaggacaaatgcctgggtagcagaaaggaaaatgaaggaaaggaaatggattcaactgctgatttggacctggggacaattcagttgagggtctcagagaagtttgatcatctgaagccttcttctctcaactcatcaaagtcattatccgtccagctttgttccattgctggaccctcagctgcaggtctgttggattgtgctggaggtccactccagaccctgtttgcctgggtatcagcagcggagtctgcagaacagcgaatattgctgaacagcaaatgttgctgtctgatcgttcctctggaggtttcaaatcagaggggtacctgcctatgtgaggtatctcaaaatccatgctgggagaaccactaccctcttcaaagctcagttggaaatgcaaaaatcacctgtcttctgcatcgttcacactgggagctgtagactggagctgttcctattcagccatcttggaaccgcgcctctggatacaagtttattaaaatgaagacaaacttacatgggaatattgcctggaaagtagaatcaaatatgcaataaatttctagaaattaacaaatggtttcatttacattataagcaattattgatttataaccattaatcttttcatttgttttctgatcttataaacacttcaaataacatttatttaaaaactttttaattgattaaaaattaatctcaataattataataatttttggataaagtttacgtaatcatcattattattaaaaatgtaaaaagtccaactatataaagttaaacctgtacagaagaccacaaacttattcaagcatatttttgctttgtcaaaaatctttttcccttaacgtcaaacaaaagattatagagctaagtagtacgtttctatgaaaagaaaaataacaatgacaacaatgaaaataaaagtcaggacttaagctaagaaagaatagaaaaccttaaggaatataatagtgacaggcaattttagcattaattatataatctcttatttaaagttaaacatcgctatgaaaaaactgaaacagtctcttgctgaatgtgatatgccagctgaataatgaggtttggcttctaagtagcttaaacttagcctggaaatgcagattgttggtattttctctgccctccaaaattgtgataatgaaatcttttagtctttccatttctgttatacataaatatgataaaacaagaacaagaaaatatgttttcattgccttaggatgatgcatttcaactcagagtcttcatataattatcatactatcagaacttctacaatggcagtagtcaatactgagagcaaaaggaatcccaaaattcttccataacgaaatgtattattagcaaagatttatttaacaatttcaaagtattttatagtctaaaatcacatacattcacacctttgtatatttgaataaatgcctaagaaaatgaaaccaatgtttaaagaaaacacatttttaaattttaaagcaaagataatttatagctctaattaaaatgttaaatacctcttaagtgtgtctacgattcatgggcaaagcagtcagtactcttgacggattttatttcttgacaatttttgctcacttgaaatccatagaaaatatgcccacaaggttaacaacaattttagaataacttatgaattggcttttaggtaaagtttctgaatattccttcttgagctacatcctgcttcacacataaattatgatataaattgttctaaatgtaatatatattatcgttacatgtgatcaagtgtcaaacatgtccccaaatacctgttcacctcatctgcatgactgaatggtagaagttttagagttattaccccaagcaacaatgtcagccatctctaatcttccctacacttcccacagttctctcatagatgacaatatgcccttcaccaagatccatcctttcttaattatatggaaaacctcaatttcataacccatgaacagaaaggagaaaaatctctcattcttttactctctacagtgccaaatatactgtttgatttttctctttctgcctctctgactctgttttcctgtgtctttttctttatcttctctcttttttagtgatcagaaattttcagtgtatatatattctcattatatggtgatgaaattattctctacaaactcaatttctactcttctttttgtaatgcaatacttattgaccacatttatattaacatatcctttataacatctgcataatattccatggaacggtcactttgtagtgtagctaataagtttatattaatggatttttttactattataaataatactgtaataagcatcttcatatatattcatctagattgattcttagtgtaaattattagtggtgccattgctggatgaaaggaagtgagtgttttaatttgccagatatttgtaatggctcttcgaaaatttggaactattacagtctcgcaggtagtgcattagcatgtttctttcctttatctttgccaaaattgaatgttttacagctaaaatttttgttaatctgatattcttattgtttcaattgacattttttaaaaagttatgattgaggttggacttttttcatatgtatattaattatcaacatgctttttctgattaactcaataatttttagtaagttgtttatatgctatgatttcatttttaccacctaccccactttacaaataaaagaataatgtattgtcaatatggataatttggaaaatgtacaaaagttagcaaaacaatcgaacaggaagctgaagaaggaaggaaaatgctgctatcttgataaaatctttagcaatccagtgtaaattcatcttaactttattatatttgaaaatgttctgttttcaaataaagtcacattcacagagcccaggtaaaaaagaattttggggagatacattcacttctattttttttttgatgaatataaggtaaaaaaaagttgagtataaaaaataaaattagaaaactatttttaacatgggatgagaatattattttcaatgaatcatgtttgttaaactatttcaataaaaaaagacaaaatccaaaattgtaataaatgtttaacagctaattaaatacaggatcctgaatcactgactgacagaaatattctcccaagttagaaatatagaaatgataaagtgtaatttaatatatttttttctgatatatggtcatccaatatcagcaccagccaatctcctacatatgccttttgttaacagtaatggtaaatactaataaaatatgccttatcaaatggaattattttgtgttcatggaagccaaacaattttcaaagcaggactttagcgacttaggaaaaccatttttattgcttcatttagaagaggaaatggaaatactgagttacaagagaagatggcattttttttaaaaccaatctttacatcatgattattagaagccgtgacactcccctatgatgaagctcttcaacattttaagggcattcattcacaatattgagatatcagtttgcacttttcggaaggcaaaagttaaacgaagtgcaatcctggaatactttacaatgaatagcacaagtgttgtgaacggactgaaacattcaacaaatatctatttagtactatgtgttactatgtgaggcactgttctatttgtgggggatagtgcaggaaacagagggacaaaagtcaggctttcatgcaagttgcgttgccctagtcatgctgaatattctccacctgctcctctggctctgcttctcacccttcagtgagctttgcgctctggccactgactcctaagtcctgcttcactttctatactctggctttgtgttgctttgaccaataaaagacaaagacagcagatcagagatgttatatcgtcaataacaatttcctggtggtcctctgcaacatttttttaaatgaccaaaatagtcatatgtcccaacggaggtacaatttacagcattgtgcgttctatttctggacatataactatataatctgagttatgaaaatcaaagaaactaatttaatatgtgaatttctatcactgaacattttaaatacttgtattcaagataatatcacagattatatatgcaaattaatgtaaattcgcagtggacaatattatattgtcaaaatcacactgacacagactctcagaagtagaagcttcctatcagaaggttaatattttctggatataacacagcaataataaaaagcaagctctggattagatagaaatccagggatttagatcctggggattgtgaatctaaatttatgttaaataaatgtatgcatactcttgggatagtaagagagttcatttttacccagtcatgtctaaaataactctgagctaaaaatattctccctgatacataatgcaaataagcctaccatgcaattttcatggttgattctttgaaacttttgtaaaacttaagctctaaaatatttggaatcttgtggcagtaaaaatagtgggaacatcctgttttacatactgctataaagtattcaccagaatgatgtttttctgtattagaaatactttcttagtttgattgcctgagagaaagagaaatctttttaaaagaaaagagagaatatttttagtattttaataacaattaaaattttcgcttcaaaattcattaaataagtgtttggaataaatcctataactagaacatagtcctgagcattaaacagtcatttgcaaaggggaaggcaagtgggctgataaatatgaaaaaaaaaaaatcttgaggactactagcagattccgttttatagacacttgagaacaaaactatagatttttgaaggtgaattttcatcaaagaaaatactttgaatacattatgttactggaatttaaacatggattatcttttagtcttgaggatccattttctgagacggtgatgggaaagatgttggttgtcaagtggaatctcagcagtcattttcagacaaagttagagaaaacaagtatggaagatgcctgattctcaaagagtcatccagtcttgggattaccgcctacgtccatggaagtgaaagtcctctttttctttgtaccacttactgaggctgaagaggaagaggaagagcaggtgttggtcttgatgtctcagggcaggcagaggtggaagagaatctgtgtgtaaagcacctgcacagttcaaacccatgctgttcgagggtcaactgcattcttgaaaattgctaaaagactccattgtaagtgttgtcaccacaaaaaatagtaagcatgtaatgtcatgcatatgttaaatcagctcaatttagccattccacaatgtatacatttttgaaaacgtaatgtacacaatatatataattttgtcaattaaaatgggt

SEQ ID NO: 460839 - DNA, 1437 bp, Homo sapiens
gaataggaacagctccggtctacagctcccagcgtgagcgacgcagaagacgggtgatttctgcatttccatctgagttaggcttggccacaagagacaaattgcaaggcatggagacatttttctaacacttgaaaattctatgcaagagcaccaggcagctcagtcaccttgtcacttatctactgggtcaccttgttggcatgggatgccagccaggcttgcagctgctccatcctcccctgaatttgtacttcagcttctccactcatggcctgccctgaggacttcatggttcagcatcagatatgaagacgacagccctatagagactatttaaccagcttctaaggtggttaaatatcttaccagcctatgtaaggccgaatcctactaacaaagcactggtatatgtaatatcccagtggtttgcttctctaattgaaccctgactactacaggtaagaattttgacaagaatatattaattcttctaggatgaagaaagggaaactcacttcaggtcaatagagattgtcatttgggaccccttcaagacaaccaattatatgactgtctctaaaatattgctatccagcccccattcctcacttttgtcctactggtaataagacattcatcgtgtatctttcagaagtccagataccacagtctgagtagttctttaatctgcttatctggtgattccatcacaaatggttcagtgcacagagagctgctcatttttgttattgctatcacttttctttggctttgactcttggaaaaaaatgtcttgggccattctggcagtgtctccaaacctgccctctgctccctgtactgcagtttctaacgagagactggggatcatccatcatccctttcctacctggcccgttactgggccaacttcccagatgggacggagttggctggcaggcagacctcagaagggtccactgtctgagaatgaggttgagcatcagggagagctactgagctttgaacaagccaagagaaatgtttcttgtaactgtggctggagtcttctgcctggaaagataggcaggagatactgcttcaacaaccaaaggaagcaggagacatcccacttgatgaccccaatatttccctgctgccataaatgtgttttttcttttttaaatattacctggtcccattgttccttccggtgggttcgtggtctcgctgacttcaagaatggagctgtggaccttcctgagtgctgattggtccattttacaaacctctagctagccccaaagcactgattggtgcatttttacagagcactgattgatgcattttacaaacctctagctagccacagagcgctgattgtgcagcagcacaacttctcccaaatgctgccataacgtattgaaagctacaacctctctccatatgtttaga

SEQ ID NO: 460840 - DNA, 1539 bp, Homo sapiens
agcttgtgctgttaacatgtatgcatgatgcttctggcagaaagaatggggaaaacaaaacccaaagtcccctccaaatcccagcaacacatatggaagtacgcagagaggacccgttcctttgcgggcctttcctgcccaagctccgggctacccgtaaatctgaccctctccagggccaggaggcctcaagagcttggagactcaccggagcaaacaacttagcaaaaacaatctgtcccataaacaaagccagtggaaagcatccaggcccacacaatggagctaatcttctgggcacacatttcccgtctggggtattagcaaggataccgcttccttctaggtggaggagcgagccacatgggaagcatgagaaagaatgcaggctgcctctacgatcaaagaccagcccccagcagaaaagagtcacctcagtcctacaaccacgaagaactgaattcagccaacaacttaattcacccccagagctggtcctgccaacagattgatcttatccttgtgagactctaacagaggacacagctgagccacatgctatccatgggcttctgacctccagaactgtgacataacaaacgggtgtcatcttaagctggtgttagtgccactgcactacaagtgaatagcagggcttggtctaaaaatatctcctccactgacataccacatgggttgatattcctgctgtcagaggcacaccttgaaattaaggtgtcttcctacaaaaagtcttgttgttaagttcagacactgtctgagatgaggtatttataattcctgccccaaatttggctataagcttcaagaatactgggacctggcttgtttactgaagcatctctagagccacaacaatgggtgaaacaccatggacagttagcaaatatttgctaagcaaatgaaagactacacgacaagagcaaaagaagtgcaggaatgggcccatgctcatggaattcactggtcttaccatgttcgtcatgatgctgaagcagctggcttcatagaatattgtaacagccctttgaagactcaattacagcaccagctaagtagtaataccttggagggctggggcaagtttctccagaaggctgaatatgctctgaattagtatccaatatatggtgctatttctcccctagccgggattcacagatccaggaatcaacggggtggaaatgggagtggcaccagtcaccatcacccctagcgacccactagcaaaatgtttttttcctgttcttgagactttatgctttgctggcctagaggtcttagttccagagggaagaatgctgccaccagaagacaaaacaatgatttcactgagctggaagttaagactgccaccccgccacttggggctcttcatgcctttgagtcaacaggctaagagaggaagagaaggaaggaatagccaatgatcagtaactgtgcagagccaggatcaaaaactcaaatgcccacaggggccaggtaataaagcaagtaaatgaaggcatttgcaatgtt

SEQ ID NO: 460841 - DNA, 1182 bp, Homo sapiens
ggcctggggagaggaccctgacccactgccagggagctgtgccagaggttcccatgggacatggaaggggaaccgacatccgtttctgcactggggtgtggacacctggccccacaccacctaggttcccccacaggggcctgaagactggaggttctctccagaatgttctggtttgattctgagagcaggagagacacccataaaaatgattggggttaaatttctggccaggtagatgggaactcacagccaaaatttaattaaggagaataaacaattgtgccacgccatgcatccaagtccggcagggcaaatccacacccgctactcactgagcttcccctgggccggaatgctccccctacatttgcaagaacaaagcctccttcctgtagaaaagaaaacaaaagtaaaataaaaaagaacaaagccattgggcttgggtttcctctttccaatcaatcgatcggtcatcgggagatggaagagacggtggaacctaggagcttggcgaatgctcctgagacctgggttctttcccaggtggcttctggcagctctgtccctggtgtctttggttctctttttctggaccctcttttggctggatgatggactgcctgggatggaagacagccctcctgactcatcgacccctccctacgcaggatctggcaatggtcaggctggcaaatcctggacacgggtcagacacgagcctcagggcatctgccactgcaagcaagtttcccatgtgagtgaccccaggcacacaatggacaaccaggcattaggccatccatcaggaggacttggtgctacgtggcacagcctgcatcagctagcagagaggctctcagattggagaggacagaagaatcatcacgagagggcttctcaaaacacagttgatgggcaaacccagaggtctgggttgggcctgagaatgtgcatttccgacaaatattcaggcattgctgttgctgctggcctgggaccctgtcatgaggagcacggatctgcacagttgtccctcattacatgtttgctgattgactgaatgagtgaatccaggcagtgagaataatggcactcagaggaggggcccaaggaacagagttgggagtggttgctgtgctgtgatcccttgaaggttggtttagaggcttgtttctcaaa

SEQ ID NO: 460842 - DNA, 6155 bp, Homo sapiens
gatcaggtgagcaagaagccggagccccgtggtttggcctttaaggcagatcaggatctgtaagaggggcctggaagcttcctgtgaatctggtgcaaggctccacctgcccttggtttcacaggcaaatggggctcctgtgatggaggatggatttcgggcctcagactgggcagccaggaggtctttgggactgcctgagctgagggctgcctgggctgaggactgcctgggctgagggactgcctgggctggggggactgcctgggctgagggctgcctgggctgaggactgcctgggctggggggactgcctgggctgagggctgcctgggctggggggactgcctgggctgaggactgcctgggctgagggactgcctgggctggggggactgcctgggctgaggactgcctgggctgaggactgcctgggctgaggactgcagctgaaggctgcctgggttgaagactacctgggctgggtgcctcctgggctgggaaggaagtgggtttggccttgtttcctctgatgttgactaagccgcctctccttgccctgggctgggcctgtcctgcccgaggaggctaggtggtcagagatgggtggtgggagaggccggcagggagcactgtcctcgggggtgagtgacgctgggcttgttgactccctcgcagagtggagggttaatgctctgattctccctgggcgcagggacccatgttaacatcttaattatgtgctttctgcagcaaagttgccaacagcaaactttcccagagagtctcagcaggacagcgaacaaggggacaggtcccagagagtctcagcaggacagcgagcaagcggacaggtcgcagagcgactcagcaggacagcgagcaaggggacaggtcccagagagtctcagcaggacagcgagcaagcggacaggtcccagagagtctcagcaggacagcgagcaagcggacaggtcccagagagtctcagcaggacagcgagcaagcggacaggtcccagagaatctcagcaggacagcgagcaagcggacaggtcccagagagtctcagcaggacagcgagcaagccgacaggtcccagagagtctcagcaggacagcgagcaagcggacaggtcccagagtctcagcaagacagcgagcaaggggacaggtcccagagagtctcagcaggacagcgagcaagcggacaggtcccagagagtctcagcaggacagcgagcaaggggacaggtcccagagagtctcagcaggacagcgagcaagcggacaggttccagagagtctcagcaggacagcgagcaagccgacaggtcccagagagtctcagcaggacagcgagcaagcagacaggtcccagagtctcagcaagacagcgagcaaggggacaggtcccagagagtctcagcaggacagcgagcaagcggacaggtcccagagagtgtcagcaggacagcgagcaagcggacaggtcccagagagtctcagcaggacagcgagcaaggggacaggtcccagagagtctcagcaggacagcgagcaagcggacaggtcccagagagtgtcagcaggacagcgagcaagcggacaggtcccagagtctcagcaagacagcgagcaaggggacaggtcccagagagtctcagcaggacagcgagcaagcggacaggtcccagagagtctcagcaggacagcgagcaaggggacaggtcccagagagtctcagcaggacagcgagcaaggggacaggtcccagagagtctcagcaggacagcgagcaagccgacaggtcccagagagtctcagcaggacagcgagcaagcggacaggtcccagagagtctcagcaggacagcgagcaagccgacaggtcccagagagtctcagcaggacagcgagcaagcggacaggtcccagagtctcagcaagacagcgagcaaggggacaggtcccagagagtctcagcaggacagcgagcaagcggacaggtcccagagagtgtcagcaggacagcgagcaagcggacaggtcccagagagtctcagcaggacagcgagcaaggggacaggtcccagagagtctcagcaggacagcgagcaagcggacaggtcccagagagtgtcagcaggacagcgagcaagcggacaggtcccagagagtctcagcaggacagcgagcaagcggacaggtcccagagagtctcagcaggacagcgagcaagcggacaggtcccagagcgtctcagcaggacagcgagcaaggggacaggtcccagagagtgtcagcaggacagcgagcaaggggacaggtcccagagagtctcagcaggacagcgagcaaggggacaggtcccagagagtctcagcaggacagcgagcaaggggacaggtcccagagagtctcagcaggacagcgagcaagcggacaggtcccagagcgtctcagcaggacagcgagcaaggggacaggtcccagagagtgtcagcaggacagcgagcaaggggacaggtcccagagagtctcagcaggacagcgagcaaggggacaggtcccagagagtctcagcaggacagcgagcaaggggacaggtcccagagagtctcagcaggacagcgagcaagccgacaggtcccagagcgtctcagcaggacagcgagcaaggggacaggtcccagagagtctcagcaggacagcgagcaagcggacaggtcccagagagtctcagcaggacagcgagcaagcggacagcaggacagcgagcaagcggacaggtcccagagagtctcagcaggacagcgagcaagcggacaggtcccagagagtctcagcaggacagcgagcaagcggacaggtcccagagagtctcagcaggacagcgagcaaggggacaggtcccagagagtctcagcaggacagcgagcaaggggacaggtcccagagagtctcagcaggacagcgagcaaggggacaggtcccagagagtctcagcaggacagcgagcaagcggacaggtcccagagagtctcagcaggacagcgagcaagccgacaggtcccagagagtctcagcaggacagcaagcaagcggacaggtcccagagtctcagcaagacagcgagcaaggggacaggtcccagagagtctcagcaggacagcgagcaagcggacaggtcccagagagtctcagcaggacagcgagcaagcggacaggtcccagagagtctcagcaggacagcgagcaagccgacaggtcccagagagtctcagcaggacagcgagcaagcggacaggtcccagagtctcagcaagacagcgagcaaggggacaggtcccagagagtgtcagcaggacagcgagcaagcggacaggtcccagagagtctcagcaggacagcgagcaaggggacaggtcccagagagtctcagcaggacagcgagcaagcggacaggtcccagagagtgtcagcaggacagcgagcaagcggacaggtcccagagtctcagcaagacagcgagcaaggggacaggtcccagagagtctcagcaggacagcgagcaagcggacaggtcccagagagtctcagcaggacagcgagcaaggggacaggaaacatcctcatggtcatggccatcagtctgaatccaggcctccacacgccagtgtacttctttctcaccaacctggcccttttagacatcgtctgcacatccatggacaacagcagagtggtggctgtgctgtacacagtggtcagccccaccctgaacccctcacctactccctgcggaacaaggacttatcagagcaatgtgggagcattcaccttgggggtgccgctggccgtgtcttcgtttagtcaggggttcttgcccggggatgggtcgagagtcacatatgcccactgtgcacactgcctggtctatgttgacggggtgggggcatttcttgatatcctgctttggagaaaatcacccaaaccccgactctccaacccaactcctcttggtgtgaggtcaaggaaaacatgagaaatgctctcctccctgtgtgaggtttcgtggtcctggcaccataaagggtgagagatggggttatccagcctttctttttaatgacctgcaggaaatacatggggctttactgatttacttcctttcagagaagggcattctcattctttaatttatgcaccaatcacctacattctgtcattaacttattatctttgtttaattgattatccttgtgtccatcaccaatccatctattttatgcatttcaaagccagttgcaaacatcatttcacttcttaaatacttctgcgtgcatatcattaaacatttgtttatagttatttttccttttaaggtaatattttcaaacaacaaaatgcataaataagggtgtacgtttgctgagtaatgtaattatcaaatcaggtgcccatgtgtgatgatcaaatcgggtacccgtgtgtgatgatcagatccttctgtctaattgtatgtttgtaccccttaacaacctctgttcatccccttcccccacactcttcccagcatctggtaactatcattttaccctctacctccatgagatcaactttttaagctcccacatgccccacctccaacattggggaacaaatttcaacatgagatttggaggggacaaatatctaaactgtattgtcacgtatagaaatgctactgatttttgtatattagaatcctgcaactttactaaatttatcagtactaagagttagaactttcttttcctctaagcactgaaacaaggatgcccccccgacttttcttcattcaataagctgttaactgtgggtttgtcatatatatttattatgttgagttactttgattatatatttaatttattaagagtttttatcatgaaggagatgttgaattttatcaaaacatttttctgcatctattgagatgatcatgtttttttcccttcattctactgatgtatgtatgatgtttgttgatttgtgtaggttgaactatccttgcattcctgggataaagcccacttgagcatggttattgttttttgatgtgttgtttaattcagtttgctagtattttgttgaggatttttgcatctatgtacacaagagatattggcctgtagttttctttttgctgttgttatgtccttgtctggttttggtatcaaagttattctggtcttgaagaatgagttaggaagaattccctctgctttaattttttggaatagtttaagaggaagcagtattaattattctttaaaaattctataggattcagcagtgaagccatccagtactggacttttctttgttgaaggactttttattactgattcaatcttgttacttgtcttggtctgttcaggttttctatttcttcttggtttaatcttgtgtagaaacaatgagttggggaaatttttcaacacatgtggtgccaggcagaatgggggagggggcattgcaaatgtgggtgtctagttctcttaccaactactcagagtgttttcacttctctgtgggcctggaagtggtctcatctttttatttgagttctgggatatttctggtgataatctttgtttttggttttctgtgggagagagtgaaaccagtttgcttctattctacattgccttttgaaactagaaaaaaaacctctcttttttgaagagcttgtgtgcttaggtcaggcttaccaggaaaatctcactgtcttaaggttaactatgccatgtaatgtaacataatcacatgtatgttaaaagtgctacttgaattaataagtgagtttatcaaggtcatataaagtaaaacatacaaaaataaatagtgttttatgtactaataacaaggattggaaattgcaatcaaataaacaccatttgcaattgcatcaaaggcatgaaataaggataaatttagcaaaatgtgtttaagacttaagtactatgatcacagcattgttgctaaaactcaagggagataaaaataagtggagatacacgctatgattgcagagtcaatattgataatatttcagttcttccaaaattgaactagtacctagaaattgacatttgattttaaattttata

SEQ ID NO: 460843 - DNA, 899 bp, Homo sapiens
acgtcgggtgctccggtgagagcgatgttttctaagcatgaccacatgacctcagatgacacctggaggagaaaggctattcttcttaagagtccacactcaccaggcccaggatctccaatcccacctctgccctacacaggtgaatgctatcttctcattgcacagatgaggaaactgaagctcgtgtcaaatagccacacagctgaggaaggacctcggggtcccagagctgtgcacacgctgcccccctggacgtacagaaccagcaggtggcatcgctccacacaggccaccgaacggccctgccccgccccctgccacgccctgtgcgtgcatccgggtccccgcgcagtggctgcacgcagcccacctctcccgacgatccgggtcctcccgcccttcgcggtgattctgtcgcgaaccctctcacggcagctatgagactgctgcgctccccagacgaggaaacctggtctcccggagccagagtcttgctctgtcgcccaggctggagtgcagtggcgcgatctcggctcactacaacctctgcctcccaggttcaagtgattctcctgcctcagcctcctgagtagctgggattacagctctgggacaaaccagcttctatgtcatgagcacactcaggcagctcattggagagatctgcatggtaaagcaatgaggcctcctgccagcagccatgtgagtggcatcttggagccagaccctccagccccagtcaagccttcggatgcctgcagccctggctgacattttaaccacaacttcatgagagattctgagccagaatcacccagctaagctgctcccgggttgccaggtgagaaaaatgaatggttatgattttaaaccgctaggttttggagtcatttgtt

SEQ ID NO: 460844 - DNA, 2090 bp, Homo sapiens
tcaccccagggtgactttgggcaggtgactcctggggctccctgctccataatcagccctcacctcctgccaccccaagcccaacctccctgggctctttgggcttgcgtctcccaggacctggtcccccagccccaggccctgccctcaccagtcatccctgggtggctttgggctggtgactcccggggctacctactgcagactctgccctcccctcctgctgccccaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacatcagcaacaggtatctacggagaaggccgtgcatcctctactaccctggaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggataggctacatgaacaggaggagaggctacgtgaacaggaggagaggctgtgtgaacaggaggagaggctacgtgaacatgaggagaggctgtgtgaacaggaggagaggctatgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggagaagctgttagaacaggagaggcggcaggaggagcaggagaggctgctggagagggagaggctgctggacgaggtggaggagctcctggacgaggtggaggagctcctggagcaggagaggcttcggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtgagctgaaagagactgtaacctccgacccatccaagaagatgtgggaggcgggcaccagcctctggggaggggaggtgccaggccacaggcagctgcagcctggggacagggtcttccggcaggtggagctgaagagccaagaggctccgagtctgcagcagcagccagaccagtacctggagccccagtcccacaaggagcttggatgtgcggacaagcagggtggactccccaggagcacccaggcttgggtggagaagctgttggtacaggagaggcggcaggaggagcaggagaggctgcatgccattcttttcgggctgccgagaacagggagctaaacatcaccatcatctaagagcgggtcaaggaattaaaaaaaaacaacaaaacgtttaaggggttaatatcctacacaattcatttacttcatttgaatgttagagccacttatgtttatttgtgtttctaatttaaatttatttgtttctaatttatagtttaaatttatttgtaaaaagttaaatgagagtgggtctttctctcatgttcactctggcatcctttagcattttttaaatttgataattataggacgttagcatgcatatcgagtttgcccttatgtggtgggagttcaaacacacaaagac

SEQ ID NO: 460845 - DNA, 1194 bp, Homo sapiens
ggtcagcgggtgacattgcattaatttgctctggtgatgatttctgctttgctagggagattgggaatggaatacaaagcccagggcctggcattgggctccagttcctgcctttcctaccactcaccattcaataccatctctaatgccttcttcccaaagacagtcgctcctccccacccagcgccatgcattctcatgccatattactgagctttgatcaaaatcaaccattcctttccaaaattcagaagcttccacaacaagtgtatacatacacaaccattaaaagtggccgttaccacgatgcattctgggaaagaagcagcaccaaatccaagatggcggccagcaggaggctgatgaaggagcttgaagaaatccgcaaatgtggaatggaaaacttccgtaacatccaggttgatgaagctaatttattgacttggcaagggcttattgttcctgacaaccctccgtataataagggggccttcagaatcgaaatcaactttccagcagagtacccattcaaaccaccgaggatcacatttaaaacaaagatctatcacccgaacatcgacgaaaaggggcaggtctgtctgccagtaattagtgctgaaaactggaagccagcaaccaaaaccgaccaagtaatccagtccctcatagcactggtgaatgacccgcagcccgagcacccgcttcgggctgacctagctgaagaatactctaacgaccgtaaaaaattctgtaagaatgctgaagagtttacaaagaaatatggggaaaagcgacctgtggactaaaatgtgccacgattggttccagcaagtgtgagcagagaccccgtgcagtacattcagacaccccgcaaagcaggactctgtggaaattgatacgtgccaccgtctggcgttcgcttgcagcagttactaactttctacagttttcttaattaaaagtggtctaggtaacctgtaaagaaaggattaaaaatttaagatgttcttaaaaaaaaaaaaagtggccattaatagacggaactatacactggactagttgttgttttaaaaacataaaatctggctaccctaacgggataagagttcagacatcaggatgttgacacagtgtcctaccagaacccagggtttacttagagaacataaaagaaaagagattgtatgctatatt

SEQ ID NO: 460846 - DNA, 1095 bp, Homo sapiens
ggacatgggcagccgcggcgcgcccaccccccgcgccggtaaaatcaaaacccaatcgtggcaggcagcagcaaattaactgaacccaccttctctcccgagcaccagagcctgagtgaacaacttgccgcagaagagccttctctagtgtcctccaccgtctcaccagagtagggatgctcttccgcttctccttagtgctgcctccaaaccaatgcaccatcaccaaccaagtctcctctcggaagccctgaaggtgtctgcgtttgctgactggttgtcaccccctgccccacttcagaacgcgtttgtgaagaagacattctctctggatgaagcaactacagaagtgcagaattccctttatgaatgtgatagaatggaggggaaagaatgcaagtcttgctaagtggactcaaggccattttcacaaagagcactgaaaatatctgctctgggaccccatggagggacttgcagttttcctggaacctcgagtttttggaatactgtgctggcatcactccagaatcactggacctgtacaacatgctgattccctgatgcacaggcgatccaggcttcattcccagctttgatgagagcaccagcctcaagccttgttctgtgcccacaaggaaatgaaagtaaaaattgatagcaaacttcttttaactaaaccatagtctttaaagcccagaatcaggcttgtttcttggttttggtagctgtaaatgagcaatttatgctttttgttgttattgtcattcactggttcattcttttcttcaagaaggttttatttaaatttgtgtaattgtgaaaatagcacacttgttaaagtattttgaaaataaggaaaagcagaataaaaatgtacccagtgccactatttacatttcagtttatttctttccactgttttaaaagatatgactatactaatacttctagtcctagaatccttgcctcaccctctccaagatggttgtaggatttctgggttgctgaggtaatgtacagttgaaaaaatgtcaagatgtgtcaggtaagctatatctgctgttggcctaaggacagatattttggtgtaag

SEQ ID NO: 460847 - DNA, 1175 bp, Homo sapiens
ggacatgggcagccgcggcgcgcccaccccccgcgccggtaaaatcaaaacccaatcgtggcaggcagcagcaaattaactgaacccaccttctctcccgagcaccagagcctgagtgaacaacttgccgcagaagagccttctctagtgtcctccaccgtctcaccagagtagggatgctcttccgcttctccttagtgctgcctccaaaccaatgcaccatcaccaaccaagtctcctctcggaagaacgcgtttgtgaagaagacattctctctggatgaagcaactacagaagtgcagattggccgcctcccttcagttatgcagaaatctctgcactggctggaagagcactgtcaaatgttgtaagcattctaaagttcacctttgtgggtcagaaacacatcacccctcacccttctacctccaacagaattccctttatgaatgtgatagaatggaggggaaagaatgcaagtcttgctaagtggactcaaggccattttcacaaagagcactgaaaatatctgctctgggaccccatggagggacttgcagttttcctggaacctcgagtttttggaatactgtgctggcatcactccagaatcactggacctgtacaacatgctgattccctgatgcacaggcgatccaggcttcattcccagctttgatgagagcaccagcctcaagccttgttctgtgcccacaaggaaatgaaagtaaaaattgatagcaaacttcttttaactaaaccatagtctttaaagcccagaatcaggcttgtttcttggttttggtagctgtaaatgagcaatttatgctttttgttgttattgtcattcactggttcattcttttcttcaagaaggttttatttaaatttgtgtaattgtgaaaatagcacacttgttaaagtattttgaaaataaggaaaagcagaataaaaatgtacccagtgccactatttacatttcagtttatttctttccactgttttaaaagatatgactatactaatacttctagtcctagaatccttgcctcaccctctccaagatggttgtaggatttctgggttgctgaggtaatgtacagttgaaaaaatgtcaagatgtgtcaggtaagctatatctgctgttggcctaaggacagatattttggtgtaag

SEQ ID NO: 460848 - DNA, 1228 bp, Homo sapiens
ggacatgggcagccgcggcgcgcccaccccccgcgccggtaaaatcaaaacccaatcgtggcaggcagcagcaaattaactgaacccaccttctctcccgagcaccagagcctgagtgaacaacttgccgcagaagagccttctctagtgtcctccaccgtctcaccagagtagggatgctcttccgcttctccttagtgctgcctccaaaccaatgcaccatcaccaaccaagtctcctctcggaagccctgaaggtgtctgcgtttgctgactggttgtcaccccctgccccacttcagaacgcgtttgtgaagaagacattctctctggatgaagcaactacagaagtgcagattggccgcctcccttcagttatgcagaaatctctgcactggctggaagagcactgtcaaatgttgtaagcattctaaagttcacctttgtgggtcagaaacacatcacccctcacccttctacctccaacagaattccctttatgaatgtgatagaatggaggggaaagaatgcaagtcttgctaagtggactcaaggccattttcacaaagagcactgaaaatatctgctctgggaccccatggagggacttgcagttttcctggaacctcgagtttttggaatactgtgctggcatcactccagaatcactggacctgtacaacatgctgattccctgatgcacaggcgatccaggcttcattcccagctttgatgagagcaccagcctcaagccttgttctgtgcccacaaggaaatgaaagtaaaaattgatagcaaacttcttttaactaaaccatagtctttaaagcccagaatcaggcttgtttcttggttttggtagctgtaaatgagcaatttatgctttttgttgttattgtcattcactggttcattcttttcttcaagaaggttttatttaaatttgtgtaattgtgaaaatagcacacttgttaaagtattttgaaaataaggaaaagcagaataaaaatgtacccagtgccactatttacatttcagtttatttctttccactgttttaaaagatatgactatactaatacttctagtcctagaatccttgcctcaccctctccaagatggttgtaggatttctgggttgctgaggtaatgtacagttgaaaaaatgtcaagatgtgtcaggtaagctatatctgctgttggcctaaggacagatattttggtgtaag

SEQ ID NO: 460849 - DNA, 1070 bp, Homo sapiens
ggacatgggcagccgcggcgcgcccaccccccgcgccggtaaaatcaaaacccaatcgtggcaggcagcagcaaattaactgaacccaccttctctcccgagcaccagagcctgagtgaacaacttgccgcagaagagccttctctagtgtcctccaccgtctcaccagagtagggatgctcttccgcttctccttagtgctgcctccaaaccaatgcaccatcaccaaccaagtctcctctcggaagaacgcgtttgtgaagaagacattctctctggatgaagcaactacagaagtgcaggcaagacattgtgctgccgtcgctgagtgtggcttaaataaaaaacatgtttatgtgggagagaatgtgtgggggttgctttcgcattatggaattcttaaaattgttgaaccgggaagatgttattcagaaacccctggtggcttcagcttgctttttgtgtatttcaggtttcttttttcccccatttttaattatctctggaaaaactcaagagtcctcccctgctcctaaaatagttataaaattaatgtgctgtactcaagtcgttactccacgtaaaagagtaaaagactcccatattaagcagagaatgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgagtctgttcccaatccaggtgctaccttcctgaacagttgggataggcaggcaggaaagcctggggagccagcaggatcccatggttaggagtctcaggaggagggtccaggctcactgcttcgcaccctataactaagccagtctcctgccccatggaggggtggacaggttgtaggggcgggctc

SEQ ID NO: 460850 - DNA, 1305 bp, Homo sapiens
ggaaccagacaaattacgcactgccaaaatacaacattgggacaggcataagataaatgttcccattccgaaagggagaactcagaagaaagaaaggagtgacagaccccaagcaagtccaaaacctagcaaggcaaatcctattagatcttaaggctcaggaattatcctctttggctcaatgtcccatcttccaggctcactggggtggaagcatcactccaatagctccaggcaggggccctgcccctgtggttcttgcagaccctgggtcttgtcagaaggctgtgtccccaaggctcctctggatggtcctcctgcaaagcttcaggctccgaggggaaaagaaacagctctcaaagctcagacgtcatggtaacactgggaaaagcccagcttttccagcagacaccgaagagccaatgataccaggagaaaaccagaagtgaatgggcatcttgtgttttattgagacacagaggacaggcaccttctgcctgaccccacccagagctgcggaaataacgaaaatataggggtttggactcaaccaggcctggactgagtcctggctccagctctttcttgccatgcaaccttggttaaattaacttttaaagcttgagttttcttacctgcaaaggggagaaaatatagtactactttctagggctgttaagagaattaagtaaaaaatccatgtaaagcacttagcatggcacgttatgcattgttctaagtgttctaagaacactacttagaaaatgttagcattgttattgctatagtatcaagggtagcgtggataccagacgttttgtgttcagttgtgagaaaagactatttaaggtaatacgctcctgaatgtgctaaaatcaaataccgcagctggaccagattaactcaggacaccaccagtggactagaattgcaatgaccccacacgatcttacctgctcctcagaccacagccaaggaagagatttctgacaaacaagcaaaaacacaacactgtccacacaactgtaaatatgcaaggaagagtttcttcttgcctgaaaactgcctttggacttggactagaatttcaccactggggctcttggatctcgagtctgtagagggcagatcgtgggatttttcagcctccaaaatcatgtgagccaattcctcataataaatctccttctatatctatgtcccagtggttctgtttctctggagaactctgactagttcaggaagagaatgattttggtttggcagctgctgagaaatgaggcataagcccaggtgagaacaggt

SEQ ID NO: 460851 - DNA, 880 bp, Homo sapiens
cactactgcacatattatattgaatatgaggcactatgttctagcaagagatcagacagagaccatccaggaagaacatggcttgaatgatagacagcttaattgtcatgagacacagaagtcaggcagaatgtactggtgcttatccacgactgaggaagggagaagacagacgatgattgcactgactcgaaagaataagtggaaaaacgatgctactggatgtctgattttgacttttcttggtctattagtcgtctcctcttccgcatcaaacagtgaaacatctttagtgtcatcattactatcctgctgcaacatggcggccctacgccagccttacttccgggagccacgtcagcgcagcagcgtacgggtccgggtcggaactcagaatctagctctttcttaaaggctgtatctaacatatggatgtattattcatatacttaagctaccaggttttttgctattacaaataatgctataatgaatatcctcattcattttgggggcatcctttgatgatatacctataaattaaatttctaataatggaacacgcccttaaaactttgataaggtcactttgccttccaaatggttgtgccaatctgtagtccagcttacaaggtgatggaatcaggataaccacagcagccccacgaacactttcctggttattctatcccaggaaataaacatcctcctgtgaaatagtatttaccaattagaagcagcaatcagaaaaggaagagcagcctgaagtggcagatgataaaaatcaaacaataaataacaatttgagtaatctagtaatgacccagcaatcattctgtgcatggacaacaatcttacataccttaacagtgcttcgggg

SEQ ID NO: 460852 - DNA, 439 bp, Homo sapiens
gattactagtttgaatctgacaatgtacttacttttaccagtaagttttttatttttgtatttttatcgtatcaattagtatccttttaatccagcttgaagaattcctagaatttcttgtaaggcacatctaatggtgatatccttcctcgacttttgtttgtttgagaaagtcttattcttgccttcatttttgaaagatagtattactaggtatggtattcttgggcagtaatttttttttcttttaggattttgaatatatcatccagctccttcctggcctataaagtttctggaaaaagaaaatccatggatatcttacacggtgggcatcccttttgtgtaactatttgctgtcccttgttgctttcaaaattctctctttgtctaaatttttaacaatttgattataatatgtctcaaatgtgtgtctctg

SEQ ID NO: 460853 - DNA, 508 bp, Homo sapiens
gcggccgcctactactactaaattcgcggccgcgtcgacacaggttcctgctgttttatcaagggctgatttacctgacgactcatttcagttttgggtgaacaggttcctgctattttatcgagggctgatttacctgacgactcatctcactcttgctgcttccaggactcccagtttccctttgattgtttgactacagtgtgtgcagatgggagttcccctgcacaagctctcttacctaccaccatgtgagatgtgactttgctcctccatcgccttccaccatgaccatgaggcttccgcagccatgtgaaactgattttgaatatatcatccagctccttcctggcctataaagtttctggaaaaagaaaatccatggatatcttacacggtgggcatcccttttgtgtaactatttgctgtcccttgttgctttcaaaattctctctttgtctaaatttttaacaatttgattataatatgtctcaaatgtgtgtctctg

SEQ ID NO: 460854 - DNA, 3690 bp, Homo sapiens
cacctatctctgtaagtcagttttgtgggagtgggacggttaggtcactggatatgtggatttacaatgttaatagagggcgcggggctctgtgctgtgtcctgtctcctgtcagccggctctgcccgcacgctgagctgcggttatggctccgggagcaaacaacccggaagtggcagcgcggctgggcggagggcgccctcctggttccgctggggctgcggctccctgaggccccgaggggaccccgctcacccgggccccgcccaccagagggcgccagagagaagccaccggggaggcgcctgcgctgtttccctgagcctcctggtaccccgtttgagacacaggaaaaaacgcgtgaaaggcttctgtaaattatcaagtgtggtgacgtatgaaccccaggcagcccactcccaaccccaaacaacatctcattcaagctgcgtctaccagaagctcgcacatccaactgcctccctccagaggtagccgctgtcccgaattttgctttgaatgttccctgtgattttcttttttatactgtgtaattggatttttaaagggatttcataacatttatattcccggaggcttgaatttttttgctcatcgtttttcgttaccacgtagtgaggtgttgctgcagttcctcgactttgtgactccacagatacgaatatgtggcactttgtttaaccactgtcctctaatgccctcttgtgaggagcaatacctcgagtcccaccaccgttttttatttcaagagtgccttgcatacaaattttaagactcagttagttaaatttcctcaaaaagtcttttgagattttgattagaatcacataaactctgtgaattaaatatctttaaaatactgatttttcctatccatgatgtggaatctgtttccatttatttaggccattttaaaatgttttcaataaattttataattttccgcatgtaaattgtacacatttttgttaaccttactcttagttaacgttgagttttctaagcagagttcttgataaattatgttttccaactatttattgctagtgtatagcaatacaaatgatttttgcttattgatcctagaggcagcccccttcctaaactctcttatttccaataatttctgtgcagattcttttgtggtttctcagtagaccatcctgtcgtctgtgaccaatgagagttttgctttatatctttcaatccttattcctgtaatttctttttcttgtcttattgcacaaacagatcctcagtacactgttgccttgatttttattttaatgggaaacatctcagaagttctctaagaggacgctcagtagccattgcccctttatgaatgatgtttattgtaaggttttgataggtatactttttgagtttaaggaaattaccttttatttctagtctactaagaatttttaagttaataatagatgttgaattgtattaaatgcttcttttgaaatgttcagatgattttcccctttaatttgtgaaagtggtgaataaatgtatggaataaacacagtttggtcctgacagtttgtctttttaatgtattgacggatttgcacccagaggaagggctggctggcagctgcatttggtttactcacaggttgttttggatttttgcatctatgttcagtatgaggctggcccatagttttctcttctgtctttctctgtgttgaatatcaaaattatccaggctccaaagaatgatttgatgaccattcattcatatttgatccttttgaagagtttatgtaagattgaaatgatctaacagctttagaagaactcacttttgaaaccatatggtatttttacttgtgaaaacatttagaattaataattcaatgtatttaagagtagcataactggtcaggctctacacttcttgaattgattacgaaaactacattttttctaggaattgtgatttcttgtaagctgtcaaatttattcacataaatttgttttagtattgtcttatgtttacagtcatggttgtatttatcattatgttcctttgacatcccaaacattgtttatttgtgcttttttgtgcttaagtagtctcagaagcagtttctctactttattaatctttttcaaatagcaagccttggttgtgttcctctctatttcctcattattttgtatttcatgatttctgcccttctttgggtccagtatgctgcttagtttcagttggacatttggcttattaattttcagtccgtctttcttagtacaaggacttatgattatatatttacctgtaagatcttctgttactgcttccccaagtgctgatatttaacggttccattattcactgagctctgtgtgctttcttaatctccatcccttgattcatgattcatgtgcaaatggggtatttttcaaaatatatagaaattattttttaattagagaaaatttcaaatgtgaaaaaacagtgagagaaagataaagcacccccacatagctaacactcaaattcaacaatggtcaaaatgcagttaattttgttgcatctttagagttaagaccttactctctctaatctctctcaaactacttacaatgccaataccacagctaaaaataaaataattttatgaagattgttagtttatacttttactgatgtctaatttaattccattgttgtcagagaatgtggtgtgtatataagttttgtacagtttactgaacttactgtatggcctagcacagtgctccctagagtgtgcactgtttgttgaaaagactaccctttgtccatcaagttgctactgcacctatgtaaaaacagatgggagttcccctgcacaagctctcttacctaccaccatgtgagatgtgactttgctcctccatcgccttccaccatgaccatgaggcttccgcagccatgtgaaactgattttgaatatatcatccagctccttcctggcctataaagtttctggaaaaagaaaatccatggatatcttacacgagagacatggaatcatgattggagcgatgtccaccagatgtcaaaatagagttctggattcttgttttgtatcaactttaatgagatataatttccatataataaaatgtacatatttgtgtataatttgataagttctcaaaagcttatacacccatgtaaacacctccacatcatgatacagaacgtttcaattaccctaacaagctcttctctgcccttttgatacaaatccttcatctcagccccaagcaatcactattctctcactttacattagttctcttattgtgcagttttatataaatggaattatacaatatgaacttattttgtatctatcttcttttgctaatctaaacacttttcagattcatccatgttggtgcatggatgaatgcatgctaagtcctattccattatatagatgtatcacattcatataattatactccattatatagattgctaaatcctattccattatatagatatatcacaattgttttgtccatcatctattgatggatatttgtcttaattttagctttagattaatttggataaagttggggtaagcataaatacataggcctttgtgttgatatatgtttttcaagctcttatataaatccctaggagtatac

SEQ ID NO: 460855 - DNA, 1684 bp, Homo sapiens
atttaaagtatgagagttagaataaactttcaaaaaaacaaagtatccaaaaatatatttggaggagaagaggtagaaatgaaaaaatggatgaaacagagctctgccatggcagccgagggacttgagcaccacattgaaagggccgctggccttacacaggtctctggggccacaactgatagaaaggatggtcagaatacccaatatttgcgaatctgtaagtggccttttctaaaaaagaaagaaatgctttacagaacaacagatgacacgagatgtccctgctggggagaaaaacttgatgatcccattggcaaaccagctcctgagatttgtatcaaggcctctgcatctcacagctaccttgtgtctcctctattgaaaagctgctgggactttcagagacattctactaatggcaagttctgagtgccatcatgaagaatttcaggaagagacgtgatttgaccttagtgttttaaatgggcatggtcctgctgtcaagttcagcaaaacagcagctactgctgtctgatgtactctgaaagcctgatcagtcagatcagccattagagacctgacctcatggacccagttgcagggttggctggatgatgggctgatatgaggacaactgctccatcgtgctcagcgctgctgggttgtactgcatgaggagccaagctcagttttatttccctgcctctttgcaaacaattattctagcaacatgcactaggcatacagaaaataatatgaaatggattctgatgttttttgtgcttggattagtttgcttcactgtagcccttgaactcttgaaacagaagtatcaagaacctgctattctcttagtgggctctgaccatgtggtgccccagaagttatctccaaatatacttcaaaatatcaggcagaggtttcctgtctaaagttaccatgtgccatatacctgttaaggtgtccaccagcggcatctttctgatgatgaccctgaatgttcacaatgatgcttgagagagggtaaaagaggcaaaatatgctggtgaatatattgagtgtcttttgggaactttgttcttttcactggatcatctttagagccttcagtgaactagctcaccttctacaatttgtttattacatgcacattagccacaacatctggcagaattgagcctagtatacttccttctttgtaactgaaaggatcccagaacaaagtgccatgtttagggtctggatatgtgaacaataggcattctcaagagcaccctcagttctctcctgggcatcaacaagaaaccctcgcagtgaagattgaatgacatcaagtgcagtagctccatggacttcatgacactcaggggaacttaggcttttgttttgttggactgtcttttgtttttcagcgtgtgtgttcattggaaattcagagataagccatttgtgaaccagggatctagaaaacttgtcatcagatgacgcatctattttaggggctgccgagctccaggtggcctgattgcttgtctcaggctccccccaccactggaactccatgcttatagtctcagctaatgtggaacacggtgggtgtctatcctgaaggtgggttccttctgggatgccacctgtgcaaccagaaggaaaactaacaaccagaaaggacatctacacc

SEQ ID NO: 460856 - DNA, 1448 bp, Homo sapiens
tccccttcgccttttgccatgattaacaacagatgacacgagatgtccctgctggggagaaaaacttgatgatcccattggcaaaccagctcctgagatttgtatcaaggcctctgcatctcacagctaccttgtgtctcctctattgaaaagctgctgggactttcagagacattctactaatggcaagttctgagtgccatcatgaagaatttcaggaagagacgtgatttgaccttagtgttttaaatgggcatggtcctgctgtcaagttcagcaaaacagcagctactgctgtctgatgtactctgaaagcctgatcagtcagatcagccattagagacctgacctcatggacccagttgcagggttggctggatgatgggctgatatgaggacaactgctccatcgtgctcagcgctgctgggttgtactgcatgaggagccaagctcagttttatttccctgcctctttgcaaacaattattctagcaacatgcactaggcatacagaaaataatatgaaatggattctgatgttttttgtgcttggattagtttgcttcactgtagcccttgaactcttgaaacagaagtatcaagaacctgctattctcttagtgggctctgaccatgtggtgccccagaagttatctccaaatatacttcaaaatatcaggcagaggtttcctgtctaaagttaccatgtgccatatacctgttaaggtgtccaccagcggcatctttctgatgatgaccctgaatgttcacaatgatgcttgagagagggtaaaagaggcaaaatatgctggtgaatatattgagtgtcttttgggaactttgttcttttcactggatcatctttagagccttcagtgaactagctcaccttctacaatttgtttattacatgcacattagccacaacatctggcagaattgagcctagtatacttccttctttgtaactgaaaggatcccagaacaaagtgccatgtttagggtctggatatgtgaacaataggcattctcaagagcaccctcagttctctcctgggcatcaacaagaaaccctcgcagtgaagattgaatgacatcaagtgcagtagctccatggacttcatgacactcaggggaacttaggcttttgttttgttggactgtcttttgtttttcagcgtgtgtgttcattggaaattcagagataagccatttgtgaaccagggatctagaaaacttgtcatcagatgacgcatctattttaggggctgccgagctccaggtggcctgattgcttgtctcaggctccccccaccactggaactccatgcttatagtctcagctaatgtggaacacggtgggtgtctatcctgaaggtgggttccttctgggatgccacctgtgcaaccagaaggaaaactaacaaccagaaaggacatctacacc

SEQ ID NO: 460857 - DNA, 832 bp, Homo sapiens
agaaagtaagatccaggaggagaaggaccttatctgttttttgttctttgccacctgaaaacatgttcccaagcatggaaaagtcatgtgaccatttgaaatttgggccagcgctcctgtgcctgtactttcaggtggccctgccgattggagggtttgaggcttggagaaaacatggcagcaaaggctggtggggaagccagaggcttggaggcaaaagccctgggtccttcgctctcagctgtgaccctgggcaggctctggaattgggctgggtctcaagtgaaatgggaagtgggagctctatggaagacactgtccagggcgccaggggaggcacagttacacaaggaagatccccagccgtgggagcctttgctctactcattgaatcctgggtactcaagggaatacttggagtgttctggtgaagtggggttttctggtcttctagctggtctctttgttcagctcaataaaggtgtttatgtagcacctatcatgttttagtcatgttactagatgctgtcaatatcaaggggggaagatggggcacttgcctgagagcagcaattttcacactttctgatttctgaacttcattactctctagctctatttcccgaaacagaaaaaaaattgagaagagtgatattgttttatgtaatttcgcaaatgtagaaaatatttcacaagtctttttaatgcctaggttaataaaagacagatggattcacatacctgcttcaccagtggtctccagataatgctggaggggtagagcaatgggtattaatgcagggaaaacgtacttgcctttgggggcattttt

SEQ ID NO: 460858 - DNA, 1001 bp, Homo sapiens
  misc_feature (809)..(810): n is a, c, g, or t
  misc_feature (823)..(823): n is a, c, g, or t
agccggctcgggaaagaatcccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgtgccacgtcagcagtgtgcccgtcttcaacagcatgcagcagcctgaagtgaagacctggggtggagtggtgacagctgccatggtcatagccctcgctgtctacatggggacagatggtgggtgcatggtacagtacggaatctcttggtcaccctgggagcttcatcttcnngccagaacacagncaaacgcaatctatgtgcgatctcctgggcataaacaactgtctcccaagggaaacaaaaaggactttggcattggtcgcaaggaaacccattctttagagctatgaggagcattcttaagtcacgatcattcaatgagtggatgaaatccggaatcatttcccggaatggagaaaat

SEQ ID NO: 460859 - DNA, 2303 bp, Homo sapiens
agccggctcgggaaagaatcccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcggtgagcccccttccactccccagggcccctcctagcccctgtgagcgcttccaacatggtcctttggccttgtgtggaccccatcctgtagaaggagaaactgaagcctgtagaaaagagtcggtgcctaggatgggtccctacatatcccaggccaggtgtcagaagcgccctttgtcctggggtcaccagaacattccgtgagtcctgtaagaatctctatccatggcatggcacggtggctcacgtctctaaacccagcactttgggaggctgaggcagaaggatcgcttgagcctgggagttcaagaccacctgggcaacctagtgagaccccatctctacacaaaataaaataaatagccaggtgtggtgggatgcacctgtggtcccagctactcagccacttgggaggctgaggcagaaggatggctggagcccaggagttcaaggctgcagtgagccaagattgcaccactgcactccagcctgggtgagagagccagaccctgtctcaaaaaaacaaaaaacaaaagaatctctatccagatcctttcctgagctttcacatggacaccctcccctttggatgccccagacagttccttttaaggaaaaaacaatatcagtttccatgtgatgtaaagcaaagtgctaagctctcgacattcaccgtctctagtccctgtggtaaacagagtgctggtggcccattttacagaagaggaaactgagggtcaggaatggggctttccccgcagtctacccagttaggggtctggctcctgtgagctagaggtggggagctgctagcagcaggggcacctctaagcccttctccatgtgggcagggcggtggtggaaggcctgtggctgcgctaccagggggtgccagtggaggaggac

SEQ ID NO: 460860 - DNA, 1517 bp, Homo sapiens
tccccccaccgcccctgttcttccctttctggctgcagcctctttgcacagtgccaagctccctgcagagagagccctggtgtcacagctccaagggtacagggggtggatccatgggtaactgtccatgccagcgacccctgctatagtccagctgcttgaagctgtgagattgctgtggggctctgaggggtgggggtcagtctgggtaaccagggaagcggaatctgctcagatgtttggctgtccaggagtcccagagctggctttttccagggctctgagacccacagctttacatcaattgttccctctcaatctagactttgctcacctctgaatgtagcttatctctgtgcagaactgaccccggggctgtggcaacatctcccttgactcattattctgctaggctctagtacattatttactagcatgaggcatattccgtcagggccagttgaatgcctgcatgaatgcttcttgttcacagcatggtatgatcaggcggcacccaacacaacatgtacaatgatcaagcaggtcagtgaccctgtgcagctctcgagcatgtgcccctgcactggccgggagcagctgaagagtgcctgtgtgatccagaagccaatgacctgggactctctctctggaccacctgttcagagcatgcatgcaggctcaaagaataataggaggaagagctttatagctgaaccgggccgagaaattgtacgtgtgacactgaaacgtgacccacatcgtggttttggccaagctgaccctggcatttttatatcttctattatacctggaggaccagcagaaaaagcaaaaacgatcaaaccaggagggcagatactagccctgaatcacatcagtctggagggcttcacattcaacatggctgttaggatgatccagaattcccctgacaacatagaattaattatttctcagtcaaaaggagtacatgattactgtgaggtactagaccttgaagtccacgtaggtcttctatattgctttcctcatggtgttggcttgcaaagaagcagtgtagtggcacaaattaataagctttgcaatttcaggggcagaatgggcgttaccatgcttgtcttgctgaaagggagtaacctactctaattttgttagacacggctggatacaaccagtctttttttttctgtcaactctccttgcatggcagggaggacctttttattgccacccaaagtccttgttgatagggtcggctccaggatttctatattttgtatagaatcctatacaaaatttctatattttgtataggtatagcaatcagctggggaggagacaagcactgttctttgttaatcttttgttttgggtttagggctacatgtgtagtttcctgagaccaatgctgctttttggttgggtgatcctgtaaactaacagcagaccgcctgcaaattcaggctcatgattgcttcttcacacttgaggggtgttgtacagttttcccttgtata

SEQ ID NO: 460861 - DNA, 3565 bp, Homo sapiens
gtgggtcccggtgaccgtgctccccggctgcgtgggctgcaggaccgtcgcggcgctggcgtcctggaccgtgcgcgatgtgaaggaacgtatcttcgcggagactggcttcccggtgtcggagcagcggctgtggcgcggcggccgcgaggtaggcggtggccgggggcgctgggctgggctccgccacgcggaggaacggcgggcgtcgagggcccggggtgggcgacgcaggtttccgcgggcggcgcgaatgactccggcagcgtggccgcctttatctgactggatcaagattggagatctgacttccaaaaattgtcatctttttgtaaaccttcaatcaaaaggcttaaaagggggaggtcgatttggtcagacaacgccaccacttgttgattttctcaaggacattttgagaagatatccagaaggaggacagattcttaaggaattaattcagaatgcagaagatgctggggcgacagaagttaaatttttatatgatgaaactcaatacggaacagagactctttggtcaaaagatatggcgccatatcaggggccagctctctatgtgtacaacaacgcggttttcaccccagaggactggcacggcattcaagaaatagcaagaagcaggaaaaaggatgatcctctgaaggtcggaagatttggaattgggtttaattctgtctatcatataacagatgttccttgtatctttagtggtgaccaaatcgggatgctagatcctcatcaaacactttttggcccacatgaatcaggccaatgttggaatctcaaagatgacagcaaagaaattagtgaactttcagaccagtttgcaccatttgttggcatttttggaagcaccaaggaaacatttataaacggcaattttccaggaacatttttccgtttccctcttcgcctacaaccttcacaacttagtagtaacctctacaataagcagaaggttcttgagttgtttgagtcttttagggcagatgcagacacagtgctgctctttctgaaaagtgtgcaggatgtttccttatatgtccgagaggctgacggaacagagaaactggtgtttagagtgacttcgagtgagagtaaggcactgaaacatgagcggccgaattctataaagattctgggaactgctataagtaactattgtaaaaagactccaagcaataacatcacctgtgtaacatatcacgtaaatattgttttagaagaggagagtactaaggatgcacagaaaacatcttggttggtgtgtaacagtgtgggtgggcgagggatcagtagtaagcttgactctttagctgatgaactgaaatttgtcccaatcattggaatagccatgcctttatcaagcagagatgatgaagcaaaaggagcaacgtctgatttctcaggaaaagcattttgtttccttcctttaccacctggtgaggaaagcagcacaggcctcccagttcacatcagtgggttctttggccttactgataaccgcaggagcataaaatggagagagctggaccagtggagagacccggcagccttatggaatgagtttcttgtcatgaatgttgtccccaaagcttatgctactctgatcttagattcaataaaacgtctggagatggaaaagagctctgatttccccttgtcagttgatgttatctataagctttggccggaggcgagcaaagtcaaggtgcactggcaaccggtgttagagcctctattcagcgagctgttgcagaatgcagtgatttattcaattagctgtgactgggtcaggttggagcaggtgtacttctcagaacttgatgaaaatttagaatacacaaaaactgtgctcaactacctccagagctcagggaagcagattgccaaggtaccagggaatgtggatgctgctgttcagctcacagctgcctctggcacaacacctgtgaggaaggtgacgcccgcgtgggtgcggcaggtgctgcggaagtgtgcacacctgggctgtgctgaagaaaagcttcaccttctagaatttgtgctttctgaccaagcctacagtgagctgcttgggctggagctgctccctttacaaaatggcaattttgtccccttctcctcatctgtatcagaccaagatgtcatttatattacctcagcagaatatccaaggtcccttttcccaagtcttgaaggaagatttattttggataacttgaaacctcaccttgtggctgctttaaaggaagctgcccaaacccgaggtattatagtttagtattcttttaaataaacttctatataaaaatacaagttttttaaaagttttctgttattcattttagacctataaatcaacaatttcttatggctcaagctaataaactttttgtgttttaagatatttcagttgccagaatggcatctaagagatgctgtctaaaagaatccagaggtgataagtgtaaaaatctctcctgtcatggtgtgatggtgtagtcaacatcttatacctgcatggtgctttacagttttccagtgctttcccatttcttttttcatttgagcctcccagcataacttgtagcttgtttggtaatgacagtgattattaaatttcacagaagaggagagagaaaggttaagatcaagaccaccagccaagtgccgagaggtcaggtcttccacttgccctgtccttgctctatttctgacaccactgcccctccatggttttatgtagttatgatgctgggtttgcattaggcttgatcagcttctgggaagtgtggacaaatccaattaactctgtaacaggggcaggaaaagggtcttgcgggggtcttaaagtgatgggtgtctgataggtgtccttttaggaaaagacagtaattttgggaaaacagtcaacatggttctaattttaatactacctttcaacttctgcaagcatccttttccttgtgaaactgttacctgagctttttctaagtgagatgttgtcctgaaaagttctgggtttgtcctgctgttcacattgtcaagcatactctgtgatgtgtcttttatggaatgtacttttttcttgtccaggataatggcttagggaaagttgctaatcattgtacacctttattcattaaaatataagtgaaatgagttggaatgggagaggcaagttaggttggagttaaagtgagagtaaaagaaaatgagtaggcaaatgttgtttcccatcagggatttgcatctatgagttggtagctgtgagactgacttttcaaacgtctgagttactcatttaattgtaattgtcatcttcaaaacaacctttttgaaagtctaagcctggattcctataagcctgccaatctttgctctaacgatttggaactcctttttttttaatgttgtattatatttttgttaaaattttgtgttgaaatataagatgcatatagaacagtgcacatatcataaatgtaggcttagtgaaattttaccatctgaacatacccatgtaaacctagatcagaac

SEQ ID NO: 460862 - DNA, 3355 bp, Homo sapiens
gggttttagccaaatgcctcgacatcgccgcgcctccgcctcctcgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgagggcgtaaaagcggcttgcattcaattagcagcgaagctcgcgggcgctggcgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgctctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcgacggtgggcgatatctatgtccctccattcccgtcgcgattatctgcgaaatccaccccgcagcccgccccaccgtgggctctggagccagaggaaacgagcgaagactttggaaacctcgcgcgccgcaggaccgcgcgccccttggcggctgagcctgtggacttggtcgcgggccaatttcgttgtccgtgtgttgggctttccggagctggaaagcgccggaggcggaggaagctgactgtggcctcccgggccgcggctctctggagggctcgcgccctagttcgcacaaagcctgctcgtgactgtgcgactaattgggggccctcctcgagaccctctaggatcctgagtgccactagggcaggtggagaggaggtgaaagctctgcccctctttgtccagggccacgtatcctaatggatgagcaaatactactcagctagaccttgtgccttctgggcttggccaggcccaaaggctccaaccacaggtttataatgagaaaacagtcccatactttatctctgattccagttcctagtgctttcccttccactttgaactttttcagttttttctgctgtttcctaccatattaaaaaataacatgctttcctgttattttttcaattttatgtat

SEQ ID NO: 460863 - DNA, 2978 bp, Homo sapiens
tccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgctctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcgacggtgggcgatatctatgtccctccattcccgtcgcgattatctgcgaaatccaccccgcagcccgccccaccgtgggctctggagccagaggaaacgagcgaagactttggaaacctcgcgcgccgcaggaccgcgcgccccttggcggctgagcctgtggacttggtcgcgggccaatttcgttgtccgtgtgttgggctttccggagctggaaagcgccggaggcggaggaagctgactgtggcctcccgggccgcggctctctggagggctcgcgccctagttcgcacaaagcctgctcgtgactgtgcgactaattgggggccctcctcgagaccctctaggatcctgagtgccactagggcaggtggagaggaggtgaaagctctgcccctctttgtccagggccacgtatcctaatggatgagcaaatactactcagctagaccttgtgccttctgggcttggccaggcccaaaggctccaaccacaggtttataatgagaaaacagtcccatactttatctctgattccagttcctagtgctttcccttccactttgaactttttcagttttttctgctgtttcctaccatattaaaaaataacatgctttcctgttattttttcaattttatgtat

SEQ ID NO: 460864 - DNA, 1170 bp, Homo sapiens
caccgcaagctctcacaggatcgcagacatgcgtgagttaacgggtgacaaggacagactcagtactcggcagcaccatcaccaatgcttcctcaagggcttcataatggcgacaacagctcctcaagcccatcccgacatcctgcagtgcttagtgacggaaccagaggtgcagcctggaagatcactgtcagccccctttgcacactgcagggaggttcccttctggcccagcatccccatctgtgcaagacctcctgacctcccctgcaccgagcccttaacctttccctcctgtgaccctctggacctcagccaccctatccttgctacattcatcctgctgtcatcggttcctccttcccctcctgggagcaaggaatccagggtctatatgagtgaccagcatccagcactggtctttttccagaaagctgcatgcatgcttgatgtttttcaactagaaaagaccactgctctcaacaccaccaccactcgcgacctcaccactgaaaggggtaccgcgctggacatgaaaaattcagataaccaccacccgcagctgcggaaggaaagcggcagagaaaagactagggcgccccctggtggctccaatgtggctcttcctgaaattggcaggaataaagcctgagccgctttcttgcaacctccagctcccaaataaccatatattcaaacgaaattaactcaagagtagaaactttgttgttaaaaaggaggtgaagggagacaaggctgttgtaaacaccaacaaatatcaactgaatgaattttgattaagatctagtaaagtagtaccagtgagctggtttccgcagcagtgacggtacttccgcagctacggagtcaggatcacttagtctggtgcattccacagcctggaacactctgaaggagagtcgtgaaagcaaaggaacttctccccaggaaaatccacgtatgtgcacaaacacacaagcacgattttgcacacaattgcaagaggtatctgaaatctctaaaactatctatgagcctccaatgaggttcccagatacaacagacacttcatataactcccaggaatccaccaaggggataatattaccaccatttcaaggactgggaaaacgagttcagagaaattaaagcatttgcccggggtcacat

SEQ ID NO: 460865 - DNA, 1017 bp, Homo sapiens
ccacttcatattcttctcacccagcacactccttgaaaaatagttattgtttgataaacaatttgattgatgaatgaaggaaaaactaaaaagagggattttctttaagctaaggaaaatatcaggccatagtcagacagcatctgccatgcacccgtggatgcctgctacagggtgtggaaccaagggaccgagcattttcttgcagttgtgcgtcagtggagggttgtggatgatcagtgtattaaagtctgtgtttgcttccttcagcaaaaaaagttcaccatcacaagcagtgtcactgggaagaagcacacatttgtcacagattcagccaagaccagtaaatacttactggacctctgctcagcccagcatgggtttaatgcacagatgggctctgggcagccttcccatgttttatttgaacacagtcacatggcccccaagacaactgcaagacgggttggaaagggaggacttcctgtgtgcccaggaagaggaagtagtgtaacgatacaccatggtccttgccataacggctgcagccgtctgctgtatcactcttaattgagagtttggtattaaactcatagcaggaccagattacggaagaggcagagtttatcatttgtgtttagattggaatccttgcaaggaaaaacattaaaatgtttctgcaatacacataatctagagatcaggtggacagcatggtgacctgaatgcagcacagttgaagattaactaccaacaagaataacaatgaatgtcctattaaatagccctggaagcacctgtaccaatcaggaagctatttgctgctgcttagcaattacagtgagaaatgtaactcatcacattctcctacttttggttgcttagcagatcttttgcttactgtgcttctaaattcaaaaactataaatacccttgttttaccaggaccatatcttaaaaatttaaggtaccttgtagagtagggtttttttttttttttgcctgaactcatttttt

SEQ ID NO: 460866 - DNA, 2268 bp, Homo sapiens
ccacacttacacttcctgttctctgcaaggcagccagagtgacctttcactaatttcaacacaagtcattggttgggagtagagggcactctgcatggtcgtctggaaccagggtttgcctacatgatgggtctccatttgccaccggccttggacgtctccactggatgctctgatttcacctgataagtaaagggagagagacagagcatggagaattacacaggtagttttagggtcaggcctggcagtgactcacatcgcttcctctgcccaccttccaattgtccagaactcagtcacatgactgctcctaactgcaagggaggctggaaaaaagtgttttatgtgggtgtcagcaacatcaggacctttcaagccccttgccccagtatcatccctgaatgcaaaactcactcagaggcctggggaagagattcgaactctgcttttcctctgccacctcagagtgagcccatctgtggaatgccatgccccttctctatcccatctttgcaagtgggcttgggttcttgggatgagttcttcaggccttataaatgcaaactgtgcagaggtgcctccaacaagaaaaaccagtctctggcagggcccctaagggcaggattctggagaggccgccctgtcctcagtttggccctgggacattctggccgaaaggaggaagggtggctggcagctggcggcagggcttgtgaaggcttagccctgggcctggtcctgcttctcttagaggtggctggttgtgcaatggcatcctggctgctcctcttggagccctgtgaccacagttccaggctccacccccatttctcaccgccggtgccttgtatgacctctgaaaatatgacctgaagcagatggatgcactcacataagaaacatcacctgtggccttcatcgaaaatgggcctgctgcttgaagaagttgggctcttggagttctctagcacaggggccatgaaaatcaatgacttccttgtttgctgacggagcagaggtagaatctcttggtgtttccacggagaaaacactgaccatgaagagccaagaaagatgacatgatgaagccatcaggggaagcaccaaacatcctcaactctgctcacccatggttttctcccgccctcccagagctcctcctgcgtgagtaatgcagtgtgtgctggtgcagtgtctcactgaaaaaagaaagaaaccctgatttgcagcattggccaatttctgtagtgtaaatactcccaccatagcagatttcaggttaccaagggtttcacaactggttcacaagtcttgactgtaatgaccagctcatgcaactccagcatctcatcatctccgccctgtcccagaaaatccccacatcacacccaggctgaatatcactttcagcttctcagtcagaaggagaagtggttaactatgccaggatggtaatgactaaatatcagaatgaatgtccaggcacttgtttcactaatatttgctgagcccctaccatgctccaaccagcactttaagcactctgcaagtgttaactagtgaatgttgaggtgttgaggttgggttccttccctgaagatagttttgtcacatggttgttaatgacctgcaaaagcagtgtttttgctttggagaatccagttacagtgctcctgagctgcagaaggagctctgagacccaacaaccttgtgtggaattccacaattctcttattcataaacggaccctctatatagactggtagtgaaacatatcaagaaacatttcccactttagtttttcacgaagaaagccgctattgtctcatctcagctgagatggggtcacgcagggacgcagctcccttgcctgatctctgactccctggaagtttcctaaaatgtttctgtgggcctaaatcctttggccttcattggcatcaccagcactggagctattccagtgaggatttttgctgcggcacatcacggagtggcatgagaggtcagagaactcctagtatcccccaaatatccattctgttcttcttccttagtgatgggcccccgacatgaaactggcactcagaatgaagaatgccttttccagcctccctcgctggtggagtctccgtgttccagccaatgaaaggaggaagcctggacagcctgcagttgaggggacctgcacaagctcacaggactcttcatcaccatgacaccacgctcaccgcaaaataaaaatgatcaaacctgtcatgatgt

SEQ ID NO: 460867 - DNA, 465 bp, Homo sapiens
ccacacttacacttcctgttctctgcaaggcagccagagtgacctttcactaatgtaagtcatattatgtcccctctctgctgcaaacccttcaatcactttccatgaatggttctgggaataaagtccagcttccttcccctgattcacttgatctggcccttcccacttgtctgacctgttttccagcccatgctccctgtccttttctacactcctaacatgtggtctttctattccttaaacttgcctggctcagtcccatgttagagcatttctgctggctcttcttcctgcctggaccttcacacagctggaaattcttgcttttcaaattgtaatttatttctatttttattttttgagacggagtttcactcttgtcgcccaggctggagtgcaatggcgcaatctcagctcactgcaacctctgcctcctgggttcaagcgattttcccacctcag

SEQ ID NO: 460868 - DNA, 1466 bp, Homo sapiens
tggcagggaccatttgatggggattcggatgtcttcctggggtgccttgtatgacctctgaaaatatgacctgaagcagatggatgcactcacataagaaacatcacctgtggccttcatcgaaaatgggcctgctgcttgaagaagttgggctcttggagttctctagcacaggggccatgaaaatcaatgacttccttgtttgctgacggagcagaggtagaatctcttggtgtttccacggagaaaacactgaccatgaagagccaagaaagatgacatgatgaagccatcaggggaagcaccaaacatcctcaactctgctcacccatggttttctcccgccctcccagagctcctcctgcgtgagtaatgcagtgtgtgctggtgcagtgtctcactgaaaaaagaaagaaaccctgatttgcagcattggccaatttctgtagtgtaaatactcccaccatagcagatttcaggttaccaagggtttcacaactggttcacaagtcttgactgtaatgaccagctcatgcaactccagcatctcatcatctccgccctgtcccagaaaatccccacatcacacccaggctgaatatcactttcagcttctcagtcagaaggagaagtggttaactatgccaggatggtaatgactaaatatcagaatgaatgtccaggcacttgtttcactaatatttgctgagcccctaccatgctccaaccagcactttaagcactctgcaagtgttaactagtgaatgttgaggtgttgaggttgggttccttccctgaagatagttttgtcacatggttgttaatgacctgcaaaagcagtgtttttgctttggagaatccagttacagtgctcctgagctgcagaaggagctctgagacccaacaaccttgtgtggaattccacaattctcttattcataaacggaccctctatatagactggtagtgaaacatatcaagaaacatttcccactttagtttttcacgaagaaagccgctattgtctcatctcagctgagatggggtcacgcagggacgcagctcccttgcctgatctctgactccctggaagtttcctaaaatgtttctgtgggcctaaatcctttggccttcattggcatcaccagcactggagctattccagtgaggatttttgctgcggcacatcacggagtggcatgagaggtcagagaactcctagtatcccccaaatatccattctgttcttcttccttagtgatgggcccccgacatgaaactggcactcagaatgaagaatgccttttccagcctccctcgctggtggagtctccgtgttccagccaatgaaaggaggaagcctggacagcctgcagttgaggggacctgcacaagctcacaggactcttcatcaccatgacaccacgctcaccgcaaaataaaaatgatcaaacctgtcatgatgt

SEQ ID NO: 460869 - DNA, 2257 bp, Homo sapiens
gtggcttaacacaataaagatgtatttctcttttatgtcacagttcaacacaagtcattggttgggagtagagggcactctgcatggtcgtctggaaccagggtttgcctacatgatgggtctccatttgccaccggccttggacgtctccactggatgctctgatttcacctgataagtaaagggagagagacagagcatggagaattacacaggtagttttagggtcaggcctggcagtgactcacatcgcttcctctgcccaccttccaattgtccagaactcagtcacatgactgctcctaactgcaagggaggctggaaaaaagtgttttatgtgggtgtcagcaacatcaggacctttcaagccccttgccccagtatcatccctgaatgcaaaactcactcagaggcctggggaagagattcgaactctgcttttcctctgccacctcagagtgagcccatctgtggaatgccatgccccttctctatcccatctttgcaagtgggcttgggttcttgggatgagttcttcaggccttataaatgcaaactgtgcagaggtgcctccaacaagaaaaaccagtctctggcagggcccctaagggcaggattctggagaggccgccctgtcctcagtttggccctgggacattctggccgaaaggaggaagggtggctggcagctggcggcagggcttgtgaaggcttagccctgggcctggtcctgcttctcttagaggtggctggttgtgcaatggcatcctggctgctcctcttggagccctgtgaccacagttccaggctccacccccatttctcaccgccggtgccttgtatgacctctgaaaatatgacctgaagcagatggatgcactcacataagaaacatcacctgtggccttcatcgaaaatgggcctgctgcttgaagaagttgggctcttggagttctctagcacaggggccatgaaaatcaatgacttccttgtttgctgacggagcagaggtagaatctcttggtgtttccacggagaaaacactgaccatgaagagccaagaaagatgacatgatgaagccatcaggggaagcaccaaacatcctcaactctgctcacccatggttttctcccgccctcccagagctcctcctgcgtgagtaatgcagtgtgtgctggtgcagtgtctcactgaaaaaagaaagaaaccctgatttgcagcattggccaatttctgtagtgtaaatactcccaccatagcagatttcaggttaccaagggtttcacaactggttcacaagtcttgactgtaatgaccagctcatgcaactccagcatctcatcatctccgccctgtcccagaaaatccccacatcacacccaggctgaatatcactttcagcttctcagtcagaaggagaagtggttaactatgccaggatggtaatgactaaatatcagaatgaatgtccaggcacttgtttcactaatatttgctgagcccctaccatgctccaaccagcactttaagcactctgcaagtgttaactagtgaatgttgaggtgttgaggttgggttccttccctgaagatagttttgtcacatggttgttaatgacctgcaaaagcagtgtttttgctttggagaatccagttacagtgctcctgagctgcagaaggagctctgagacccaacaaccttgtgtggaattccacaattctcttattcataaacggaccctctatatagactggtagtgaaacatatcaagaaacatttcccactttagtttttcacgaagaaagccgctattgtctcatctcagctgagatggggtcacgcagggacgcagctcccttgcctgatctctgactccctggaagtttcctaaaatgtttctgtgggcctaaatcctttggccttcattggcatcaccagcactggagctattccagtgaggatttttgctgcggcacatcacggagtggcatgagaggtcagagaactcctagtatcccccaaatatccattctgttcttcttccttagtgatgggcccccgacatgaaactggcactcagaatgaagaatgccttttccagcctccctcgctggtggagtctccgtgttccagccaatgaaaggaggaagcctggacagcctgcagttgaggggacctgcacaagctcacaggactcttcatcaccatgacaccacgctcaccgcaaaataaaaatgatcaaacctgtcatgatgt

SEQ ID NO: 460870 - DNA, 1551 bp, Homo sapiens
tgcctctagcttttttctttttattcaagatttttttgtctatctgagataactacacttatcattgctggacaaagctctatccaaatgatggcggagagtgatggcatgtacctgtagtcccagctactcgagagcctgaggcaggagaatcacttgaggtcaggagttaaaggcctccattctctatgattgcacctgtgaatatctaagctgcactacaacttgggcaacatagcgagacatctcttaaaatgataataataataaataaaataactctacattcaggagagttgtggggagatgacctaacaagcgcgcccctaccccgcacgggcgagaggggcaaagctggagtgaacccagctgagcctgggccgcccagccctggaggctggaggcgctgtggtcaggaagcgctcggaggatggagcccttttccctgtaagcagggggccagggtctcacttctgagccggcttcccacggaccccaggccccggcagggtcctgcagtgaggatgatcatgcccacggggtgggtggggtgttggcaaagcggggccgcagggcaggttctggaagccactccgcgtggctgggctggagtgtgcagacgtgggagagcccggaatggggagcgcatggagtgtgtgattgtgagtgagaggggaatgggcactgaatccttacctacacaaatgcctaaactcacatatccactggggaattgtatggcaggaaggctgattttatttagctggtccttgattcttggtttgcgcagtatctgggtccagcctgcagccctcgggtccagttcagtctgtcatctgaaccatgaggatctggtggcttctgcttgccattgaaatctgcacagggaacataaactcacaggacacctgcaggcaagggcaccctggaatccctgggaaccccggtcacaatggtctgcctggaagagatggacgagacggagcgaagggtgacaaaggcgatgcaggagaaccaggatgtcctggcagcccggggaaggatgggacgagtggagagaagggagaacgaggagcagatggaaaagttgaagcaaaaggcatcaaaggtgatcaaggctcaagaggatccccaggaaaacatggccccaaggggcttgcagggcccatgggagagaaaggcctccgaggagagactgggcctcaggggcagaaggggaataagggtgacgtgggtcccactggtcctgaggggccaaggggcaacattgggcctttgggcccaactggtttaccgggccccatgggccctattggaaagcctggtcccaagggagaagctggacccacggggccccagggtgagccaggagtccggggaataagaggctggaaaggagatcgaggagagaaagggaaaatcggtgagactctagtcttgccaaaaagtgctttcactgtggggctcacggtgctgagcaagtttccttcttcagatgtgcccattaaatttgataagatcctgtataatgaattcaaccattatgataca

SEQ ID NO: 460871 - DNA, 279 bp, Homo sapiens
aatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgcatattcatacctgtattgaggaggtggaatttacagccttaatctgcttggtagacaaaaatcaggggaaaaagttagacccccccgttttgtcaacaggtcaggttgcttgctcgct

SEQ ID NO: 460872 - DNA, 3393 bp, Homo sapiens
aatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagagagcaccatgaagcccaatgaaggtggatatggggcaggagctcgctggggctctggtgtgcaggaaggtttccctgtttgtcttcaaaactgattttgctgatggttgtcccctcaaggtgctggctgtctccaccctgcttccacactatccagcagggctggtccccttctctggctctggagaaggtcctgagggcagcacagggcagacctcatggttatggaggtgggaagagaacgaggtgctcaaagtccaactgaagaaatatgtaggagctgtccagatgctgaaaagagaaggtcaaacagctgaaggtggactggtggcattggaggtgacagctctgaagttgtatatcgtggccccactctcaggtggactggtggcgttggaggtgacagctctgaagttgtatagcgtggccccactctcgggtggactggtggtattggaggtgacatttctgaagttgcgtagtgtggccccactctcaggtggactggtggtattggaggtgacagctctgaagttgcgtagtgtggccctgctgtcaggtggactggtggcattggaggtgacaactctgaagttgtatagtgtggccctgatgtcagatggactggtggcattggaggtgacgtctctgaagttgtgtagtgtggccttgctgtcaggtggactggtggcattggaggtgacgtctctgaagttgtgtagtgtggcctcgctgtcagttggactggtggcattggaggccccggtggatgccatgatgcagacctgagacatggtcactccccctggggctcccagcctggagaggagggagtgtcagaaatctttctaacatctgttattctaacaaacagtgcctttggtattgattaatattgattaatatcaaaggcattgatattaataacagtatcagtgatattaatatcactgcctttgatattatcttttgatcagaggtaaagacagctgaactcttaatgtatctacctttaagggacatcttttttacttggctctaggtgtatcataaactttgtagtaggcatctggtaacggcttggctgtgtccccatccaaatctcatcttggattgtaactcccacaagtcccacgtgttgtgggaggatcccggtgggaggtaatagaatcatgggagcgggtctttcccatgctcttctcatgatggtgaataagtctcatgagatctgatggctttaaaaacgggactttccctgcacaagctctctctctttgatgtctgccatccacgtaagatatgatttgctcctccttctgccatgattgtgaggcctctccagccatgtggaactataagtccattagacctctctcttttgtaagttgcccagtcttgggtatgtctttatcagcattgtgaaaacggactaatacagcatccaggtcagcccaggtacaagttgtaaggtagaggcagcatggaaagttaaaggcctttctggcatcgcatgaagatttgaggagctgatacagggatttgaccagatctcagcaaagcccaaacaagtcttgttcttcctcatgtgttaaaaaaatgtgttgactttctagcatccagcccacattgacttgggcaccctcaatgtagttaactccacaataatacactagagttactgaagaggctctcctgccttttaactaaccccagtaagacagatgaagcaattgagttctgtgttttacactgggaaactagccagcatccagccctcatcctccggcattctagcaaggggcaaattcatacaaggtactaaacccctcgcatacaaatgacttctctgttgttccactctttcctaataattaatcctagtgatgattaatcttttcgaacttacatcatctgaagaacggtcgtgttcgacattctggagatctgaaaagtgctctatgtgtttaatgttaataggcagccactagaaaggtgcagaataaatcgaattaatattgtctgggagtttgggatgtcgtaaccagcagaggcccaaaaatgaagtggatgctggcagaaggcatgaatcacctccctgcaacaggagaatgttcttatgattttttaatgaccccctgaaaatgaatgtgcactattaagtgacaacgtggagtggctccgcggaagatggatgatacacacttgtgatgttgctcatgttttatggttaactgcctggaattcttcagagttcttttcatagcagttgaaggctgaaaggcacacagaaatgaccaactcaattctgtcaacatttgctgagtgttctttttctgtgtcaggccctgggaactggagcttatcttacacaaatctatggggggaaagattgtggccattttaaagtgtcaccagcaaacaggccctcttggccactctcaccagcattcataactgttgccattggaactccagtaggcaaaaacctagctccttatatttgtaattcatgagtcactgtggagatggaatacttacttttttctgtgtttatgaattgaatttctttttggtgaataatcagctcatttccttggcctatgtgtttcaggggtttttcctctgggttatgtgaggacttggtatcaataaagatgctggccctttgttttaatggattctcctcaccaacatttatctttcttctattttataacagccatcttaacaggtgtgaggtgctatctcattgtggttttgatttgcatttctccgatgattggtaatgttgagcagctggtcatacacctgttggccgtttggatgtcttccttgagaaatgtctatttgcatcctgtgtccattttttaatcaggttatattttcctgctattgagttgtttgagttccttgtatattttggatattaaccccttatcagacctattttgcaaacagtttcttccatttgaatccagttccgagtagctgaatgactaaggttcccgcttctggttggctctcagctgggggctgccctgagctctggaggcccccagaacccagaacaagcaatggcatgttgagtccttttcattcttggaatccgacttcctgttctcctgcttctcctctgtggttgtcttctgccatccctctcttctgctttc

SEQ ID NO: 460873 - DNA, 1373 bp, Homo sapiens
  misc_feature (5)..(5): n is a, c, g, or t
  misc_feature (15)..(15): n is a, c, g, or t
gctcnggctgagggnccgcgggacccggggaacgcggcctggaggacgaggaggactgggttcccggaggcaacaggaccggctcggcatctacagctactggcaggacacgtcctcacagaaaattgaagacttgatggaaatggtgcaaaagctgcagaaagtgggaagcctagagccccgagttgaggtcctgattaaccggattaatgaggtccagcaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggctcccagaccaggtagaccagtgacatggtggagttgaagagagaggctcactgcagagcactgtttccatggaaaaatggaacatggcaaagtgcagaaattcttcagtcagtccaggacagacgagttctctaagatgcagttaatcatacctgtcttaaacaaactggcaatatactatcaaacatgacttttaaatcaagtggaagttagaaaatatattgaactgagtggcaatgaagacaccacattttaaaactgtaattcagttaagcccacaattagaaggaactttagcttttattggttcaccacaattttttaagaaatcaaccaatgattgttcagttaatgaataaaaggcctttgacacagttcacctattcatgtgaaaaaaaaagactaataaatagtcagcttccctt

SEQ ID NO: 460874 - DNA, 2605 bp, Homo sapiens
agcggaatcaccactggaggctccctcccgaggcaccctcgctggcgagctgagaggaaatggcggggaggtccctgacatcgaaggccgagcccaccgcaggagccgtggacagggctgagaaggccggagacgagattgtgctttgttgcccaggctggagtgcagtggtacaatcactgctcactgcagccttgacctcctggcctcaagagattctcccacctcagcctcttgagtagctggaatcacagggcaggacacgtcctcacagaaaattgaagacttgatggaaatggtgcaaaagctgcagaaaggtcgtgtgtctcctttgtgtgaggcacagcctgaggtttggggccaggcagatgtgggtttaatttcaggccccacaatgtacgaatttgggaaataatcctcttcaccttctctttcttttaaaacttaattacttaaactaaaaatagggccccatgtttcaaaattaaagaagcaaaagggtatagaaggcaaaatgttttcccaaaaccctgtcccaaacctctcgctggtcacccatctggctccactgcagtccattagatccagaagttgccgccttcacttcccttccttccccctcacccgctactccctctttgctcgctaggctcctgccagccatgttcccacctcatgatgggtctttgcactgactacctcccaaccccacccaaattgctgcagggcctgccccccaccacttgatttggggccctcaggtcccttcccatatctcaggagcacttcccactcctttgctctttagcctcccttggcctacttcatttctcttgaacacggttaccgcagccccattcggtatcttattgtgtctgttcccagtcttgcccacccagaacgtgagccccgtgagggccccacagagcacctgcttgcaggaggtactcaatagatctgtgttgcgtgaaagcagcagagacacaaggctggcaaccgccccaactctgcctgccctgtcaactcaacctcctttcctccgtgcagtgggaagcctagagccccgagttgaggtcctgattaaccggattaatgaggtccagcaaggtgagttcaggggccttggctgccagctaggaccagctgcatggtttgcggggctcagtgccaagtgagaatgcagggtcccttgttccaaagttactggttattcacaacagcaacagcagagccttaaattaagtacagggcatttcagcatgcgactgccatagttacatgcccatgatcctggccctgctatcagcagagcctggcaaggagagctggaagcctcgtttcctactctataaaatctaggccactatagatttacctgaaggcaaatgagaaatgtcactgttgggaagagaatagaggctgcactcacacaatgtttttctgctctttggtgaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggctcccagaccaggtagaccagtgacatggtggagttgaagagagaggctcactgcagagcactgtttccatggaaaaatggaacatggcaaagtgcagaaattcttcagtcagtccaggacagacgagttctctaagatgcagttaatcatacctgtcttaaacaaactggcaatatactatcaaacatgacttttaaatcaagtggaagttagaaaatatattgaactgagtggcaatgaagacaccacattttaaaactgtaattcagttaagcccacaattagaaggaactttagcttttattggttcaccacaattttttaagaaatcaaccaatgattgttcagttaatgaataaaaggcctttgacacagttcacctattcatgtgaaaaaaaaagactaataaatagtcagcttccctt

SEQ ID NO: 460875 - DNA, 2483 bp, Homo sapiens
agcggaatcaccactggaggctccctcccgaggcaccctcgctggcgagctgagaggaaatggcggggaggtccctgacatcgaaggccgagcccaccgcaggagccgtggacagggctgagaaggccggagggcaggacacgtcctcacagaaaattgaagacttgatggaaatggtgcaaaagctgcagaaaggtcgtgtgtctcctttgtgtgaggcacagcctgaggtttggggccaggcagatgtgggtttaatttcaggccccacaatgtacgaatttgggaaataatcctcttcaccttctctttcttttaaaacttaattacttaaactaaaaatagggccccatgtttcaaaattaaagaagcaaaagggtatagaaggcaaaatgttttcccaaaaccctgtcccaaacctctcgctggtcacccatctggctccactgcagtccattagatccagaagttgccgccttcacttcccttccttccccctcacccgctactccctctttgctcgctaggctcctgccagccatgttcccacctcatgatgggtctttgcactgactacctcccaaccccacccaaattgctgcagggcctgccccccaccacttgatttggggccctcaggtcccttcccatatctcaggagcacttcccactcctttgctctttagcctcccttggcctacttcatttctcttgaacacggttaccgcagccccattcggtatcttattgtgtctgttcccagtcttgcccacccagaacgtgagccccgtgagggccccacagagcacctgcttgcaggaggtactcaatagatctgtgttgcgtgaaagcagcagagacacaaggctggcaaccgccccaactctgcctgccctgtcaactcaacctcctttcctccgtgcagtgggaagcctagagccccgagttgaggtcctgattaaccggattaatgaggtccagcaaggtgagttcaggggccttggctgccagctaggaccagctgcatggtttgcggggctcagtgccaagtgagaatgcagggtcccttgttccaaagttactggttattcacaacagcaacagcagagccttaaattaagtacagggcatttcagcatgcgactgccatagttacatgcccatgatcctggccctgctatcagcagagcctggcaaggagagctggaagcctcgtttcctactctataaaatctaggccactatagatttacctgaaggcaaatgagaaatgtcactgttgggaagagaatagaggctgcactcacacaatgtttttctgctctttggtgaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggctcccagaccaggtagaccagtgacatggtggagttgaagagagaggctcactgcagagcactgtttccatggaaaaatggaacatggcaaagtgcagaaattcttcagtcagtccaggacagacgagttctctaagatgcagttaatcatacctgtcttaaacaaactggcaatatactatcaaacatgacttttaaatcaagtggaagttagaaaatatattgaactgagtggcaatgaagacaccacattttaaaactgtaattcagttaagcccacaattagaaggaactttagcttttattggttcaccacaattttttaagaaatcaaccaatgattgttcagttaatgaataaaaggcctttgacacagttcacctattcatgtgaaaaaaaaagactaataaatagtcagcttccctt

SEQ ID NO: 460876 - DNA, 2536 bp, Homo sapiens
agcggaatcaccactggaggctccctcccgaggcaccctcgctggcgagctgagaggaaatggcggggaggtccctgacatcgaaggccgagcccaccgcaggagccgtggacagggctgagaaggccggagacgagattgtgctttgttgcccaggctggagtgcagtggtacaatcactgctcactgcagccttgacctcctggcctcaagagattctcccacctcagcctcttgagtagctggaatcacagggcaggacacgtcctcacagaaaattgaagacttgatggaaatggtgcaaaagctgcagaaaggtcgtgtgtctcctttgtgtgaggcacagcctgaggtttggggccaggcagatgtgggtttaatttcaggccccacaatgtacgaatttgggaaataatcctcttcaccttctctttcttttaaaacttaattacttaaactaaaaatagggccccatgtttcaaaattaaagaagcaaaagggtatagaaggcaaaatgttttcccaaaaccctgtcccaaacctctcgctggtcacccatctggctccactgcagtccattagatccagaagttgccgccttcacttcccttccttccccctcacccgctactccctctttgctcgctaggctcctgccagccatgttcccacctcatgatgggtctttgcactgactacctcccaaccccacccaaattgctgcagggcctgccccccaccacttgatttggggccctcaggtcccttcccatatctcaggagcacttcccactcctttgctctttagcctcccttggcctacttcatttctcttgaacacggttaccgcagccccattcggtatcttattgtgtctgttcccagtcttgcccacccagaacgtgagccccgtgagggccccacagagcacctgcttgcaggaggtactcaatagatctgtgttgcgtgaaagcagcagagacacaaggctggcaaccgccccaactctgcctgccctgtcaactcaacctcctttcctccgtgcagtgggaagcctagagccccgagttgaggtcctgattaaccggattaatgaggtccagcaaggtgagttcaggggccttggctgccagctaggaccagctgcatggtttgcggggctcagtgccaagtgagaatgcagggtcccttgttccaaagttactggttattcacaacagcaacagcagagccttaaattaagtacagggcatttcagcatgcgactgccatagttacatgcccatgatcctggccctgctatcagcagagcctggcaaggagagctggaagcctcgtttcctactctataaaatctaggccactatagatttacctgaaggcaaatgagaaatgtcactgttgggaagagaatagaggctgcactcacacaatgtttttctgctctttggtgaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggtaagccccagaagtgggcgtcagggaacagaaacagctactgaagggacagcggaaggggcgggaggacaagggagggggtcctgggactcctcagaggatggtctatggggagggcctttcccatactgggtccacccaaggtggtgatggggcaggaggggaccatgtggccatggggatgggtgtaaattcccaccctggacactaacctcctgcaggccagtcccaagcccctaaaaggagaaagacctggagctgcacaccaagcagggcctgatgtcctcataggccaggaggacacactccaccccgaccttagcccaaggggctttcaggaaataaaggagctattttg

SEQ ID NO: 460877 - DNA, 910 bp, Homo sapiens
agaaatcctcagcttgcagggagtcaatcaactaggatgtaagtcatgtgcatctgatacatgtttcaaattcactgaaatgcgttgacccaatcaagaccaatggtgggagtcaaagtctgcatctcctgagtcagaatgcattgaagtaatgacaaagcgatcccttttcttgacaggctcccagaccaggtagaccagtgacatggtggagttgaagagagaggctcactgcagagcactgtttccatggaaaaatggaacatggcaaagtgcagaaattcttcagtcagtccaggacagacgagttctctaagatgcagttaatcatacctgtcttaaacaaactggcaatatactatcaaacatgacttttaaatcaagtggaagttagaaaatatattgaactgagtggcaatgaagacaccacattttaaaactgtaattcagttaagcccacaattagaaggaactttagcttttattggttcaccacaattttttaagaaatcaaccaatgattgttcagttaatgaataaaaggcctttgacacagttcacctattcatgtgaaaaaaaaagactaataaatagtcagcttcccttagatttattggtgagatgtttgaagaatttcatgttgggaataactcaaggatgtctgcaatattcaaatactgttcattatactggaagttctatacagtgaaatagttaagacagatttatgattatatgctttgtgaatcaatctacagataaatttcagaatgtctaaatgagtataaaagtttgctaaatacaggtcaatattttaaaatcacctttatgtctcaatgctagggcacaggacccacaaaacacatcacttaggaatctacggttggttgatagaaaaggatacaataaa

SEQ ID NO: 460878 - DNA, 411 bp, Homo sapiens
tcacagtgcttgcaggtttatctgttgtaaataacaatccatgagcatccccactgcagtaccgcagagatgtgggatgacagaagtgcacagggagggaatggccagtgccatggccctgaggctgtactgtagctggtgtgcacagaggggcagagttgttggaagtgaggcatagtgagtaagtatgaaacaagatccagatagccttctttgaggcatgggggaaagccaagaggagtggacaggcctcttttctgcccctcagatgccagagcggctggcaaaggagatttgtgccctggacagcagcaaggagcagctgctcaaggaaggtgagaccagggaaggtggatggcccatatctgacctcacgtgccttcatgtgctcacctgcccctttgtgctgca

SEQ ID NO: 460879 - DNA, 1677 bp, Homo sapiens
  misc_feature (5)..(5): n is a, c, g, or t
  misc_feature (15)..(15): n is a, c, g, or t
gctcnggctgagggnccgcgggacccggggaacgcggcctggaggacgaggaggactgggttcccggaggcaacaggaccggctcggcatctacagctactggcaggacacgtcctcacagaaaattgaagacttgatggaaatggtgcaaaagctgcagaaagtgggaagcctagagccccgagttgaggtcctgattaaccggattaatgaggtccagcaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggctcccagaccaggtagaccagtgacatggtggagttgaagagagaggctcactgcagagcactgtttccatggaaaaatggaacatggcaaagtgcagaaattcttcagtcagtccaggacagacgagttctctaagatgcagttaatcatacctgtcttaaacaaactggcaatatactatcaaacatgacttttaaatcaagtggaagttagaaaatatattgaactgagtggcaatgaagacaccacattttaaaactgtaattcagttaagcccacaattagaaggaactttagcttttattggttcaccacaattttttaagaaatcaaccaatgattgttcagttaatgaataaaaggcctttgacacagttcacctattcatgtgaaaaaaaaagactaataaatagtcagcttcccttagatttattggtgagatgtttgaagaatttcatgttgggaataactcaaggatgtctgcaatattcaaatactgttcattatactggaagttctatacagtgaaatagttaagacagatttatgattatatgctttgtgaatcaatctacagataaatttcagaatgtctaaatgagtataaaagtttgctaaatacaggtcaatattttaaaatcacctttatgtctcaatgctagggcacaggacccacaaaacacatcacttaggaatctacggttggttgatagaaaaggatacaataaa

SEQ ID NO: 460880 - DNA, 1114 bp, Homo sapiens
agcggaatcaccactggaggctccctcccgaggcaccctcgctggcgagctgagaggaaatggcggggaggtccctgacatcgaaggccgagcccaccgcaggagccgtggacagggctgagaaggccggagggcaggacacgtcctcacagaaaattgaagacttgatggaaatggtgcaaaagctgcagaaagtgggaagcctagagccccgagttgaggtcctgattaaccggattaatgaggtccagcaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggccagtcccaagcccctaaaaggagaaagacctggagctgcacaccaagcagggcctgatgtcctcataggccaggaggacacactccaccccgaccttagcccaaggggctttcaggaaataaaggagctattttg

SEQ ID NO: 460881 - DNA, 1708 bp, Homo sapiens
agcggaatcaccactggaggctccctcccgaggcaccctcgctggcgagctgagaggaaatggcggggaggtccctgacatcgaaggccgagcccaccgcaggagccgtggacagggctgagaaggccggagggcaggacacgtcctcacagaaaattgaagacttgatggaaatggtgcaaaagctgcagaaagtgggaagcctagagccccgagttgaggtcctgattaaccggattaatgaggtccagcaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggctcccagaccaggtagaccagtgacatggtggagttgaagagagaggctcactgcagagcactgtttccatggaaaaatggaacatggcaaagtgcagaaattcttcagtcagtccaggacagacgagttctctaagatgcagttaatcatacctgtcttaaacaaactggcaatatactatcaaacatgacttttaaatcaagtggaagttagaaaatatattgaactgagtggcaatgaagacaccacattttaaaactgtaattcagttaagcccacaattagaaggaactttagcttttattggttcaccacaattttttaagaaatcaaccaatgattgttcagttaatgaataaaaggcctttgacacagttcacctattcatgtgaaaaaaaaagactaataaatagtcagcttcccttagatttattggtgagatgtttgaagaatttcatgttgggaataactcaaggatgtctgcaatattcaaatactgttcattatactggaagttctatacagtgaaatagttaagacagatttatgattatatgctttgtgaatcaatctacagataaatttcagaatgtctaaatgagtataaaagtttgctaaatacaggtcaatattttaaaatcacctttatgtctcaatgctagggcacaggacccacaaaacacatcacttaggaatctacggttggttgatagaaaaggatacaataaa

SEQ ID NO: 460882 - DNA, 2935 bp, Homo sapiens
  misc_feature (1)..(2): n is a, c, g, or t
  misc_feature (6)..(7): n is a, c, g, or t
nncgtnngagctgatgaggaactgacgacccagagtcggcctgtgtgaggcccgtacaggtggctcccgaagtctttagcggcacagggtcggtccctccaggccgacctggtaaaattcccgcatctcccgcaggccgcccttctctggcccctggaccccgggctcctggcccgcgcgcaccaggagctgtccgcggtgctgaccgcaggcgcttcccgcgctcggccgatgcgcacgcgtcccgggaggggcgcgcgggacctgccggcgccgccactgcgcagcctcccgcggcctccccgcccggcgcagcctcccgcggccttcccgccgccgctctcgcccgggccggccatggcgctcaacaatttccttttcgctcagtgcgcctgctacttcttggccttcctgttcagcttcgtggtggtggtcccgctgtccgagaacggccacgacttccgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctatgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccagtttggcctctgggcctcatggctggcctggctggccatcaccacgctggccttcctgaaggtctaccacaactaccgtcaggaggacctgctggacagcctgatccacgagaaggagctgctgctggcccggccgtccccacgcacctccttccaagaggagaagagcgctgtcatttaggcacagtgcaggcagggggagctggccccgacctccctgctgcgctcgggggcacgggcctgcctggggaagcagctggggcgctctgcctgggccctggccacatgcagccctgcgtgtgtcccctcgacgccacgtgtagtgaggtgagcgccccagtgcccacctgtgagcctggcagtggactgggtgggtgccggctccctgatgaggatggtgcagagagactatgggtgtggggcgggggcggggggcacctccaggcctcgcacagggccccttggctgtcccagtaggacctgactggccagcctatgtggagggcgtccagcttgtctcccccaaccctggccggatgctgtctccatgccagctggcccaggggtggccagatgtcacttagccctgaacgaattctgcatgaattctgccatccaggcagaggctgcgtgtggggaggagctcacggcaccttccagcctctggccccaggttggccccctccccagctgagtccccctcctggaatatggggcaggaacctgcccatcctccttcctggggtggggtgggatgggctgggcctggggagagatgctggagggtccccgggggagcccccaccatggtcccttctgggccacttctggaaacagccccttttgttacctccacccgcaactctgggctccctggattccaaagctggaagtgaccctggagaccacttcacctgttccctggcacctggagttgcagggacacaccctgactgcagggcaaagggagccggccgggcatccctcaagacccaggggcttggtcagcccctgcccgagtggacacatccactcccaggcctgcaggagatggggaggttccaggcgcccaggacatccgctttggccactgaggccgattccttagcaaatcggttctggtttctctcatttctataaaaacaccaagactgaaggaagccacggtgtgttttaataaaacagtgtctcccagttaagtggtgggacaaacaggaaccaccgggtggatggtcggccgtgcccacccgcctcaggctaacctcgaggacgctggtctgattgtccctgtgtctctcctgggcagttctgcctggtgtctaaccgtgggcctccctgctttgttcagccctccccccacgtagggtcgggggtgtctgggccccttgctgtcccctcggcttctacacctgaagccgcccctgatgaggggtccttccctggggcctctccagactcacggggctgggtaggggggtcagacctgggctcagaggatggcacctcacatcaaagggacccaccttgacaaccagacccttccctccccgtggggtttcgaggtctggattccccacaagccataatcgcaaaaggctgggtttgcctcctccgagcagccccttgaacacgggcagtgtgtccccctcctcaagagggtgcacacggtgatggccgggccaggccctagcagcagcaggagttcctgctgggacgagggaggggtctttgggtgagcctggggagcctcaactgttagcagtcgaatcctctttctaataaaatctcacatggacccaacacaggagacaggagggctgtgctgactagtgtggcggggccgcctgctgtgccccccatgtccgatctcacgccacggggtcccccttttcctagttagccctcaggcagcagccccttttggcccccatgattcaccaagcagcagggccagggctcaggctgtctcggagcccccggagtgcttgagctctcctggaagccctgcccgtcctgcccgtcctgcccgtcagagccgcaggaggccgcgccagcag

SEQ ID NO: 460883 - DNA, 525 bp, Homo sapiens
tgcatgaaaaataacgctattgatatcttggcaccactgggagaaaggagggggttgagctctggaagtcagacacagcaatggtatgcagagaacccaacctgtacctttcccattaaaactcggcgcctcctatccctggggtatacacggctatatcctctttgacatccggattttgatttgtcttacaactcccacccgctccaaagtctgggttggggaggtgggagtaccatgtggtgcaacaccattaccgacaagggcaccgaaccccacagctgtgaagagctccaggacatcgacttggagctgggcgtggacaactccgccttctacgatcagtttgcaattgcccaggtccaattccggaccccaggctggcctctgaaggctcttgctggccgtggctggcctgaggacgcttctcctggccaggagccctccaagggtgctggacgtgggtgggcctgaatgctctttgccgagatgaactggacctgtcaaagacaccttcatgcaaat

SEQ ID NO: 460884 - DNA, 1044 bp, Homo sapiens
  misc_feature (1)..(2): n is a, c, g, or t
  misc_feature (6)..(7): n is a, c, g, or t
nncgtnngagctgatgaggaactgacgacccagagtcggcctgtgtgaggcccgtacaggtggctcccgaagtctttagcggcacagggtcggtccctccaggccgacctggtaaaattcccgcatctcccgcaggccgcccttctctggcccctggaccccgggctcctggcccgcgcgcaccaggagctgtccgcggtgctgaccgcaggcgcttcccgcgctcggccgatgcgcacgcgtcccgggaggggcgcgcgggacctgccggcgccgccactgcgcagcctcccgcggcctccccgcccggcgcagcctcccgcggccttcccgccgccgctctcgcccgggccggccatggcgctcaacaatttccttttcgctcagtgcgcctgctacttcttggccttcctgttcagcttcgtggtggtggtcccgctgtccgagaacggccacgacttccgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctatgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccaggtccaattccggaccccaggctggcctctgaaggctcttgctggccgtggctggcctgaggacgcttctcctggccaggagccctccaagggtgctggacgtgggtgggcctgaatgctctttgccgagatgaactggacctgtcaaagacaccttcatgcaaat

SEQ ID NO: 460885 - DNA, 3365 bp, Homo sapiens
caccaatggggtaggagctaccccatcgctgtcttgcagatgagaaacagagattgcaggggatctcgctgcattcccacagagccggtaaatggtactgcaggtctctgacagcctcagggaatgtcaccttgtgatgtgaagtagatgcagtgtagcctctgggatgcatttctggggcctcggctggtcatactgcctgtgcaaggggtataaatcagggcttgcaaatgcactggcccacggaggctgccaggacggggagcaggctgtcctggggagtgaggaagacgtaccaaagcgaagatgttttgtgtttcctcaggatgccaagtttgtggaggaacggagaaagcagctccagaattacctgcgcagcgtcatgaacaaagtcatccagatggtccccgagttcgctgccagccccaagaaggagaccctcatccagctgatgcccttcttcgtgaggcgctgccccatccgcaagtcagtgtcccccaccccctgcggggtccacagcccaggcatctccggtccagtgtttcccaaacattcgcatggcagagatccccggggagatgtgaggtaccgttcgtggagggaggctcggactccaagaattcgctcagtgagactggaccgcaaatcggtgacagcttcagtgatttgccgtgctgtcatttagcgcattattaaaatggttttctgcagagtaatttaactttgggaaatacattatgttctcctgctccttgaggagagagaaagttagggggctggaaggtggcagagtaatgtaggtcacagcacaaattcccaactggattttcagcagaaaacccagtctgggtttcccccgccgccgcccccatttgctgctgcattctctcttagggttgtgaaatatatccattttttgctgaaatatgagctgccttgttctcccagtgagcagctgcaccctcccccacctctaagcccttgtccctccccctctagttttgtcttttcaagaatgtcacataaatggaatcatactgtaagcaacctcttgaggctggcgtctttcagcatgtgtgagaaccgtcaagtcgttgggtgagtcagcagtgtttttattactgagcagagtttggttaaatggatataccacggtttatctagtcataaaggaataaagttgcgttggttccagttgttggcaatcttgaatagagctagtggaaacattcaagtgcagctttttgtgtgaacaaaagttttcatttctgtgcggcaaatacttaagagttgaggactggatcctatgctaaatgtaagaaactgcattcccacagtgtatgaggggcccagttgctctgcaccctgggcagcatgtcatactgtcatgattctttactgtggctgttcacaaggatgcagaatatttcatcatggtcttaatttgcattttcctaatgagtaatgatgttgagcatattttcatgtggatgttttcctttaacacatcctctttggggaagtaagtaagtgtccaagtattttgcctgttcttagaaactaggctgtttgtggttttacaaagatttgagttttgggagttctttgtatatgttagatgcaagacctttgtcgaacatggcttgtggacggataggatgccagtgactctcctcctgcaactgtggcaagaccgtgtgtcctgtcagagtgggtgaccagggcctttgccagcagacgacttatggagaaatgtttgagtagatggaggaaccgatttcctctggaatccagagtgctgataaagacatacctgagactgtgcaatttacagaaagaaggtttaatggactcacagttccatgtggctggggaggcctcacaatcaccgtggaaggcaaggagcaagtcacttaagctctttgcatggcaccatcgatgtgagctaggaaactcttccctatgaaaccatcacattcactgtcagaagaacagcacaggaaagactcgcccctgtgattcaattatctcccaatgggtccctcccatgatacatgggaattcaagatgacacatggtttggctgtgtccccacccaaggataatacaggtggaacataaatgccagcttgatctattgataattataaacaattaccaagaagagtggataaatcttcctttttgaatccatctagacccactgtgattaaagctattattttgactagaaaactaagaagataggagaaaattagacatttaaacagctaccttccatgcaacaattaaaggaaattttaaatacagaaaattaggattgctttcaaaatatatgaaaataaagggattaagattatacagtcaccaccccagtgtttcttggcacctgagaaacatgttggttaacttttctcccatgaggcgctccctgtctttccctgcgtgtctgctgggctgctggcccctcaggttgctttgtaggagacactcatgtctgtttacatcacaccaacttgtaacaccatctgcgtggctttcaattttcaagtgtttttttttgttcacttgtcctgtggactcatgccatgtcaccgtagtgctgagtgacgcttaaagggtgcttttcttattaatcttatagaattaatttctgctttcattgagaagtatgggttattactcttatgttctcaaagtgatggttggagtggttaaatcgctttgtcgccatgacacatcccagatgttgctgagtctgaaatgtaacctagggtcttccaattgtgaggttggtttcatggcgtcacaccccacctccctaaagctggcaagaaatccgaggtcctgtggggccagcgggcattggtctgctatagacgagctagaccaggacagaccacttgcacttcactcacctggttgagtataccagtcgtaattgtaggcactggcgatatagtacagaagatgacacttcagatggctacagatgctgtgaagaaactccaaggaactcttaggcgaaggccaaaagcacgaggaggagttagggcatggcaggcagtccccgtgttgccagaggaagtgacgatgggattacagctgtgggaaacatttgcatttgattctgaacacagtgggaagctatggaagggtttggggtctgaggaagggtcaaggcaagaagggacggtgtctgggtttaggagacacagcagagacagaagtggaagcagtagtcatgtgtctggaggcagaagccaaacgccagtgggtcttggattttgtttggaatgtgaataaagaaaaattaaggtgcccccagagttctggtttgagcattggagtcaacagttgccccc

SEQ ID NO: 460886 - DNA, 937 bp, Homo sapiens
gaggtggaggaggcgggcgcggcccggcgccgcggccgccccgccgagctgtgcttctactcgggccgtgtgctcggccaccccggctccctcgtctcgctcagcgcctgcggcgccgccggcggcctggttggcctcattcagcttgggcaggagcaggtgctaatccagcccctcaacaactcccagggcccattcagtggacgagaacatctgatcaggcgcaaatggtccttgacccccagcccttctgctgaggcccagagacctgagcagctctgcaaggttctaacagaaagattaatcagattaatccaagctttcccatgggaacatgctcttcctggctgaacatggcagccataggtttcgtgccctgttggtgaccctgtgttatgatagccttggacatggtctgagagtagccttgccggctcttgtagagttctgcagcgtctacataaagcatagtgtcagtgtctgtttctggtggaagatgaaggggagccagcgtgtcacatggggagagaagggagcaagagagaagggaacgagagagagcgaagaggccctcagcccctctggcttttgggtcactgctgaaaagcacacgtcccatttacaggacactgtcctttgctctgctcttggctgcttcagccttggctcaaggccaccccctgcccccagtgctattctaccctctttgggagtcccctatgccctgcattatggaaaagtcttcactgagtcatttcatatgcacttctgccagatgccccagggctcttccacaagtgcacatgtcatctctccttcagtgcttatccttaggccatcggaagcacaggatgatctacttgtgtgtgtagcacaggcttggggatttgtactggggaccctgcccatgtcccgctggtatcctgaactctgaatg

SEQ ID NO: 460887 - DNA, 609 bp, Homo sapiens
  misc_feature (432)..(432): n is a, c, g, or t
gaggtggaggaggcgggcgcggcccggcgccgcggccgccccgccgagctgtgcttctactcgggccgtgtgctcggccaccccggctccctcgtctcgctcagcgcctgcggcgccgccggcggcctggttggcctcattcagcttgggcaggagcaggtgctaatccagcccctcaacaactcccagggcccattcagtggacgagaacatctgatcaggcgcaaatggtccttgacccccagcccttctgctgaggcccagagacctgagcagctctgcaaggttctaacagaaaagaagaagccgacgtggggcaggccttcgcgggactggcgggagcggaggaacgctatccggctcaccagcgagcacacggtggagaccctggtggtggccgacgccgacatggtgcagtaccacggggccgangccgcccagaggttcatcctgaccgtcatgaacatggtatacaatatgtttcagcaccagagcctggggattaaaatgaacattcaagtgaccaagcttgtcctgctacaacaacgtgccgctaagttgtccattgggcaccatagtgagctgtccctgaagagcttgtgtcactgg

SEQ ID NO: 460888 - DNA, 696 bp, Homo sapiens
gaggtggaggaggcgggcgcggcccggcgccgcggccgccccgccgagctgtgcttctactcgggccgtgtgctcggccaccccggctccctcgtctcgctcagcgcctgcggcgccgccggcggcctggttggcctcattcagcttgggcaggagcaggtgctaatccagcccctcaacaactcccagggcccattcagtggacgagaacatctgatcaggcgcaaatggtccttgacccccagcccttctgctgaggcccagagacctgagcagctctgcaaggttctaacagttccacagtgtctgggcctcacctgggaggacttgaaatctggaggctggagtgatctggaggtgcctcattcatgtgtctggcctggaggtggatgacttgaagacaaggacaacaacgtggagcgtctacctgtggcctctgcagcttggcgtccataccttggtggcagacatacttcttctatggccaccagggctcccaatgcaagagttcccgcaagccagcaggagctgtgctgcctttgaggatcagcctcagaaatcctagagcatcactctgaaggtactctgttggctgaagcggttagaaacctacccaggttcaagggcagagagatagaccccaccgctcaatgtcaaagaatttgggggccttatttaaaacctcttcacacctct

SEQ ID NO: 460889 - DNA, 509 bp, Homo sapiens
tgtgcttctactcgggccgtgtgctcggccaccccggctccctcgtctcgctcagcgcctgcggcgccgccggcggcctggtactgcccgcgccacctccgggtcggcccgtccggtctgttgcgacgcagagtggtcgccgtggagggtgggggtggggcgcctctgctggaagtccagcctccaggggaaccggagggaaccccctgcctttccacctctccccatcccccaccccggccttcggtaccctctataggcaaagggggtgggaggggcagcatcccagtccagcgcctctgcagcccgtggaacccgcgcggagctggggttgcgtggggtatacgccgcccgctctagggagcgcagatctggcagggatgaaactgtcagggccctggacagaggcgccttggccccaatgtagagaacactgcatctgcaccgccgtgtcaaagtgtatgtcacgggagtacctgtgtacgtgtaggtgttatgttcttggactt

SEQ ID NO: 460890 - DNA, 1181 bp, Homo sapiens
cccaggctggagtgcagtggcttgatctcggctcaccacaaccactgcctcccgggctcaagcaattctcctaactcagcctcctcagtagctggggttacagcatctgtcttaatcaatgtaggctgctataacaaaattatattacatggggtggcttaaacaacagacacttacttcttacagtactgaggctgggaagcccaagatcgaggtgctggcagatcccacacctggtgaggactcatccccatttgcagaaggccaccttcttgccgtcctcacatggcggagaggagacagaaagagatcatctctcctgtgtctcttctttgcacagagggtcacgttccgcagggctcccgcctgagcagctgctccctccacccgtgctcccgccgcccacgctgccctccagcacgtcccacccatcatagcagggtacgcgcagcctccacacacacgttcctccgagatgtctttaactctctggaggttggcgagggaggaatcccttacattgagctggtgagcaaggccatgctcgagctgaagcctctggagtcttcagacctcaccaaagtcgtggtttatggctactatttgtacaagctccagaccaagtggatgctccagtccgtggctgagtggcaccgccagcgccaggagcccttggatgaagccaaccagcttccagccaatgcgatgaaggccaggatgtagagattacattgtgcccagagctagagggattcctctagtttggtttaaactctgctccagcctgataagttaagggaaaaccacctgtttaggggtctctgaccttgctctgagtcttgctgtaaatatctctttcatggttgccagtaaaataaagttaaaaaaaaaaaaaaaaaaattaaccaggcatggtggtgtgcacctgtaatcccagctacttgggaggctgaggcaggagaatcacttgaacctgggagatggaggttgcagtgagctgagatcatgccattgcactccagcatgggcaacagagtgagaatctgtctcaaaaaaaaaaaaaaaaaattctttctttttccccacacacttacacacacacaccccatactttcctgttccttggtatgcctggtgtcgggggtccacacctggcctttggattttcctcttgtggtacc

SEQ ID NO: 460891 - DNA, 2042 bp, Homo sapiens
cgccggggaaccactgtcaggatgcggtcactggagtcactggggaccactgtcaggatgcggtcactggagtcaccggggaccactgtcaggatgcggtcactggagtcaccggggaccactgtcaggatgtggtcactggagtcactggggaccactgtcaggatgtggtcactggagtcactggagtcaccggggaccactgtcaggatgtggtcactggagtcaccggggaccactgtggcagagatgcatggcgagctgattgagttcaacgagcgcctgcacagggccctggtagccaaggaagccctcgtgtcccagatgaggcaggagctcatcgatctccggggaccggttatctacatctgcttcctcctcctatatcatttcaatcaaattctggaggttttcaacccctcagctttgctgatggtatctctgtagtgtgattcgatatgcttcttcatttcctgtatttccttaaattagaggcttggattcaggtttaattttgctgattatatgactgtgtcgttgggtggtgttttctgtcaggagatgcctaatgtttgctatctttttgtgatattaacagccatctcttatcacttcctgggtccattacacaaacgtttctttaaggtcagtacctaagtgtgaaattgcggcgttttagtgtatggcgtcttaaactttactgagttttgccattttataaagtaaaagcacctatttattaaccccctgtttgtgtgcaaaagttcctgctgacgcttttacatccctgctgtgatattttatatatttgtgttttcatccgctgttcctggcccataattcccaccataccctttttatccaatcacgttgttaatcttgattatccagtgatgtctccataaaaggcccaggaagacaggattcagggagcttccaggtagctgaataagtggagattcctggaggttgatacatggggagagcatggaagctccgcaccgcttcccataccttggcctgtgcatgtcttcactgtatcctttgtaatatcctttataatcaccagaaaatgtgtttctctgagttctgtgagctgctctagcaaattaatggaacccaagaagggggttgtgagatccgcattttattgctatttctcctcatgctcccccagggtgctggacctcctgccctgtgctgccccccacccagggcctttgttcctagtgttccctcgcctggaacactgcccagtgccagggctgcatatcagctcaacgcttcctcaggaatcctccctgaagccctgacaaggtcacactttccaagttgactatgatgctgacatgtgtctctcccttcctgtcttaatgtcatgttacattgatttatcactgatcagtgttatctttcccgcgtccacaagggcaagtttttgtttctttctgctccctttgggtttcagtgattcacatggtatcaagtataatgatggcacaatggtggggttagttacctgctggggtatgtcatggaaggtttcaaagaggagacgtttgacttgagtttttaaggatgagttgaagttgatcaggaagatgggcctgttaggcagcgggaatggtggtatcaatcgacatggtttgctcacaatattctcattgctagtttcatggatgtatcctgtggcttctccatgagataatgaagttcttgaaagtgggagtgtcatttacactcctacctgcagacagcacctgatacagagtataaagcattggctgaatgcgtgaatcttagttcccgcttttcaccttagcatcctgactaccgatgccctgaacacacatggtgaatttggctgaaatgaagcattctgtgcctgccccacaaaccaccaagggactgtgggtttatttgtctcaagatggtcaacactgctgttttcacattttacttgctgtcaaatataaagagatatcatatgttgcccgcctctggttttcctgatgtctcaatttaagtggtttccaatttgg

SEQ ID NO: 460892 - DNA, 2053 bp, Homo sapiens
cgccggggaaccactgtcaggatgcggtcactggagtcactggggaccactgtcaggatgcggtcactggagtcaccggggaccactgtcaggatgcggtcactggagtcaccggggaccactgtcaggatgtggtcactggagtcactggggaccactgtcaggatgtggtcactggagtcactggagtcaccggggaccactgtcaggatgtggtcactggagtcaccggggaccactgtggcagagatgcatggcgagctgattgagttcaacgagcgcctgcacagggccctggtagccaaggaagccctcgtgtcccagatgaggcaggagctcatcgatctccggggaccggttatctacatctgcttcctcctcctatatcatttcaatcaaattctggaggttttcaacccctcagctttgctgatggtatctctgtagtgtgattcgatatgcttcttcatttcctgtatttccttaaattagaggcttggattcaggtttaattttgctgattatatgactgtgtcgttgggtggtgttttctgtcaggagatgcctaatgtttgctatctttttgtgatattaacagccatctcttatcacttcctgggtccattacacaaacgtttctttaaggtcagtacctaagtgtgaaattgcggcgttttagtgtatggcgtcttaaactttactgagttttgccattttataaagtaaaagcacctatttattaaccccctgtttgtgtgcaaaagttcctgctgacgcttttacatccctgctgtgatattttatatatttgtgttttcatccgctgttcctggcccataattcccaccataccctttttatccaatcacgttgttaatcttgattatccagtgatgtctccataaaaggcccaggaagacaggattcagggagcttccaggtagctgaataagtggagattcctggaggttgatacatggggagagcatggaagctccgcaccgcttcccataccttggcctgtgcatgtcttcactgtatcctttgtaatatcctttataatcaccagaaaatgtgtttctctgagttctgtgagctgctctagcaaattaatggaacccaagaagggggttgtgagatccgcattttattgctatttctcctcatgctcccccagggtgctggacctcctgccctgtgctgccccccacccagggcctttgttcctagtgttccctcgcctggaacactgcccagtgccagggctgcatatcagctcaacgcttcctcaggaatcctccctgaagccctgacaaggtcacactttccaagttgactatgatgctgacatgtgtctctcccttcctgtcttaatgtcatgttacattgatttatcactgatcagtgttatctttcccgcgtccacaagggcaagtttttgtttctttctgctccctttgggtttcagtgattcacatggtatcaagtataatgatggcacaatggtggggttagttacctgctggggtatgtcatggaaggtttcaaagaggagacgtttgacttgagtttttaaggatgagttgaagttgatcaggaagatgggcctgttaggcagcgggaatggtggtatcaatcgacatggtttgctcacaatattctcattgctagtttcatggatgtatcctgtggcttctccatgagataatgaagttcttgaaagtgggagtgtcatttacactcctacctgcagacaggtatactggcacttattacataccaaatcctattccatgagctgtgcatgtagtagcaagcactgatgtaggttctcatgtctccattttagagatgacaagactaaggcacagataaggtaggcaatatccccaagtctccatgtccccatgattagtaggagatggagctgtaagtctctttttagagtcttcatgtcctcacctttatttctttacattttgtatttttaatttttttaagagacagtctcgcttgcactccagcctgggcaacaaaccaagactctgtctca

SEQ ID NO: 460893 - DNA, 2161 bp, Homo sapiens
cgccggggaaccactgtcaggatgcggtcactggagtcactggggaccactgtcaggatgcggtcactggagtcaccggggaccactgtcaggatgcggtcactggagtcaccggggaccactgtcaggatgtggtcactggagtcactggggaccactgtcaggatgtggtcactggagtcactggagtcaccggggaccactgtcaggatgtggtcactggagtcaccggggaccactgtggcagagatgcatggcgagctgattgagttcaacgagcgcctgcacagggccctggtagccaaggaagccctcgtgtcccagatgaggcaggagctcatcgatctccggggaccggttatctacatctgcttcctcctcctatatcatttcaatcaaattctggaggttttcaacccctcagctttgctgatggtatctctgtagtgtgattcgatatgcttcttcatttcctgtatttccttaaattagaggcttggattcaggtttaattttgctgattatatgactgtgtcgttgggtggtgttttctgtcaggagatgcctaatgtttgctatctttttgtgatattaacagccatctcttatcacttcctgggtccattacacaaacgtttctttaaggtcagtacctaagtgtgaaattgcggcgttttagtgtatggcgtcttaaactttactgagttttgccattttataaagtaaaagcacctatttattaaccccctgtttgtgtgcaaaagttcctgctgacgcttttacatccctgctgtgatattttatatatttgtgttttcatccgctgttcctggcccataattcccaccataccctttttatccaatcacgttgttaatcttgattatccagtgatgtctccataaaaggcccaggaagacaggattcagggagcttccaggtagctgaataagtggagattcctggaggttgatacatggggagagcatggaagctccgcaccgcttcccataccttggcctgtgcatgtcttcactgtatcctttgtaatatcctttataatcaccagaaaatgtgtttctctgagttctgtgagctgctctagcaaattaatggaacccaagaagggggttgtgagatccgcattttattgctatttctcctcatgctcccccagggtgctggacctcctgccctgtgctgccccccacccagggcctttgttcctagtgttccctcgcctggaacactgcccagtgccagggctgcatatcagctcaacgcttcctcaggaatcctccctgaagccctgacaaggtcacactttccaagttgactatgatgctgacatgtgtctctcccttcctgtcttaatgtcatgttacattgatttatcactgatcagtgttatctttcccgcgtccacaagggcaagtttttgtttctttctgctccctttgggtttcagtgattcacatggtatcaagtataatgatggcacaatggtggggttagttacctgctggggtatgtcatggaaggtttcaaagaggagacgtttgacttgagtttttaaggatgagttgaagttgatcaggaagatgggcctgttaggcagcgggaatggtggtatcaatcgacatggtttgctcacaatattctcattgctagtttcatggatgtatcctgtggcttctccatgagataatgaagttcttgaaagtgggagtgtcatttacactcctacctgcagacaggtatactggcacttattacataccaaatcctattccatgagctgtgcatgtagtagcaagcactgatgtaggttctcatgtctccattttagagatgacaagactaaggcacagataagcacctgatacagagtataaagcattggctgaatgcgtgaatcttagttcccgcttttcaccttagcatcctgactaccgatgccctgaacacacatggtgaatttggctgaaatgaagcattctgtgcctgccccacaaaccaccaagggactgtgggtttatttgtctcaagatggtcaacactgctgttttcacattttacttgctgtcaaatataaagagatatcatatgttgcccgcctctggttttcctgatgtctcaatttaagtggtttccaatttgg

SEQ ID NO: 460894 - DNA, 819 bp, Homo sapiens
tggcatacggtatggaaaggctgggggcagtaaacctcttcatgagacttcccccctactccagtttgccctccaggagagccttggaggaacgctccaggcaggtccgcctctctctgcaaaccaagccctgtgctgaggtggaggggagcagccgcatccccattcccaatccaagccctcccagatgccacactggttcccgtgttgaatctgcccgcagggagaagcaagagagagaacgttgtcatctgtgttcgggtataaaaagacaatctactgtgaagaccttagatgtctccatcctcctgctccagaagttccatcagattctttcaggctctagaatgggaatgtctctctgtggtatgcaagcaatgcctccactaactgactgcccaggctatgaagtcgagaccatgaagatcaccattctacactccgtgtcccctgctttctctgtgaaaatgtttcagcagagacatgtagtaaaattaaacctgtgaactgttttatcacaacccttcagctatgaaagccctgagccactgagtctgaataagagtacaaccaactcttgcagaaaacacagttttttcatgtgtacgtggagcattaaccaaaaccaacctttgtcaaggcataaaatatatcacaataaacaccaaataaatgaaatttaaggaatatgttatctgaccacaactagacactaaagacaagtaagattaaatcaggtagctaaaagtatccctatacttggaaattaaaactctctctctctgacacacacacacgcgtgcacacatttctaaataa

SEQ ID NO: 460895 - DNA, 782 bp, Homo sapiens
cccagcaggttcctgctgaggacctggtccgtgccggcccccgggtgatggcagtggacatgacagatgcactgggacctgcagcccagctgggagaggctggcttcccctgctggggagcctgcagccccttcatgaatcccctgcaggcgctggtggagaaacccataagcaactcacagttccagaaacggcttctgcagcaccggcctcccgcggccagcccaagggtcacgcaaggccaggagcttctccgcagggctgagggtctggagggggccctggcgtgcaagccctttgcaggtggtgacttgtggcgggaaccacttggagctgtgtggttcccatctggcctggagagaccaggggtggaacttggatgctgcctcttggggcagagcgatttccagcagggctctcttcctgaagtcacacacagctttgagcgcctggatttcaaggcaccagggggctgaaggcttctgtgtcacccccgtgctggcatcacttgaaccatcgcccatcaaatggtttctgactgggggaggactcctgttacaggctgagccatgtccctcaactttgtgtgttgcagccctgacccccagttcctcggaatgtgcctgtgtctgtagatagggtcttcagaaaggtattaataattgggctagaagccgggcgcggtggctcatgcctggaatcccagcattttgggaggccgagaccggcagaacacttgaggccaggctggtcttgaacttgtggcctcagtgatccacccg

SEQ ID NO: 460896 - DNA, 894 bp, Homo sapiens
gagggacctagaaagaaagaacatgaattcatcaatccattcagcagctattttgaacgcctcctgtgtgccagatgctgttctagaagctcagaatatctatgaacgcgataggcaatgcccccatatgccaaggccctcatatgctagccttgactcaaggaaaactgtaggatgggtaaacgattatgagggaaatgactctgaagcagaagacctgaatttcagggaggctttgccttcatcaagtcaggaaaacacacctagatcaaaggtttttgaaaataaagttaattcagagaaggtaaaactttctcttcggaatttcccacataatgattatgaggatgtttttgaagagccttcagaaagtggcagtgatcccagcatgtggacagccagaggccccttcggaagagacaggtggagcagtgaggatgaggaggctgcagggccatcacaggctctctcccctctactttctgtattccattcaccagttgaaggacactgtgttgtttccagattttggcaattatggataaaagtactacagatattcacaaactttgtgtaaacataagtttccattactttaagatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggtaaatattttcttaacgaaagtctatatgtgatttctttttttatatcattgccagagggtttcttttcttttctttctttatttggttttagtacattgtttttacttttaaatgttatatatattttaaagtaatagat

SEQ ID NO: 460897 - DNA, 516 bp, Homo sapiens
atggcccctgcgcaaggatgacacgcaaattcgtgaagcgttccatatttttagtgaggatgaggaggctgcagggccatcacaggctctctcccctctactttctgtattccattcaccagttgaaggacactgtgttgtttccagattttggcaattatggataaaagtactacagatattcacaaactttgtgtaaacataagtttccattactttaagatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggtaaatattttcttaacgaaagtctatatgtgatttctttttttatatcattgccagagggtttcttttcttttctttctttatttggttttagtacattgtttttacttttaaatgttatatatattttaaagtaatagat

SEQ ID NO: 460898 - DNA, 750 bp, Homo sapiens
gaaaaccaatgcatgaatttacaatgataattaacatagtcaagttaccatgggtgagaaagcaagacagacactcagtgtattattatagaaacaagaggacaatgaccgttatttttaacttaagaaatccacctggtcgaactactgcctgtctgccaggcagacacagctgctctcagggtctgccagagccacgttacagcctgctgggaaatatgccgatgagcgggagtttggcgtgggagtggggctttgttctggagcaagagaagatgctggtgatacttgttctaatctatgtctcaaagtttccgctgccacagagaattcaggggccccttcccagtttggagcgggtattaaagtcccaggattttcttataatagttggcatcgtgaacaggaccccagagatcaaacgatgagtcagggaggagtatctgcagagggaaccctgaggtgattggcatcaaccatgtggggtgaagttgcctggctgcttgacctttgtgggctgccatagtgactggtttaacagtaccaatacggcaacccaggctcactgggggtggcctccacccagaggcccgatcgccaatactacggagacgcaacaacatgtgcccttatagccactacctgttgtgcctattggaggatttcttgagcacaggagttcaagaccagcctggataacataatgagatcccatctctacaaaaataaaataaaataaaataaaaatta

SEQ ID NO: 460899 - DNA, 1304 bp, Homo sapiens
ggaccccggttgctagggtgtgtctccttggcctcctagagggtggggatccgtggtgcttcttcgggaacagcctcctgcaggaagaccctcgctggacctttacctcgctgcctagattccgaggaaaaggagataggagacgaaaagccagttggtttggaaagcggccgattatcctaaagggtagtgtgggagtccagcacttccatgcccctctttgggtactacggaagggagatttccagcatcgtgtggaacatatgaccagggagtacaccttgagcgcttgtgtgcagttatcttttggcggattatgaaaaacagcacttattattcattaaaatgcaaaagcccccactgcttcttcgaagacccttacctccaaaattcactaagctgtctttacatgagaaaaaaacccatacagctaaaactggtaaaattgagtcactacatgtagcattcactgaagatgaaaccacttccattaaaatggatagaactcgttttcctgatgttttaagaaatcaatcactaacacctatcaatatccaaaatatctttcttgatcactgtgtacaagaaagagtgactgcaatttcatcaccccagaaatctactaagcatgtccgtgagcagattccagatactgctactggttccatattttttccacattgtaattcagcttctactcgaatttttgggaaacaaacaaacaaaatggaaagttcaagaaagtttaaaactatgaaagatgtttatactgaaaaaaggctagaaaacattttaattctttcttccaagttttccaaacctaaaagtactcctggctcagttatcgctcaaaaacttgagaaaatgcaccctaagcatcaacctttaccagagagtccaggctatacttatcagcacatctcgagagacttaagtgcaacagtgccaagccctccacctatgactgtatctatgaaaccagaaggacagtggcctgaacattttaaatcaactgctacattgacactaagagttactgaatttccaggttttgtttccttgccaacaccagttttaccaagaaaacctcacaggcagtctgtgatagaagtcctgaccttgcagatctgccaaggccagactgggtactccattcagatggtgataatgggaaccaacaagggaattcaaaggatcggaaaagctaatataaagaagcaaaactcttgtaacagaaaatggaaatatagaaagtgtcccaaagcaaatcccaccaagaccacctgaaggtaaatgctagattt

SEQ ID NO: 460900 - DNA, 694 bp, Homo sapiens
ccttggcctcctagagggtggggatccgtggtgcttcttcgggaacagcctcctgcaggaagaccctcgctggacctttacctcgctgcctagattccgaggaaaaggagataggagacgaaaagccagttggtttggaaagcggccgattatcctaaagggtagtgtgggagtccagcacttccatgcccctctttgggtactacggaagggagatttccagcatcgtgtggaacatatgaccagggagtacaccttgagcgcttgtgtgcagttatcttttggcggtaaacggcccatttgtgcagtttcagggtgttcccttctaggctatcaatggaataatgccgtgccaggcacttttgatgttgccctgcaaactaaaagcacattttgggggtgcatcttctcgcattatttctaaacagtatgagttgggatccagcagccctgggaaatctcattatagtgaaacccatcttattttaggattgaattgttttggcccaagcatagtggttgaaaaacaagccattatagaaagaaaacaatttgtttgtgaatggttagatatggtgggtcttcagaggcttatctaatgaaggcatcttctacacatttctgaccaaattctctttctacatttatagcgataacattttggagagagagaaaaaaaatgtcatttcgacta

SEQ ID NO: 460901 - DNA, 514 bp, Homo sapiens
ggaccccggttgctagggtgtgtctccttggcctcctagagggtggggatccgtggtgcttcttcgggaacagcctcctgcaggaagaccctcgctggacctttacctcgctgcctagattccgaggaaaaggagataggagacgaaaagccagttggtttggaaagcggccgattatcctaaagggtagtgtgggagtccagcacttccatgcccctctttgggtactacggaagggagatttccagcatcgtgtggaacatatgaccagggagtacaccttgagcgcttgtgtgcagttatcttttggcggattatgaaaaacagcacttattattcattaaaatgcaaaagcccccactgcttcttcgaagacccttacctccaaaattcactaagctgtctttacatgagaaaaaaacccatacagaaactcttgtaacagaaaatggaaatatagaaagtgtcccaaagcaaatcccaccaagaccacctgaaggtaaatgctagattt

SEQ ID NO: 460902 - DNA, 968 bp, Homo sapiens
ccccctttctttgtcagcagctggcctggactcccaggggagcctggtcaatattaatggacacgcaaggctgtggggcacacagggttttgtgattatggattatctcctgctcagcaccatcttgaaggtggagacaaaagttctcagccagggccaggaattccaagcccacagtgggtctggatttaaagtactattgtgcctgggcctgtgatgtcagcatcccccactcccagggggccctggagaacatggcatctcagagcagttcaaggggctcaagcagactgggcctcggaggactggccaggctgggaaaatgccattgtttcctgaatttccctggaccgcagccaccacctttaaagctttagttagttaatggggaaggatgaaagggggaaatttaatagggttcttccaaataaatggggattcacagcccaccgctgaatagcctaatgagatcctgcattgtgccagctgagcacctgccatcggcagcccatttaatcatcccagcaaccccacctgaattctcagaggctcagaagtcaagtcagctgcccaacgtcacccagctggtcacagtgagagccgagaatgcaggccagcatgtgtcctctgtcaagtacctagtccccgcacagtgtccagggcacagtgacggctggctgcagctgcccgagtctcctggacaatccacgaaacacatgcacaaaagcacgatccagagccaggcaggccaggccttctccacagcctctgctccccactccctgctgcctgccaccccctcctatcttcagagcctgtgcccggctttctctgctggccccccttttcagcggcaccccctcttcatgcacaaatggcttggagagggcgtgggccaccgcagatgagcgtgacacaatgactgaaggagcagagccgcctcacccagggcagtcagtttctcaagc

SEQ ID NO: 460903 - DNA, 374 bp, Homo sapiens
tagaagcaacaatcgcagacaaagagtacaacttgtttttgaagtagttccggagcaacagttcacgatgtgagtctccacacactgctctgtctgtctgcatggcagctagaatctaatcctgcctcctgtctgccatgagcctaaaaaatcttccagaaccaggagaccataactctctcttgtttaagtcacccagtgtgtgatgctttgtgacaggcagccctggcaaatgaataagctgccagggaacaggaactcccattgtggaattcacagaagtgagaaataaatatttgtgtgatccattatatgttttcggtttgtttgtcacagaaaccagttttatctcacctaagaggtgggaagagaac

SEQ ID NO: 460904 - DNA, 794 bp, Homo sapiens
cgatccttcgggtgaaataagatgatccacttcaacagatccatgcatttcagtagcacacaatacagttgtgcccgccttccccaacagcaccccctgctggttttcctcctacttcatcaagggtcctctcggttctctttgctgcgtcttcctcaggacttggaagaaggtggagtggggaagaaagcacttgccctcgtgtggtctttgggtgtgtgctgggttttgtcttccgagctggcccaagttccattctgggatatcctgatgggtctactgttgatgtctgcagttggtaaagtggacacagaaacaggtcaggagattgagctgaaagatcctttatcaggactggtaccttggcaagttgaagccatatgcacacttaagttgcatggaagcagagaaatcctgagtaagggcctgtggattctctctactttcctgcctttttcctacagtagttccggagcaacagttcacgatgtgagtctccacacactgctctgtctgtctgcatggcagctagaatctaatcctgcctcctgtctgccatgagcctaaaaaatcttccagaaccaggagaccataactctctcttgtttaagtcacccagtgtgtgatgctttgtgacaggcagccctggcaaatgaataagctgccagggaacaggaactcccattgtggaattcacagaagtgagaaataaatatttgtgtgatccattatatgttttcggtttgtttgtcacagaaaccagttttatctcacctaagaggtgggaagagaac

SEQ ID NO: 460905 - DNA, 1416 bp, Homo sapiens
ataggcttggaaaaagcaccattcagaaagaagcatcatagtgttgcattgttctgagaaacaaaatggggatttgtctgactgacaaagcacataatagtacaaatgtagcattccgccgcctgtgtgagatcttggaatgttgtgttcacaacacagaaaagctttacaggagccagacaggtgaggtgaggccaggtggacattatgccaaaccgtataacagatgcccacctatagaagacagcagctacttgctctatccaaatattgcaggtgagaagacagctgcagcgatagatagcccaatggaaacaaaatcgtattataaacctagaaacaggtgcatggcagccaagcaggaccacaagggaaaatgtcaggcggtcaggaggaacaaaggaggagcaagacaaatcaaacatcccacgtataaggacaccattagccacatgttccataaaactaccactaatccacctgttccaaagcagctgaacttgcaatttcaggcctgcaaagctaaaagacggccctatccctgtctcccttgggctgactctcttttcggactcagcccgcctgcacccaggtgaaataaacagccttgttgctcacacaaagcctgtttggtggtctcttcacacaaacgcgcatgaaatttggtgccatgactcggatcggggtacctcccttgggagatcaatccccagtcctcctgctctttgctccgtgagaaagatctacctaggacctcaggtcctcagactgaccagcccaaggaacatctcaccaatttcaaatctggaccccactgaaaatcggactgttcaactcatctggcagccactcccagagcccctggaactctggcccaagcctctctgactgactccttcccagatcttctcggcttagcagctgaagactgacactgcccaatcgccttggaagccccctagaccatcacggatgccgagcttcgagtaactctcacagtggagggaacgcgcatgaaaaaaccaaacaaacaaaaaaatttcttttggtagcagaataaaaaaacaaaaaaaaggactttttcttctggactgaactatatttaaatctcaaaggatggacatctcacaaccttcctacagcaagtactgtgaggtaataattgatatattaattattaaaattattgaagctggaactcagattccattttatattacctatttaattattctattaatgggttctagttaataagagaagcactgagtcttggggggtggatgggacctggatggtcccgttggaaatggcggacagggaaatcaagagggggaacgccaggggggacttgcgaaggactgacgggggaagtggaaaactttttttggggatgggaaaatgttgggaaaaacc

SEQ ID NO: 460906 - DNA, 3562 bp, Homo sapiens
ataggcttggaaaaagcaccattcagaaagaagcatcatagtgttgcattgttctgagaaacaaaatggggatttgtctgactgacaaagcacataatagtacaaatgtagcattccgccgcctgtgtgagatcttggaatgttgtgttcacaacacagaaaagctttacaggagccagacaggtgaggtgaggccaggtggacattatgccaaaccgtataacagatgcccacctatagaagacagcagctacttgctctatccaaatattgcaggtgagaagacagctgcagcgatagatagcccaatggaaacaaaatcgtattataaacctagaaacaggtgcatggcagccaagcaggaccacaagggaaaatgtcaggcggtcaggaggaacaaaggaggagcaagacaaatcaaacatcccacgtataaggacaccattagccacatgttccataaaactaccactaatccacctgttccaaagcagctgaacttgcaatttcaggcctgcaaagctaaaagacggccctatccctgtctcccttgggctgactctcttttcggactcagcccgcctgcacccaggtgaaataaacagccttgttgctcacacaaagcctgtttggtggtctcttcacacaaacgcgcatgaaatttggtgccatgactcggatcggggtacctcccttgggagatcaatccccagtcctcctgctctttgctccgtgagaaagatctacctaggacctcaggtcctcagactgaccagcccaaggaacatctcaccaatttcaaatctggaacgcgcatgaaaaaaccaaacaaacaaaaaaatttcttttggtagcagaataaaaaaacaaaaaaaaggactttttcttctggactgaactatatttaaatctcaaaggatggacatctcacaaccttcctacagcaagtactgtgagagctgcatcttgtcccactggatggtcttcagagacaataatacataatggagctgtcatctcctatgataacaatgccttcttctggatacctcctgaaggacctgcctgaggctctttcactccatgtaaaggtgtgctgctttccctttgccttccgccattattgaaagtttcctgaggcctccccagccatgctacctgtacgacctgtgaaaccataagccaataaaagatactagcgccagtctggcaggggccttttctagtctcaagcacgctgagcagtcctacaccttgccttctgagagagaagaggacagtcctcagcctcctgaagcctggcaagggtgccttagtgaggacatcatctgcaactcccagatggatagacgaggccatggagagaggagaacaccaacccatgagtgacaagtgcctgtcattgtcaatgatgctgcaagcaccacgatgccccttcttagcagggacccagtgggccttaccagcttcattattttctaggcatgatcgcatcctgtctcccatttttgctaaaattctatctagagaaagagctcatttttagctaaaaaaaaaaaaatcctgttttatctgctaaaaaatcacataaaataactattggactgtttgaaatggcgtggcctctgctctgacttattaactgtgatcttgactaagttaagcagtcactctgaccttacgttactccctcaaatttgaataaaaatagcaacttcctctacttataaattacttctaaaaattagattcttgagattcaaagataggcaatggaccacctttgtatttaaagtcttttctttaaaaagattttaaatttcagaaaaagcctttgcacttaaacagtgcttccttttctgtcactttcatgcttaaatggtcgtccaatttgacattaactttatcgagaataataagtctcaatagagcttctattatccagtgttctgtgagtaggtagcacttcagttgaaagaagattattccatttttatattttctggaacactagaggaaaatctcagacattgtcacatttcatttgcagatcaaatcaggcagctgtcatacttactaactcatgcaacagattataaaccaagccaacaataaaatgacaggaaatcaacctaaaattgtagacaatatggacataataattttgtgtccttgaacactgacattcattttttaaggtaagggattatttagtacttataactgaacaacagttttaactgtatatgaagataaaaaacactgtcctatgttctcaaactataataatgttttatgtcttataaatctctgtacaaataaatataaaaccatttgttttgatggcaaaattaaaaaaataagctgtagctatttaaacttggttgctctgaattttaataacttttaataattaaaatataaagacaaacactatttataatgttatgcttcaataagattgttttgaagtatacaaggacagagagaagccaggcagctgtggttcaaatcctagacctggtgatttcaagcaatgtgaacatttagcaaattacttgatcactgtgtgtcctagatttttttaaatctacaaaataaggataatagtgcctattgaagagagatccatataaagtatgtaaagtgctataacatatgaagcagtcaatttatatttgctacaattattatatttgaatgtatatggttctttgaagacaatattgttgctattggttttacttctatgaatgttcttgacttaaaatattgatgattttgcaccttagttgattgcacctaagttgatgtgcccagctaatattcaatatctgtcaatgtccatatagctaatgacaactctaccctatggtgattagtactcatgattgtaaattttgaaaattattttgaaatcttgctgacagtctggctttgctgctgaagttcaagctttaccttgcccacaacttttgttccacaggacctgagttcaaaatgtttcttgccagttgatctttgtcttagaaaatttcagcaaaatgttctggtggaggaaggttttttggtgtggaacaacagacataaactatggaaatgcacagaagtaaaggcatttttcagagaaccaaaggtaatatatcctgcattaaaatcactgagatacggatcagaagtcctgaatttttatgccagatcaataacttgcctattaagtaattaagattatctgagccccaatttcttccatataagatacctctgctatgattagtgagtttttcataagttatgaaaatgttgatcaagagttcgggaatgatgttaggacaacgttcctgctctctgctgatccacttttccatttaataacaagagtaatatatcactttttagcatgttaccatgtcacttaaaacttaaaaactaaaatttgtaatgatttctcattgctttcatttgaaatccaaatgtctctggtggtgtataaggtgctaggtgtcatggtttcttccacccccacgcgactgtgcttgatttctctcagttcacacaattt

SEQ ID NO: 460907 - DNA, 522 bp, Homo sapiens
gcaagtcagctcctggaaggtggaagtgttttgttctccattgcatctcctgggatttttgccataggcttttctgtactgtttgcatttctggttgtttgcttgaattacctctttgggacgtgaggaatttacactaaaacacctgtttctttacagaaaagatactagcgccagtctggcaggggccttttctagtctcaagcacgctgagcagtcctacaccttgccttctgagagagaagaggacagtcctcagcctcctgaagcctggcaagggtgccttagtgaggacatcatctgcaactcccagatggatagacgaggccatggagagaggagaacaccaacccatgagtgacaagtgcctgtcattgtcaatgatgctgcaagcaccacgatgccccttcttagcagggacccagtgggccttaccagcttcattattttctaggcatgatcgcatcctgtctcccatttttgctaaaattctatctagagaaagagctcatttttagctaa

SEQ ID NO: 460908 - DNA, 3530 bp, Homo sapiens
ataggcttggaaaaagcaccattcagaaagaagcatcatagtgttgcattgttctgagaaacaaaatggggatttgtctgactgacaaagcacataatagtacaaatgtagcattccgccgcctgtgtgagatcttggaatgttgtgttcacaacacagaaaagctttacaggagccagacaggtgaggtgaggccaggtggacattatgccaaaccgtataacagatgcccacctatagaagacagcagctacttgctctatccaaatattgcaggtgagaagacagctgcagcgatagatagcccaatggaaacaaaatcgtattataaacctagaaacaggtgcatggcagccaagcaggaccacaagggaaaatgtcaggcggtcaggaggaacaaaggaggagcaagacaaatcaaacatcccacgtataaggacaccattagccacatgttccataaaactaccactaatccacctgttccaaagcagctgaacttgcaatttcaggcctgcaaagctaaaagacggccctatccctgtctcccttgggctgactctcttttcggactcagcccgcctgcacccaggtgaaataaacagccttgttgctcacacaaagcctgtttggtggtctcttcacacaaacgcgcatgaaatttggtgccatgactcggatcggggtacctcccttgggagatcaatccccagtcctcctgctctttgctccgtgagaaagatctacctaggacctcaggtcctcagactgaccagcccaaggaacatctcaccaatttcaaatctggaccccactgaaaatcggactgttcaactcatctggcagccactcccagagcccctggaactctggcccaagcctctctgactgactccttcccagatcttctcggcttagcagctgaagactgacactgcccaatcgccttggaagccccctagaccatcacggatgccgagcttcgagtaactctcacagtggagggaacgcgcatgaaaaaaccaaacaaacaaaaaaatttcttttggtagcagaataaaaaaacaaaaaaaaggactttttcttctggactgaactatatttaaatctcaaaggatggacatctcacaaccttcctacagcaagtactgtgagaaaagatactagcgccagtctggcaggggccttttctagtctcaagcacgctgagcagtcctacaccttgccttctgagagagaagaggacagtcctcagcctcctgaagcctggcaagggtgccttagtgaggacatcatctgcaactcccagatggatagacgaggccatggagagaggagaacaccaacccatgagtgacaagtgcctgtcattgtcaatgatgctgcaagcaccacgatgccccttcttagcagggacccagtgggccttaccagcttcattattttctaggcatgatcgcatcctgtctcccatttttgctaaaattctatctagagaaagagctcatttttagctaaaaaaaaaaaaatcctgttttatctgctaaaaaatcacataaaataactattggactgtttgaaatggcgtggcctctgctctgacttattaactgtgatcttgactaagttaagcagtcactctgaccttacgttactccctcaaatttgaataaaaatagcaacttcctctacttataaattacttctaaaaattagattcttgagattcaaagataggcaatggaccacctttgtatttaaagtcttttctttaaaaagattttaaatttcagaaaaagcctttgcacttaaacagtgcttccttttctgtcactttcatgcttaaatggtcgtccaatttgacattaactttatcgagaataataagtctcaatagagcttctattatccagtgttctgtgagtaggtagcacttcagttgaaagaagattattccatttttatattttctggaacactagaggaaaatctcagacattgtcacatttcatttgcagatcaaatcaggcagctgtcatacttactaactcatgcaacagattataaaccaagccaacaataaaatgacaggaaatcaacctaaaattgtagacaatatggacataataattttgtgtccttgaacactgacattcattttttaaggtaagggattatttagtacttataactgaacaacagttttaactgtatatgaagataaaaaacactgtcctatgttctcaaactataataatgttttatgtcttataaatctctgtacaaataaatataaaaccatttgttttgatggcaaaattaaaaaaataagctgtagctatttaaacttggttgctctgaattttaataacttttaataattaaaatataaagacaaacactatttataatgttatgcttcaataagattgttttgaagtatacaaggacagagagaagccaggcagctgtggttcaaatcctagacctggtgatttcaagcaatgtgaacatttagcaaattacttgatcactgtgtgtcctagatttttttaaatctacaaaataaggataatagtgcctattgaagagagatccatataaagtatgtaaagtgctataacatatgaagcagtcaatttatatttgctacaattattatatttgaatgtatatggttctttgaagacaatattgttgctattggttttacttctatgaatgttcttgacttaaaatattgatgattttgcaccttagttgattgcacctaagttgatgtgcccagctaatattcaatatctgtcaatgtccatatagctaatgacaactctaccctatggtgattagtactcatgattgtaaattttgaaaattattttgaaatcttgctgacagtctggctttgctgctgaagttcaagctttaccttgcccacaacttttgttccacaggacctgagttcaaaatgtttcttgccagttgatctttgtcttagaaaatttcagcaaaatgttctggtggaggaaggttttttggtgtggaacaacagacataaactatggaaatgcacagaagtaaaggcatttttcagagaaccaaaggtaatatatcctgcattaaaatcactgagatacggatcagaagtcctgaatttttatgccagatcaataacttgcctattaagtaattaagattatctgagccccaatttcttccatataagatacctctgctatgattagtgagtttttcataagttatgaaaatgttgatcaagagttcgggaatgatgttaggacaacgttcctgctctctgctgatccacttttccatttaataacaagagtaatatatcactttttagcatgttaccatgtcacttaaaacttaaaaactaaaatttgtaatgatttctcattgctttcatttgaaatccaaatgtctctggtggtgtataaggtgctaggtgtcatggtttcttccacccccacgcgactgtgcttgatttctctcagttcacacaattt

SEQ ID NO: 460909 - DNA, 1279 bp, Homo sapiens
ataggcttggaaaaagcaccattcagaaagaagcatcatagtgttgcattgttctgagaaacaaaatggggatttgtctgactgacaaagcacataatagtacaaatgtagcattccgccgcctgtgtgagatcttggaatgttgtgttcacaacacagaaaagctttacaggagccagacaggtgaggtgaggccaggtggacattatgccaaaccgtataacagatgcccacctatagaagacagcagctacttgctctatccaaatattgcaggtgagaagacagctgcagcgatagatagcccaatggaaacaaaatcgtattataaacctagaaacaggtgcatggcagccaagcaggaccacaagggaaaatgtcaggcggtcaggaggaacaaaggaggagcaagacaaatcaaacatcccacgtataaggacaccattagccacatgttccataaaactaccactaatccacctgttccaaagcagctgaacttgcaatttcaggcctgcaaagctaaaagacggccctatccctgtctcccttgggctgactctcttttcggactcagcccgcctgcacccaggtgaaataaacagccttgttgctcacacaaagcctgtttggtggtctcttcacacaaacgcgcatgaaatttggtgccatgactcggatcggggtacctcccttgggagatcaatccccagtcctcctgctctttgctccgtgagaaagatctacctaggacctcaggtcctcagactgaccagcccaaggaacatctcaccaatttcaaatctggaccccactgaaaatcggactgttcaactcatctggcagccactcccagagcccctggaactctggcccaagcctctctgactgactccttcccagatcttctcggcttagcagctgaagactgacactgcccaatcgccttggaagccccctagaccatcacggatgccgagcttcgagtaactctcacagtggagggaacgcgcatgaaaaaaccaaacaaacaaaaaaatttcttttggtagcagaataaaaaaacaaaaaaaaggactttttcttctggactgaactatatttaaatctcaaaggatggacatctcacaaccttcctacagcaagtactgtgagaactcaaagggggagagaaaaagacgaaaaatatcttcaagaggagaacaaatctgatctttctctacgtctgcttagttggcgtaactttaggatgtccataagttgtagctttcctgggaaa

SEQ ID NO: 460910 - DNA, 3036 bp, Homo sapiens
cagcagtagcacctggggggctagttaaaacacagtctccaattcgctgttgtttcctttttaaattagtgagtcgtgttccattgtatgaatataccattgatttgttcacgcaacctcctgttggctccgcgaccacccacggttaaagaagcagctgctagagcaacccctcacccacccaccggaacttccctccaggccatgggacgttggtctcagccggaacttccgtccaggcagtgggaccttggcctcagccataagcatccaagccgccgtcgttgggagactggccttcccattggcagggtgcactgtccatcacagatctcagggctctcattggccatcgtatggcaggggtggagctcaccacgcttcgtccgcgtgctccccacgtgaaggcacccgccctgcgcgtgtgaaagggcgagagcagcgcgagatagggcctagcgcctcagatcttcgttggcggccatggcttcggcttctcagggcgctgacgacgacggcagtcgtaggaagccccgcctggctgcatcgttgcagatcagcccccagccccgcccctggcgaccgctacccgcccaggcccaaagtgcctgggagcccgcgcccgcgcccgcgacgtatcgcgcggagggcgggtggccccaggtctcggtgttgagggacagtgggcctggggcaggggccggagtcggggaactgggggcagcccgggcgtgggaaaacttgggggaacagatggggaaggccccgagggtccctgtgcccccagcagggctcagcctgccgctcaaagacccacctgccagccaggccgtgtccttgctcacggagtacgcggccagcctgggcatcttcctgctcttccgggaggaccagccaccaggtccctgcttccccttctcggtgagcgcggaactggatggggtggtctgccctgcgggcactgcgaatagcaagacggaggccaaacagcaggcagcgctctctgccctctgctacatccggagtcagctggagaacccagagtccccccagacctccagccggcctccactggcccccctgagcgtagagaacatcctgacccatgagcagcgctgcgcagcgttggtgagcgccggctttgacctcctgttggacgagcgctcgccatactgggcctgtaaggggactgtggctggagtcatcctggagagggagatcccgcgtgccaggggccacgtgaaggagatctacaagctggtggctctgggcaccggcagcagctgctgtgctggctggctggagttctcgggccagcagctccacgactgccatggcctggtcatcgcccgcagggccctgctgaggttcttgttccggcagctcctgctggccacacaggggggccccaagggcaaggagcagtccgtgctggccccccagccagggcccggacccccattcaccctcaagccccgcgtcttcctgcacctctacatcagcaacacccccaagggcgcggcccgtgacatctacctgccccccacctcggaaggtggcctcccgcacagcccacccatgcgcctgcaggcccatgtgctcgggcagctgaagcctgtgtgctacgtggcgccctcgctctgtgacacccacgtgggctgcctgtcagccagtgacaagctggcacgctgggccgtgctggggctgggtggtgccctgctggcccacctggtgtccccactctacagcaccagcctcatcctggctgactcatgccacgaccctccgactctgagcagggccatccacacccggccctgcctggacagtgtcctggggccatgcctgccacctccctacgtccggaccgccctgcacctgtttgcagggcccccggtggccccttccgaacccacccctgacacctgccgtggcctgagcctcaactggagcctgggggaccctggcatcgaggttgtggatgtggccaccgggcgtgtgaaggccaatgccgccctggggcctccctcccgtctctgcaaggcctcctttctccgggcctttcaccaggcggccagggctgtggggaagccctacctcctggccttgaagacctacgaggctgccaaggctgggccctaccaggaggctcgcaggcagctgtctctcctcctggaccagcagggcctgggggcttggccctcgaagccactggtgggcaaattcagaaactgaagccagcctcggcgggaccgaggtcccggagccaagctgtacccctgctgggggagtgccctatctgaggagcgttgtggggagaacatgggttgtgcggggtgaaactggggctggagggaaggaggagcctgctgtggttgggaggcggctgctgcacgtttgggcttgaataaagaagtatttctggttcctgtgtgtgtagttggctgtgtgtgtgtgtgtgtgtgtgtttatgtgttggggtggccaggggccctttgtttgcggagagagcccctcactcctcctttgggaggccctgtgttcactgggttcccacctggatcctctcactgagccactgaattgtcacccccgcccctgttcacagggctggaggcaggtttaggaggggaggtgacctcccctggttcctcctgttttccagcctgtgtgctggaggagaccacggaggccacgggttgcgggtgttgtaaagggtgggagggcaggctgcttggatgtgtgagcattttgtcctctggccgctattggggctccaaatccttgcctttctgggcccccaggatgtgtgggagggcagagaacacccttccctggtcagagctttagctgccctggccctcgagggtgctgtggggtctgggcagccccatgttgaagggcgtggggagggcatgagcagcatcagtgctttccctgggccgcccggctgttggacctgggcgaggcattggaccgctagagcctgcgtcttccaccatggagagggacagtgctcctgccctgtgtgggctc

SEQ ID NO: 460911 - DNA, 722 bp, Homo sapiens
cgcgagatagggcctagcgcctcagatcttcgttggcggccatggcttcggcttctcagggcgctgacgacgacggcagtcgtaggaagccccgcctggctgcatcgttgcagatcagcccccagccccgcccctggcgaccgctacccgcccaggcccaaagtgcctgggagcccgcgcccgcgcccgcgacgtatcgcgcggagggcgggtggccccaggtctcggtgttgagggacagtgggcctggggcaggggccggagtcggggaactgggggcagcccgggcgtgggaaaacttgggggaacagatggggaaggccccgagggtccctgtgcccccagcagggctcagcctgccgctcaaagacccacctgccagccaggccgtgtccttgctcacggagtacgcggccagcctgggcatcttcctgctcttccgggaggaccagccaccaggtgaggccgggccggggcatggctgtgccagagggcagagccacggagggctgggtcccaggacgtggggagcagggggtctggggaaggtggaccttggtccctatgctcagagacaccgccggagcaggacctggcctgagcttgggaccttggggtggaccctgctgtgagcagcgatctccaaggatcaccagccacaccagatgctcaactgtgaaagagtcatggcaggtgaacattcttcccacctgacttccagg

SEQ ID NO: 460912 - DNA, 1512 bp, Homo sapiens
cagcagtagcacctggggggctagttaaaacacagtctccaattcgctgttgtttcctttttaaattagtgagtcgtgttccattgtatgaatataccattgatttgttcacgcaacctcctgttggctccgcgaccacccacggttaaagaagcagctgctagagcaacccctcacccacccaccggaacttccctccaggccatgggacgttggtctcagccggaacttccgtccaggcagtgggaccttggcctcagccataagcatccaagccgccgtcgttgggagactggccttcccattggcagggtgcactgtccatcacagatctcagggctctcattggccatcgtatggcaggggtggagctcaccacgcttcgtccgcgtgctccccacgtgaaggcacccgccctgcgcgtgtgaaagggcgagagcagcgcgagatagggcctagcgcctcagatcttcgttggcggccatggcttcggcttctcagggcgctgacgacgacggcagtcgtaggaagccccgcctggctgcatcgttgcagatcagcccccagccccgcccctggcgaccgctacccgcccaggcccaaagtgcctgggagcccgcgcccgcgcccgcgacgtatcgcgcggagggcgggtggccccaggtctcggtgttgagggacagtgggcctggggcaggggccggagtcggggaactgggggcagcccgggcgtgggaaaacttgggggaacagatggggaaggccccgagggtccctgtgcccccagcagggctcagcctgccgctcaaagacccacctgccagccaggccgtgtccttgctcacggagtacgcggccagcctgggcatcttcctgctcttccgggaggaccagccaccaggtccctgcttccccttctcggtgagcgcggaactggatggggtggtctgccctgcgggcactgcgaatagcaagacggaggccaaacagcaggcagcgctctctgccctctgctacatccggagtcagctggagaacccagagaacatcctgacccatgagcagcgctgcgcagcgttggtgagcgccggctttgacctcctgttggacgagcgctcgccatactgggcctgtaaggggactgtggctggagtcatcctggagagggagatcccgcgtgccaggggccacgtgaaggagatctacaagctggtggctctgggcaccggcagcagctgctgtgctggctggctggagttctcgggccagcagctccacgactgccatggcctggtcatcgcccgcagggccctgctgaggttcttgttccggcagctcctgctggccacacaggggggccccaagggcaaggagcagtccgtgctggccccccagccagggcccggacccccattcaccctcaagccccgcgtcttcctgcacctctacatcagcaacacccccaagggcgcggcccgtgacatctagtatgcagggcccccggggcaggcg

SEQ ID NO: 460913 - DNA, 2671 bp, Homo sapiens
cacagagacagtaaccaccagcttcagcttttggacactaaatttaaaggtacagttgaggaactcagtaaccagatattatctgcacggagttggttgcaacaggaacaagaacggatagaaaaagagcttttacagaaaattgatcagctttccttgattgttaaggaaaacagtggagccagtgaaagggatatggagaagaagctcagccagatgtcagccaggcttgacaaaatagaagagggtcaaaagaagacttttgatggtcagagaacaaggcaagaagaggagaagatgcacgggcgaatcaccaagctggagttacagatgaaccagaacatcaaggaaatgaaagcagaagttaatgctgggtttacagccgtctatgaaagcataggatccctcaggcaagttctcgaggccaagatgaagctggacagggaccagctacagaagcaaatccagctgatgcagaagccagagacccccatgtgaagggagctgggacaaggtcctaaaagacagttttgccagtggggctaggagccggatacctctgtagccaggccatcgctgcattcaggattgttccatccatggcgtgcatgtgccaagaaatgtgtttttatgggtctaaatgtttaccttgagtcttgaaaatactcttttgttaaaagtatgaaatacagtttttaccagtttatttcacttctctaaattcaatggaaatcccccgccctggattttgaaaggcttttatcttcttcattttacgaatggaaagacgacaatttttcttcaatgcttgatgcactaatgaagactgtttactattttgaaaaatgtcatggggatttttttttaattaagaaactaatgaatcatcacaggaatgtgttgctcctcaccctaaattaagagaatgtcccagtagattagacttcaacctttgagtccaatttggattttattatcgttgtctatgcacttcttatattggttatcttcttgtaaatcttctgtcttttgtaaggggaaaggatttaacatttagaataaaccccaccatttatgtaatggaaatagtttaaaaattgctaactgccatgtggattgcaaattaaatggaaacttatttagataacgtaaggctcaatatctgcgttgaccacctagatattacaggttttaatatttaaaactatttttgaattatccacaacctgtatagtgatagccatatatttaataatggaatggtggttaacagtctatttactgcacaattaattgttcactaatcaaatagaatgtggtaatttttcagactttatgatctgtttccaaaattggcacaaagtgctagggtttatatacacttatcgtaactgtatttttgtgccttggttttatcatgtcaatgcactgtactctgtaaaagttttgcagacaaaatagaaagtatgataatccgtcagaagtatgatgtaaaactggaatcctctgtattttttaaatgttctaaaaattttatcgctgttaaggtattaatcattcagtattactaatggaatagaaattcatacttttgtatggacaacaattcaaattgatattgcatttatagcactgtaagaaactttcatcttgagcaactttgtagatgatgggtgttttattttcaatcgccatatttgatcagtcattgaaaattggccccagtgctgtttgttcatctctgtatgtaaaaactgacagtgagacacaacgttctgaactgtgagggtgtcccaggaaaaagaaaaacaggaatactttaacaattaaaaagaaaaaaatgttttttgtttgccaaggactcaggaaaataaaaagcattttctatttttaggacaaatcacaaatgaagtgtctaactggctattactgtttacccatataaaatatgctgctaaagtacatattttgctgtcaatggcttgacaattttttttttcaaatttggacatgagaggttatatagggactatattatccaacacatattttcttattttgccacaaatttccacttaacaaataaaaaaaggcgaatgctgttttgcaatcagaaagtgaatttcttttgtggtagcgtacacgtggttcatgtggttctccacgtttaagcacaaaccacagcacaggaagccacaccccctccagcatctctgtcttgtggggtctttgaggagaaggaatcagaacatcgacacctgggaagagggaggcggggaacaccagctggactctggccaaggagtgatgtaagcaggtgacacttggctgtcagctgagcttctcaggtgcttctgacattgccagccccttgagatgagccaccgcaggtgtgctcaccttggctacatgttgaaatcatccagaggagttgggaaatctactgatgccccgctgtgcctcccagaccgattaagtcagaacctctgggaggtgggtcgcaggcatcagtgcgtgcccgaggcctccgcgtgtttgggtgtgcagccgaggtggtgagctgtcgagccacagtgcagttctcttctcaccaaagctcaaatgagaatcagcttccatgttctttcctttaccagaaatttgcaataaaaagaaaaataaaattttcaca

SEQ ID NO: 460914 - DNA, 2799 bp, Homo sapiens
  misc_feature (2)..(3): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (11)..(11): n is a, c, g, or t
  misc_feature (13)..(13): n is a, c, g, or t
  misc_feature (15)..(16): n is a, c, g, or t
gnncntncncntngnngggacatggatggatctggaagccattatcctcagcaaagtaacacaggaacagaaaaccaaacaccacatgttcttacttataagtgggagctgaacaatgagaacatatttaaaggtacagttgaggaactcagtaaccagatattatctgcacggagttggttgcaacaggaacaagaacggatagaaaaagagcttttacagaaaattgatcagctttccttgattgttaaggaaaacagtggagccagtgaaagggatatggagaagaagctcagccagatgtcagccaggcttgacaaaatagaagagggtcaaaagaagacttttgatggtcagagaacaaggcaagaagaggagaagatgcacgggcgaatcaccaagctggagttacagatgaaccagaacatcaaggaaatgaaagcagaagttaatgctgggtttacagccgtctatgaaagcataggatccctcaggcaagttctcgaggccaagatgaagctggacagggaccagctacagaagcaaatccagctgatgcagaagccagagacccccatgtgaagggagctgggacaaggtcctaaaagacagttttgccagtggggctaggagccggatacctctgtagccaggccatcgctgcattcaggattgttccatccatggcgtgcatgtgccaagaaatgtgtttttatgggtctaaatgtttaccttgagtcttgaaaatactcttttgttaaaagtatgaaatacagtttttaccagtttatttcacttctctaaattcaatggaaatcccccgccctggattttgaaaggcttttatcttcttcattttacgaatggaaagacgacaatttttcttcaatgcttgatgcactaatgaagactgtttactattttgaaaaatgtcatggggatttttttttaattaagaaactaatgaatcatcacaggaatgtgttgctcctcaccctaaattaagagaatgtcccagtagattagacttcaacctttgagtccaatttggattttattatcgttgtctatgcacttcttatattggttatcttcttgtaaatcttctgtcttttgtaaggggaaaggatttaacatttagaataaaccccaccatttatgtaatggaaatagtttaaaaattgctaactgccatgtggattgcaaattaaatggaaacttatttagataacgtaaggctcaatatctgcgttgaccacctagatattacaggttttaatatttaaaactatttttgaattatccacaacctgtatagtgatagccatatatttaataatggaatggtggttaacagtctatttactgcacaattaattgttcactaatcaaatagaatgtggtaatttttcagactttatgatctgtttccaaaattggcacaaagtgctagggtttatatacacttatcgtaactgtatttttgtgccttggttttatcatgtcaatgcactgtactctgtaaaagttttgcagacaaaatagaaagtatgataatccgtcagaagtatgatgtaaaactggaatcctctgtattttttaaatgttctaaaaattttatcgctgttaaggtattaatcattcagtattactaatggaatagaaattcatacttttgtatggacaacaattcaaattgatattgcatttatagcactgtaagaaactttcatcttgagcaactttgtagatgatgggtgttttattttcaatcgccatatttgatcagtcattgaaaattggccccagtgctgtttgttcatctctgtatgtaaaaactgacagtgagacacaacgttctgaactgtgagggtgtcccaggaaaaagaaaaacaggaatactttaacaattaaaaagaaaaaaatgttttttgtttgccaaggactcaggaaaataaaaagcattttctatttttaggacaaatcacaaatgaagtgtctaactggctattactgtttacccatataaaatatgctgctaaagtacatattttgctgtcaatggcttgacaattttttttttcaaatttggacatgagaggttatatagggactatattatccaacacatattttcttattttgccacaaatttccacttaacaaataaaaaaaggcgaatgctgttttgcaatcagaaagtgaatttcttttgtggtagcgtacacgtggttcatgtggttctccacgtttaagcacaaaccacagcacaggaagccacaccccctccagcatctctgtcttgtggggtctttgaggagaaggaatcagaacatcgacacctgggaagagggaggcggggaacaccagctggactctggccaaggagtgatgtaagcaggtgacacttggctgtcagctgagcttctcaggtgcttctgacattgccagccccttgagatgagccaccgcaggtgtgctcaccttggctacatgttgaaatcatccagaggagttgggaaatctactgatgccccgctgtgcctcccagaccgattaagtcagaacctctgggaggtgggtcgcaggcatcagtgcgtgcccgaggcctccgcgtgtttgggtgtgcagccgaggtggtgagctgtcgagccacagtgcagttctcttctcaccaaagctcaaatgagaatcagcttccatgttctttcctttaccagaaatttgcaataaaaagaaaaataaaattttcacataaatgtggtgtatgatttttaaattgaaaagtctttcagtgtt

SEQ ID NO: 460915 - DNA, 1463 bp, Homo sapiens
tgctctaagaaaagaaagttttgggcctagagtcaggaaaaagccttttcaagtcaagctgagaactttaaggtggtcttggctacctcattttatgcaaagtaggcagaaaatttaaaagaaaagaaacatatttaagtacaattaagaaaattacagtgtttcagttaaagcagttcagtgctttttagaaaaggagctgaaattaaataagttgaacttcctctctttttagaagaatggatttctcggagtctgaaaaatttatggttcttctctggaagaattttattttaaagaggcggcgatgtattgctttagttgtggaaatggtcctcacatttctgtttagtgctgcgcttttggcaacacgctctgttattactataaataagaacggacctttcgattttgctgctcagcctgtcgatgaagtgcctttctacatcacagcttccttaatttctccttctcctttggaattggcttacgtgccttccagaagtactgtggttcagggtattattgaaagagtgaaaatggatttaaaccctcaaatgaaaggttagaaattaacattttctgaaaaaacatacagaattactaaatcgatttagtgaagacatacttacaaccttattaactggttcttaacctcccaagtaaaacatcgttggaatcctcatactaagtataaatattatggactttgttaaacttgaaagttaaatttatataaaatattttgttcatagagcccagaacaaatagtaatatttcaaaatgagatgaccaattattattattattctaagttgttatccagttttgtgatactgttttttctatctggttgtgcttcttgaacctggctaagccttgcccccagaggtggagtctacagaggcaggcaggcctcgagctgtggtgggctccacccagttcaaacttcccagccgctttgtttacctggtcaagcctcagcaatggcagacgcccctcctgcagcttggctgccacctcacagtttgatctcggactgctgtgctagcagtgagcaatgctccgtgggcatgggacctactgagccatgtgtgggatataatctcctggtgtgccgtttgctaagactgttggaaaagcacagtgttatggcgggagtgtcccgatattccaggttgaacctgcaccagtcatccaaagcagtgacccaacgcttatctttatctttttgctgttttatgccatcgccacaatatgcttcagctttatggttagcactttcttcagtagaggccctcaacagattggatgatgcctgcccacattggggaggaccatctgctttactgagtccactgattcaaatgcttatctcatttggcaacctcctcacagacacacccagaaataatgtttaatctgtatactccatggagagtcaagttggcacataaaatgaa

SEQ ID NO: 460916 - DNA, 875 bp, Homo sapiens
accagtatgaagtccataggagcctatgtggcattggctcactgagacaagagctagaacaagagacagatgagatcgggcgcattcagggtggtatggccgtagaccagggtggtatggccatagactcaataattgttcaacagcaatgcagaggtctgtcctctcataaagaggatggaccaagttgtgtcaacagttgttctgtggcaatattatatgtgatatgtggagctgtagagaagcctctccctgtggccactaccaccaccaacccacagcaggttttgccaggccaccaccaatgttcacttaaagccgaaaagctcttcggtcatctgaagaggtcaggtctagaaatgctttccaagagcctaggcctggacctggggaccctaagaacccacttgttgctctacccaactgtggccaagctcgtacctaagggcaacactgagttcgatgtaaagtcccacagtcactgtgttttcccctccccaggtgcacagactcctcgcaatgcaaggccactgccagggaatgctggaggggtgatgctagcaattgaagattgtctctcctaccctcttcaatgcctctttcagcaatatgaagttaaaaccagattagtgttgggtctgaagttccaaatcctgctgcctctgtgaagtctttctgctcatgctagaagcaatatcacctcttctagaattgtaaagtgccattttccataccacttataatatactgtcttgtagatgtttttctgtcgtctgtatttcatccctctaatagatgataaatttctagaggatgcctcccacagaaaaagtgctcaataaatatctgtcattggtgaaaacagattatagatg

SEQ ID NO: 460917 - DNA, 949 bp, Homo sapiens
ctcggtaaggtgctccagctgcttctatcatagcacttcctacatggactgtaacatttctttactgctccaacttctcattaaattgggggctcctcaaagccagggttggtgccttataagtttcttgcttcctggtgcccagagcagcctctggcatgagctgtttgaacactggctgagtctcacgggcctgtgtcgtgcagagtattctaaaaggcaaggggaaggtggggtgaggaattttttttatcaaggctggaagaaacatgggcttctgtattctagtcctgaattggatggggaggatggggaaggtgacatgtaccatccatgtggagccccttctcccacctcggaggatgaagagtatcttaccatcaactctacatgccaaggccagctaccctgtgaagaatgtttggaggcagattctgggaccattcccttgccacagttctgctcttggggcactgtcccagagtctttgcctccagaagagtccccagagagtgggagtgaatgggaagacctggaggagcctgtggccctggaatacggtgccctcaggtctctctcttttgggggtctgaatgtctagtgctgattcctgttttgcctgctcctacctgcccctctgctggatgtactgcagagaagagtcttggtgtcctgtcatagggcccatcttgttggactgctgtggctgagtatagaccagcatcaggaaagtctcactgttaatgcaaggagccaccagaagctgacctggtcaccaggcagggtcagaacatattgatgaggacacagaaaaagtaagggcaacagaaactgtcacactgggaggaagggaggttaaattctgggcaggtctgtaaccacccaacattctgttaaagtacttacagtgtatatttaaaaatgctgaatgttccaaaaactttcacat

SEQ ID NO: 460918 - DNA, 1784 bp, Homo sapiens
acagctgccatcccgaagggcgccggggacctggccgtggctagcgatgaccgggacaggccaagggacgcagaaccgccaaaggctgcggcggcctaggggtcataggttattgcagacttgtccccacagtgtggaggtacagaatctggcagccatccagctgcatgtaccggggcaggggaacagtgaggaggccggtgtggccaagccagccggaacaagggcagagagcatgggcggggattgtcacgaagctgccgtctccatctactgcagcatgcgcaaacggagcctctcccactgggccctggtgtctgtgctgtccttgctggcctgctgcctcatctattcactgacgggggtttatggcttcctgacttttgggacagaagtttctgctgacgtcttgatgtcctacccaggcaatgatatggtcatcattgtggcccgggtcctttttgctgtctccatcgtaactgtctaccccatcgtgctcttcctggggagccaggactggaatgcgaaccacgtgcttcatcccctgccccatgggctgcccgatggtggcagaacccctgaggatgcccatgtgtctgtgttggctgtggcctccaggtcagtgatgcaggacttctggaggaggagctgcttggggggatgggggcccagcgccctggccgacccctcagggctgtgggtccggatgccgctgaccatcctgtgggtcaccgtgacgctcgccatggcgctgtttatgcctgacctcagcgagatcgtcagcatcatcggaggcatcagttccttcttcatcttcatcttcccaggtttgtgcctcatctgtgcaatgggtgtcgagcctataggaccaagagtcaagtgctgcctggaggtctggggagtggtctctgtgctggtcggcaccttcatctttgggcagagcacggcggcagcggtctgggagatgttctgatgggcagctagtgccgggcaggaaggggccctccgggggctgaccctacgtggctgctgtatgcagccaggagaccgatgccatttcttttcctcataaagatgctggagagactgatgccttctgcctccttgggctgctcatggggctatgcgggttcgaagggtttctggtacaaagttctaggggtggccggcactccttggcttgtggctgcctcactccagtgtctgctcttgtcttcatgtgactctcccctgtgtatcctctgtgtccaaatctctctcttaaaaagatacccatcactaagtgagctcctcccacctccccactctgtgctttctgtctatgtggatttgcttattctggacgtttcatgtaagtggaatattagatgccgtctgttgtgtctgcctgccttcactcagtgtggggttttcgagtcaccgacggcccagtccttcactcctgttgatgactgaatgataaactgtttggagagactgcatttgtttacgccttcatcggctgatgagtatttggatagtttctaccttgtggctgttgtgaatagtgccgtcatgagtacatgcaccgagcatcacaccccgcaaggaggtggcagtacccaaggggcagggacctgccctgggagcagggtttcaaagctcccggcaagcacagggggctggacagtgtgggcagggaccttgctgggtgggctcccacctgtgccctggcctgtggtcttggctctgccctgttttaggagagggacccaccattctctttgtcctttgaacttttgtga

SEQ ID NO: 460919 - DNA, 2709 bp, Homo sapiens
tcacatgcatgtctttattgtaggcatgagcctgtcctctgtgacgctggccagcgccctacaggtcaggggtgaagctctgtctgaggaggaaatctggtccctcctgttcctggccgctgagcagctcctggaagacctccgcaacgattcctcggactatgtggtttgcccctggtcagccctgctttctgcagctggaagcctttctttccaaggccgtgtttctcatatagaggctgctcctttcaaggcccctgaactgctacagggacagagtgaggatgagcagcctgatgcatctcagcccctgcagctctgcgagcccctgcactccatcctgctgaccatgtgtgaagaccagcctcacaggcggtgcacgttgcagtcggttctggaagcttgtcgggttcatgagaaagaagtgtctgtctacccagcccctgctggtctccacatcagaaggctggttggcttggttctgggtaccatttctgaggtggagaaaagagttgtggaggaaagctcctctgtgcagcagaacagaagctacctgctcaggaagaggctgcgtgggacaagcagcgagagcccagcggcacaggccccggagtgtctgcatccttgcagagtttcagaaagaagcacggagacccagagctcaccagagccccattggagcaccttgacacacagtcactgcagcctccttgttaaccggtaagcagcaaggcctaaagggtgctgtgaacttgatgtgagacataggtgtgggggctatggtaccttatttctttactgattattagtaagaagcctcttgctcctccagaaaatgccaatgctattccattaacagatgaagaagccacatttaagcagatccgaagccaagataatgaggggcctggtggcagctgtgctgtcagggcatcctgtttcctctgggaaccatactcaggccgagtggcggagcaacaacatgcctcaatattgttgccattatccattgccataccatgctgcataacaagcaaccacaaaacacagtggctaaaagcaacaattatgaatttagctcatgattctgtgagttggtcatttaggctgtgctcagctgggaggtcttctagactctgctgaaagccttcctgcctttttgactgtcttcggctcggctatccagcttctcctgcggggtgaatggccattgtctgggaagctctggctctcctccaccagcaggtcagcctaggattgttctcgtgacaatggcagaactgacagagaggaactgagagagagagagagagacagagagacagagagaaagaggagagagaggagagaggacggcaaggtgcataaagccttcagaactggtcttccatcatttccacttcattctgttggccatatcaggcctaaaggccagccccatttcaaggagtaagaaatagactccatctcttgatggcaggaggctgcaaagtcggattgcaaagggtgcagatcagggagaagaactgtggacatttttgcaattgtctaacttaggatgcttgaatcagatcaaaacctagatgggctcatatcttcctggacctggaacggtgtttattttgaagtttgggtgatttatttattcacatggtgacctgttgagggctgtaacagtgtcttgtcatagttgatgtcaaatccacagctgacgccctgattggatatcgtagagtttatcttgcaatactttttcctgccatttaaaactttattttcccaatgaaaacaatttttaccccctgattccttaaacaatatattttattgtcaaaatattttgaacaacatatcaaattctaaagaagccagaactgctgcagtcccatgacctgctgggtggttgctctagacctggggtcctggcaccacaaacagagaggtaaagccatggggtggagaagtcgactgtgccttgtacctccaaccccaccccaccccagtggctgtgcagcctggcttctccaggcctcagcttcccccacttgaaaaatggatataactcccccataggtgggggagaaggtgacatgcatcagtgggtgcaccctgcccaactgagcccctgtgcgggtggtctttcatgccatggaagcccttgccattgctaagtgcttcaccccttctcaacccctggccagcgctcttccaggagcagatccccaggaccagcaggcgggccggaggctcagctctggatctgtgcactcggcagcagacagctcatggccaacaactccttctcagaggggttttctgcaaagaaggagcaaggtaagcaaaataaggctgaaggacactcctcaaggaggcttgagcagggagctgtgggtggctggcacggtggctgaaaatgggcagggtcttctaggggacaacttccctgggctgaggtttataggattggactaacataaacctgaaatttgcaacttagggcataggcattcactgagtagcctcactggggaaggctctatgggggacgctgtataagatgtagggttaaagatgctgggtcccaccctagaggaagccaccggtgcgcagggtggtggcagagcgtgctacatgattcgagaactgacaaggcagaatgtgtttggaaggggccttctgcacaggtgaaaggtgggagcatagatccag

SEQ ID NO: 460920 - DNA, 660 bp, Homo sapiens
tcacatgcatgtctttattgtaggcatgagcctgtcctctgtgacgctggccagcgccctacaggtcaggggtgaagctctgtctgaggaggaaatctggtccctcctgttcctggccgctgagcagctcctggaagacctccgcaacgattcctcggactatgtggtttgcccctggtcagccctgctttctgcagctggaagcctttctttccaaggccgtgtttctcatatagaggctgctcctttcaaggcccctgaactgctacagggacagagtgaggatgagcagcctgatgcatctcagatgcatgtctattctttaggaatgaccctctactggtcagcagggtttcatgttccgccacatcagcccctgcagctctgcgagcccctgcactccatcctgctgaccatgtgtgaagaccagcctcacaggcggtgcacgttgcagtcggttctggaagcttgtcgggttcatgagaaagaagtgtctgtctacccagcccctgctggtctccacatcagaaggctggttggcttggttctgggtaccatttctgaggtcagtagagaaccgtgcttttcaagcagtagctgctggtcatgtgtggctattaaaatttgaattagttatattatcattaactaaaataaaat

SEQ ID NO: 460921 - DNA, 1228 bp, Homo sapiens
tcacatgcatgtctttattgtaggcatgagcctgtcctctgtgacgctggccagcgccctacaggtcaggggtgaagctctgtctgaggaggaaatctggtccctcctgttcctggccgctgagcagctcctggaagacctccgcaacgattcctcggactatgtggtttgcccctggtcagccctgctttctgcagctggaagcctttctttccaaggccgtgtttctcatatagaggctgctcctttcaaggcccctgaactgctacagggacagagtgaggatgagcagcctgatgcatctcagcccctgcagctctgcgagcccctgcactccatcctgctgaccatgtgtgaagaccagcctcacaggcggtgcacgttgcagtcggttctggaagcttgtcgggttcatgagaaagaagtgtctgtctacccagcccctgctggtctccacatcagaaggctggttggcttggttctgggtaccatttctgaggtggagaaaagagttgtggaggaaagctcctctgtgcagcagaacagaagctacctgctcaggaagaggctgcgtgggacaagcagcgagagcccagcggcacaggccccggagtgtctgcatccttgcagagtttcagaaagaagcacggagacccagagctcaccagagccccattggagcaccttgacacacagtcactgcagcctccttgttaaccgcgctcttccaggagcagatccccaggaccagcaggcgggccggaggctcagctctggatctgtgcactcggcagcagacagctcatggccaacaactccttctcagaggggttttctgcaaagaaggagcaaggtaagcaaaataaggctgaaggacactcctcaaggaggcttgagcagggagctgtgggtggctggcacggtggctgaaaatgggcagggtcttctaggggacaacttccctgggctgaggtttataggattggactaacataaacctgaaatttgcaacttagggcataggcattcactgagtagcctcactggggaaggctctatgggggacgctgtataagatgtagggttaaagatgctgggtcccaccctagaggaagccaccggtgcgcagggtggtggcagagcgtgctacatgattcgagaactgacaaggcagaatgtgtttggaaggggccttctgcacaggtgaaaggtgggagcatagatccag

SEQ ID NO: 460922 - DNA, 2326 bp, Homo sapiens
gctctttgcaataaatcttgctgctgctaactctttgggtccacactgcctttatgagctgtaacactcaccgcgaaggtctgcaacttcactcctgaagccagcgagaccacgaacccaccagaaggaagaaactcagaacacatctgaacatcagaaggaacaagcgctggacccaccacctttaagaactgtaacactccccacgagagtccacagcttcattcttgaagtcagtgagaccaagaacccaccaattccggacgctttttggcgacccagatgggactatcgcctatcaccaagtcgtgagaccattgcctatcactgagtggtgagactgtcacctatcgccaagcaaatcgaggccatcaagctacagatggtcttacaaatggaaccccaaatgagttcaactaacaacttctaccgaggacacctggactgacctgctggcccttccactggcctaaagagttcccctctggaggacactacaactgcagggccccttcatcacccctatccagcaggaagtagctagagcagtcatcggccaaattcccaacagcagttggagtgtccagtttagaggggggattgagaggtgacaatgtgctagcagccctcgctcactctcagtgcctcctcagcctcggcgtccactctggccatgctcaaggagcccttcagcccaccactgcactgtgggggcccctctttgggctggctgaggccagagccggctccctctgtttgtggggaggtgtggagggagaggcatgggcaggaactggggccagcacgagttccgggtgggcgtgggctcagctgtggagggtgcaccgggtcccccagcactgttggcccacctgtgccatgctcaaattcttgccgggcctcagccgcctccctgcggggcagggcttgggacctgcagcccgccatgccctaaccccccctgctccacggagcctggtcccatcgactacacaatggcaaaggagtgtgggcacgcagcatgggatggtcgggcaactcctcacgtggccctggagcgggatccactaggcgaagccagctgggctcctgagtcagcttcactcctgaagccagcgagaccacgaacccaccagaaggaagaaactccgaacaagtccgaacatcagaaggaacaaactctggacccaccacctttaagaactgtaatactcaccacgagggtccgcggcttcattcttgaagtcagtgagaccaagaacccaccaattccggacacaataggaagcaagatccctcttggtggttgtatattgcctggtctacacgtgctgcgtggaactgggctgatttcattgtatcaatatgccactattgatgtatccatcctccggctgagaggcattgggtttgtttccggttgggttctaagcagatgcttagagggagtttgggatgcagtgtgcttgctggggaccaacacctgtgaaaagaagggagaggaagcaggcttgggaagacggagaaggatccacacggaaggtaattttcaagtgggtgggcccgctctccagctcttcctgccccagctccctggcctcccttgctgtccagggtacgaggctagcggcgcgccgcggtccccgctcccttgggggacagcgagcaaggcgtatggaaaggaggaggagaaagagggggaaggggaagagcaagggaggggaagggggttcgcggctgcctggcgctcagcaagtgcaggaacggaggcaccgcagggcaggcggccaggggctcggaggctctgcctctttgagttccagaaaagtcaaccgggacagggcggtggagagacgcgcagtcttcgcggggcgggctcgggcacactggccctccaggatccgcaacattttccaacttggaaaacgtcctcttttcccattgcagaaaaaatacgctaggagagaaaactagattcctaacttcaaaacgttttagaacagagtgtgtctcttaaaactcatatggcggatgacgccaaaacagtctgtcttttgtttccagcagtttccagttggaaaattcctttgggaatttctttgcatctcaggcacaaacttcaacaacagcctcaagtagcactgtctgcattgccggattctgatttctctgacctctaacagaagttttctattttactttcgaaggtaactgaaaggggttgatttaatctacaaagctctattctcctgatgaaaatttcttaagagatctccggtttcccttgcgtttatttcatgggaattaagatgctgtgttttgatac

SEQ ID NO: 460923 - DNA, 640 bp, Homo sapiens
aagagggctttcctccttgaaggaagggtgttgggtgaactaacactattttctcctgccctttcccccaatctcaatccctttctctccaaacattcttccttgagcaccccactctggcactcaaaaagccatgggaatgggaaagaagtggctggaagtaaacagcctgcttactcacagcaactgaaaattttgtttcgacgattctggttccaggggcaggagctgaagattaatgcctggagtctgccccattctgagagcagcagcctggctcctggtggctccagcagcagccttcatatctgtttttttcttatgaagcttcttctggttggaaacttgtcaaatttcatcaggcttcttcaatgtctttaaagcaaaatgtaagaaaacggatgattgagttgacctgaattttgggattgttaagaaagctggattagaaggtcaaagggattgggacacgagaccactcagcgattaaactgaaaaggaaagaagtcaagccaaaaaacggctaataaactgaaagaacagggaggggtttggggactgaaagtctagggggagatggtgacagtggcagatgtggtggacagagtagtttccagtccaaaggttcagagatggagca

SEQ ID NO: 460924 - DNA, 2206 bp, Homo sapiens
taaagactttcagggaaagggaagagcagttaagtggcgcagatgggaacccactgcagtcactctgcaaaactggagtgcgatgcatgacggagagtcagcgttcacccagtgctagtttccaaaaggcagccactactgaactttcatgtggcaagggtgcgacacgttgctctcatgagccagatctaggttctcagtggctcctgcaggaagtcgtaagtggatgcaagaagtcccaagctggcagtctgccaggtgattccagtagggacattctacaaaatatccgactggtactcccgaaattgactgttcaggtcactgaaagcaaggaaagcctgataaactgccacggccacgaggagtctaaggacacatccaatttccattcgcatccaaaatggaatccgagacagaaagaggaccttagccttcatatctgtttttttcttatgaagcttcttctggttggaaacttgtcaaatttcatcagatggctggaactctccgtgtctccttttctttctgtcatggctggcaagagctcatgggccatgagctgcatctttataaacatgaacagattagcaggtattcccaaatgggacaaatgctaccttattgcagacagtttctagtatagtcccacattctttgagaaagtaggtggagaccccatcagcaccaggccactggcagcaaatggttgtagccaggagccagaatagagcaagtccagcctgagcctgtggtcggcagtggagaagagagggtcgcagacctgaggcaaagggcagcctgaacaatcaagaaccagagcagccctggcacccgacacccaggagagtgggctacaggaagaggatctgagaccagagcccacagagtctgcagaaactagaggcacaaggcacgaggaatcacaaagcaaacttaagtgccgacatcaaagaaggcattctcaccctgtttcctgcttctgggtttctccacattcctatagccttacagacagtaagcccagtgtggtgggaacagggaattgaagtggaaagcacaggccaggggatctgatgggtctcttagatcccctgggagggcatgacaacatagagaaagaagagtcctttaaaagcattcaacataacgtagtttgcccaggcagttcacgctgactgaaacctcctctgtcttctgaactcgggcatgcctatctcatctcttcttttgaagcagaatgctttaaatttttatttttatcctgtgaacttcaatatgcgacctccttctgtgacagagcttctcttttggtcccccatgagtggatatcaccttgtactcccctgcacccctaagctcacgttcttcatcttctctttgaccctcagcatgttatcccttgacccattcttcagttttcatgtctatcatctgcaaaatcttttctgcctcatagtacttaggagatcagacatacgcacgctggagacaggaacctcccaatatcaaattagccacttgggccatcttgtctggcacgttgcataaatgttgtatggaagacaggtcctcctcccaatttcgtttttcactggccacatgatgttagacaagtctctttctctctttgagcctctcctgtctgatccaatgggttgtaagaatcagatgaaataacagaggggagaggattacacattttaaagcactatgcaaatgtaaggtgttgttataataaaatatggatcatggcttatgttggggaagctacaagccttcccactagcccacactgctgctgcagtatgcacttatctggatcacccatgagatcaacttgcaaacaggaactggcttatgaagccatgcttgctctgagaaacataatggtcatctcactgccagtggaatgtaatatttgatgtcatgacacccttcctgtccaacttggcattggcagttggtttgacttggtggtgagaaatacaacaaaacgatgagaaattttccttctggagcacttcttaagggagcttggttgctttattggaaattcgtacttcttagctttcatgaaatgtccctttggtacattagtgagaaggttcaaggcaaaataaacacatttcatcttgaccatatttggaactcacaatataaaggagtcaaaagattattctacaaaacactttagcatttcctt

SEQ ID NO: 460925 - DNA, 2316 bp, Homo sapiens
taaagactttcagggaaagggaagagcagttaagtggcgcagatgggaacccactgcagtcactctgcaaaactggagtgcgatgcatgacggagagtcagcgttcacccagtgctagtttccaaaaggcagccactactgaactttcatgtggcaagggtgcgacacgttgctctcatgagccagatctaggttctcagtggctcctgcaggaagtcgtaagtggatgcaagaagtcccaagctggcagtctgccaggtgattccagtagggacattctacaaaatatccgactggtactcccgaaattgactgttcaggtcactgaaagcaaggaaagcctgataaactgccacggccacgaggagtctaaggacacatccaatttccattcgcatccaaaatggaatccgagacagaaagaggaccttagccttcatatctgtttttttcttatgaagcttcttctggttggaaacttgtcaaatttcatcaggaatacagagatttcgcatgatttcttaatgggattcagctgcctacgctgcagtgctttcagctgtatttgagaatgcactgtgtttctgccttgttttacgtttgcagatggctggaactctccgtgtctccttttctttctgtcatggctggcaagagctcatgggccatgagctgcatctttataaacatgaacagattagcaggtattcccaaatgggacaaatgctaccttattgcagacagtttctagtatagtcccacattctttgagaaagtaggtggagaccccatcagcaccaggccactggcagcaaatggttgtagccaggagccagaatagagcaagtccagcctgagcctgtggtcggcagtggagaagagagggtcgcagacctgaggcaaagggcagcctgaacaatcaagaaccagagcagccctggcacccgacacccaggagagtgggctacaggaagaggatctgagaccagagcccacagagtctgcagaaactagaggcacaaggcacgaggaatcacaaagcaaacttaagtgccgacatcaaagaaggcattctcaccctgtttcctgcttctgggtttctccacattcctatagccttacagacagtaagcccagtgtggtgggaacagggaattgaagtggaaagcacaggccaggggatctgatgggtctcttagatcccctgggagggcatgacaacatagagaaagaagagtcctttaaaagcattcaacataacgtagtttgcccaggcagttcacgctgactgaaacctcctctgtcttctgaactcgggcatgcctatctcatctcttcttttgaagcagaatgctttaaatttttatttttatcctgtgaacttcaatatgcgacctccttctgtgacagagcttctcttttggtcccccatgagtggatatcaccttgtactcccctgcacccctaagctcacgttcttcatcttctctttgaccctcagcatgttatcccttgacccattcttcagttttcatgtctatcatctgcaaaatcttttctgcctcatagtacttaggagatcagacatacgcacgctggagacaggaacctcccaatatcaaattagccacttgggccatcttgtctggcacgttgcataaatgttgtatggaagacaggtcctcctcccaatttcgtttttcactggccacatgatgttagacaagtctctttctctctttgagcctctcctgtctgatccaatgggttgtaagaatcagatgaaataacagaggggagaggattacacattttaaagcactatgcaaatgtaaggtgttgttataataaaatatggatcatggcttatgttggggaagctacaagccttcccactagcccacactgctgctgcagtatgcacttatctggatcacccatgagatcaacttgcaaacaggaactggcttatgaagccatgcttgctctgagaaacataatggtcatctcactgccagtggaatgtaatatttgatgtcatgacacccttcctgtccaacttggcattggcagttggtttgacttggtggtgagaaatacaacaaaacgatgagaaattttccttctggagcacttcttaagggagcttggttgctttattggaaattcgtacttcttagctttcatgaaatgtccctttggtacattagtgagaaggttcaaggcaaaataaacacatttcatcttgaccatatttggaactcacaatataaaggagtcaaaagattattctacaaaacactttagcatttcctt

SEQ ID NO: 460926 - DNA, 822 bp, Homo sapiens
taaagactttcagggaaagggaagagcagttaagtggcgcagatgggaacccactgcagtcactctgcaaaactggagtgcgatgcatgacggagagtcagcgttcacccagtgctagtttccaaaaggcagccactactgaactttcatgtggcaagggtgcgacacgttgctctcatgagccagatctaggttctcagtggctcctgcaggaagtcgtaagtggatgcaagaagtcccaagctggcagtctgccaggtgattccagtagggacattctacaaaatatccgactggtactcccgaaattgactgttcaggtcactgaaagcaaggaaagcctgataaactgccacggccacgaggagtctaaggacacatccaatttccattcgcatccaaaatggaatccgagacagaaagaggaccttagccttcatatctgtttttttcttatgaagcttcttctggttggaaacttgtcaaatttcatcagctttatgaaaacccaaccacagcaaacatacaggctggcacaaggtttgctctaaagaggaagagatctaggtggggctgaagatgtatcacttccctttggagagtgccctgccacaggcagggacaatctttcatctctcatagaggaaaacataagggaggaggcgccttccagtaaatatcctcagttgagttttcatattatatataatatattcaaggagacaaccacccaatttccctccctggattccaagccttgagatataactaatatttaagttttgcattgcagagtgccctgataataaagaacaaattcct

SEQ ID NO: 460927 - DNA, 453 bp, Homo sapiens
gtttccctgcacaagctctcttctcttgtctgctgccatgtaagacgtgactttcaccttccaccatcattgtgaggcctccccagccacatagaactgagatactcccaaagtcccatccagttatatcatcaggttgaaattccaggatctcttggtgatgggtagttatctccaagtgtggctcctggggtcagatcacctacagtctaagagaaggttctttttctccgccaatggtgatagatttggcaccaaaaaaagaagagaagaaacatgacagtcattgtttccacagtggactttctccatactttctgagttatcagttacttttgatcaacagaagtaccgctaaagacacatcccaaaaaaagattatcaggagaaacttgatttccttaatctttaaggagcacttctacactaaaaaaaaaaaaatactaatagagt

SEQ ID NO: 460928 - DNA, 861 bp, Homo sapiens
ggctcggcatcagaggaagaccgtggaaagagagggagaccgtggggagaggcagaggcagaggcagaggcaggggcaggggcaggggcagggggcaggggcaggggcagggggcaggggcaggggcagaggcagagcttgagtgcttttatgaagaataaaaatgaatgactgggcggccaacttagtttgtctttttgtcctgagtaaacacctcaacacatgggagctcaacaaaatgagaatttggaagaggtacgaacgcgaaaatgaaagtgagaaaattacaacaggtgcctcagaaatacaaaagattataagaaaccctcatgaaaaattttatgccaacaaacaagataacctaaaggaaacagataaattcctggaaaaatacaaaccaccaagattgggtctttgtgaggttattaattggcctaatttcaatactgttgtgtttcaaggaatagagaggcccgaggagagggtgagagatgggaaaatgggtggagatactcccaaagtcccatccagttatatcatcaggttgaaattccaggatctcttggtgatgggtagttatctccaagtgtggctcctggggtcagatcacctacagtctaagagaaggttctttttctccgccaatggtgatagatttggcaccaaaaaaagaagagaagaaacatgacagtcattgtttccacagtggactttctccatactttctgagttatcagttacttttgatcaacagaagtaccgctaaagacacatcccaaaaaaagattatcaggagaaacttgatttccttaatctttaaggagcacttctacactaaaaaaaaaaaaatactaatagagt

SEQ ID NO: 460929 - DNA, 1018 bp, Homo sapiens
cagtaagtgggagttaaccagatggaaaatgggcagcagcaattttggacagagcagcaggtggaaagtcaaggggccatgagaaagcaggatgcttgtgggaactgctggagacggatggtggattcggtggtgcctgttccaggaacctttagtgtgaaggatcctccagataaagagacatcatcttctcctccaaacagaaatgtcatgactgtgcttgagggatactttcaagatgacacaaaaccaggtttttggagtgctttgaagatggagaatggcttattaacactagtcacattggcagatgtttttcataacatcaaccagttgaataagcctctgcacagccctggagaaaatgttttcaccaaaaatgtcaagagtttttggatttaaaagaaaactaaagttttggaaaaaaccatgaggcaaaagaaatccttgagatgtttccattgttgcttgggcctggggccatcatgtgagaacagaggagaagcctggtttgagtgagtttttcctgaagcaaaagggaagagcttaatttcaaaaggaatatcttgaaagacgcatcaactcaccattagaaaacatgaaacgacagattatatcctaagattgtgtgaacctcttacctggaaacccgtacaattgctttatctaccaatcctaaactattatatcttgatctttactcaatcctaattacacacccacattgaaagacctatcttaattcagacttcaaaatcttacaaacgtccaagtccctcctttgaaatgctactaagactgcagtaagaatacatagcatgcagtgactgagaggaagagagatactaacacttgaagtaatccagtctatcaataggagatggactgctttgatttaaagcgatttacaaaaggatttggatacctcatctctcctgtttcgccaaggtcttgactcatcgctgcaggttgtataattagtctcattaatctagcaaatgatggcaaaatgcttggt

SEQ ID NO: 460930 - DNA, 998 bp, Homo sapiens
cagtaagtgggagttaaccagatggaaaatgggcagcagcaattttggacagagcagcaggtggaaagtcaaggggccatgagaaagcaggatgcttgtgggaactgctggagacggatggtggattcggtggtgcctgttccaggaacctttagtgtgaaggatcctccagataaagagacatcatcttctcctccaaacagaaatgtcatgactgtgcttgagggatactttcaagatgacacaaaaccaggtttttggagtgctttgaagatggagaatggcttattaacactagtcacattggcagatgtttttcataacatcaaccagttgaataagcctctgcacagccctggagaaaatgttttcaccaaaaatgtcaagagtttttggatttaaaagaaaactaaagttttggaaaaaaccatgaggcaaaagaaatccttgagatgtttccattgttgcttgggcctggggccatcatgtgagaacagaggagaagcctggtttgagtgagtttttcctgaagcaaaagggaagagcttaatttcaaaaggaatatcttgaaagacgcatcaactcaccattagaaaacatgaaacgacagattatatcctaagattgtgtgaacctcttacctggaaacccgtacaattgctttatctaccaatcctaaactattatatcttgatctttactcaatcctaattacacacccacattgaaagacctatcttaattcagacttcaaaatcttacaaacgtccaagtccctcctttgaaatgctactaagactgcagtaagaatacatagcatgcagtgactgagaggaagagagatactaacacttgaagtaatccagtctatcaataggagatggactgctttgatttaaagcgatttacaaaaggatttggatacctcatctctcctgtttcgccaaggtcttgactcatcgctgcagatgactaaatcccattgagctaaatctcct

SEQ ID NO: 460931 - DNA, 1754 bp, Homo sapiens
gatactcaagaaataagacccatcttcatgttgggtctccacgttgcctccagaagagtgattcagtctggcatctctccacaatataaggccacatgcttcccaactggatggtcaagacattggggtcacagggtcctctttctcctctactctttacatcttgccatagcccctaataaatctaattcctctaagcaccactctgctctcccctctgaatgcctactgctccgggtgtcctctgtgtaccctagtctctccctagcccacctctctgtgcccaagagacagagcacaaggatcccaccaacacctcctgtgccttctaagctctgggttccctttctactgggtcaaagggtggcaccagctgcagttattcctctgccaaaggccagggttctgaatggccatcctctccgggttgtagtgaccgccctctcctgtccctctgcaagcccaagagggtagggcacttcctttggtggtggtctttcaccttactcatgcttttgtaaatagtcctgctcctcaatttccccatgctatgagcatggaaagagagatgaagctatactacccaagaaacaaaaagggacctacttcacagtaattaaagaaaccctcatgtatccaggaaagggctatggagatgctcataaaggattctcattcctattgtaagccagagagaatgcaatccaatgcaatgtttcgatcatggagtctttattggacacaggctggcatgagttgatggcacctgaaaatcagcaagctacaaatgctcctgggaggaacagcatcttcagtctctaaaccttggtgcagctgagtttattagaggttttccagaccttaacaagagcctgtgacagtactaagaccctggggatggtgcgaaggagtctggaaccaggaggctgctgcgttttacaggatactggagcccagttctcaatcaaacgctagagctcagaaagacatgcctctcagatctgtctacctttaagcatttttttaattaataactggatattgaccattaaaaccatcacaggtataggagtttgttgactaaaatttgtattatagatacaactgaaatgtttacaaatctttataagaaaatcattactacttgggtcagaagcaatgcaagtcaagcttaggtctatggtttttgctcctgatcagtaatatgtagatggcatgtgttctcttaccctctctaaatctggaaagatgcatttcatagtacctctaatctcaaaaattttaactttcacttttaattgttgaaaatgtcattctgaaatccaacaatgaatgagtgaatgtgtatatattcatcatatacttgtacacacacacacaaataaaacctgtatctcacggcccacatatcttgcttaagctgctctttcaggaagatttatgacactctgcttcacaaagaaagtttaaaagagagaaagaaaacgaaatgaaacagtgactgttccctagtgcaattactctgtcaaatactcccctagggaaaggaatttgctcttattgtgaaataaattaatatagaaaccagactcctgcagtaacttttctttatccccaggcagtattttcccactactgctctcaaaattcacttttggcgatacacatatgggaggttggaaatagctagaaattatatgtttgaatttaaatatattcccatttccataaatgttagcagctccccaaattat

SEQ ID NO: 460932 - DNA, 684 bp, Homo sapiens
  misc_feature (9)..(10): n is a, c, g, or t
  misc_feature (12)..(12): n is a, c, g, or t
  misc_feature (14)..(15): n is a, c, g, or t
tgccttggnntntnnaacataatacctctaacttcttgaatattggaggcagggtagcagtcagagaattcaactttccaaagtcagctttttgcaaaggtagaatgtgggacagacaccacggtgagtttgctgccggtggaagagatccaagttaccccaagttacccgcggcatatctgtacggggtgggcttcccgcatgcacagtgcttccctcacccttgggaactgagcacgcgcagtgtgtttaggaagttgtgcgcatgcccatctgaggctttcttcattgtgtctggtggagtgtacccggaagaccatactttgccactgttgtctcttaatgtgcacgctcaggaagtttcttctccctgggaatgtactgttgacccttgaacaacacaggtttaaactgtgaaggtccacttatacatgaattttatcccatctttgccaccccaagacagcaagaccaaccccttctctccctccttctcagcctactcaacatgaagacaacaaagatgaatgatccacttccattgtatgatgttcctcttccacttaatggatcataagtatattttctctttcttatgattttcttaataacatgttgttttctctggcttactttattgtaagaatgcagcatataatacatgtaacatacaaaatatgtgtc

SEQ ID NO: 460933 - DNA, 1816 bp, Homo sapiens
tggactcgccctcagaccctccataacggaattcaggcctactgacaccttgatttaagcccagtgaaacctgtgtcaggcttctgacctacagaaccataaggcgttaaatgctgtcctcgtgctgagacatccagattcactgctcccctgacctccagacctgcgggaagttcacctcccatctgcctacaccctctgctctcagtgagggcggcagcggcagaacaaaggagactggcacacgtgaaaccctcgcgtaaggcgggcatgacactcacagactgatgagcacacctgatgggccagaagggcatggtgtggagcagcgggggctgcagtgagaggagcagtggccagacacacctgttggggtgcagaaaaccaccaggtgcacgaggcactcctccactgcagggctgcggccactcggctgcctgtgtgctctgcctgtgggcatcaggctgaggccttttgtctctcctggggaacttctgcatttatcagtgcccgaaggctgggactgtctggggcggggcaagaaggacttgctgggatccccgccagtgggaggtcggcgtggttgttctgcatccgcatctgtgcctgccaccctgtgcacttgtcctgctgtgttcttgactccctgaggtggggggagtgtccatcctatttatctggcatgtgggaaccccagctcagtgccactagctttatgcctcagggttctctccaggtggacccacccaccaggtattggagattaatgaatgcatgggagaagcctgatgtagacacatggtctgtgtcacagacagagaagctgacgctccgtgagctttcagtggcccagggtcaccacgctgggaaatggcacagccaggatttgaactcagctgttgtggattctgtgcgccagtcagctgctgcctttatggtgtctcccttgcctctgggacaaagggagcaggaagcagctccttcacctagcctggtctcctctcctccagcagcagtgctccaaatgccctcccacctccttgcatggctgactccctctcatttaaagcctcagctcaaatgtacattacagaatccttccctgggtgagagccttcgtcaaggagctgcgccctcccacccaattagtcttacacgactttctctatagaacttatcctgattggaaagcagcttgtttgtctgcatacgtgtttactgcctgtctctgtgaaaggaatgatcttacctaagatccttgtccccgggtgcctgctgaacaatcgcctggtgcctgccagaatatctgtaggaagacagccggtaacactagagttgctgtgtgtgtactccagagaaagaggatgcagtgcctcgggccggtccccaacttgcataaggctccctgcgggtaacatctaccttggcctgtcatcacgagcccacatgctctgttttctgagaagaaagatgtgatcctgtggtgaaaggagaaagctggcccgagcaggacacggcccagatgagtctcccattacctactctcgcatccctgcagggaccacggcagccacactgcatagctgtaccagggcacctagaaacctggtgagtccctctcctccttggggtgtgctggcgaacaatgaaggcccctgaacaaaaataccaggcacctgttggtcctcagagcctccaggtgctccacatgatggcccttctggccccttgcccaagccaggagccagtgaagtgaagtggcccacatgtagaggaagccaccccaacacccccaccagtcccagcacaaggattt

SEQ ID NO: 460934 - DNA, 2349 bp, Homo sapiens
gaattacccggaaccccagagctcaccctctctgaaggagagcaggtgcctcctgagagcagggcttctctaccttggggcactatgaacattctgagtggggcgccctgaacgagtgcccagatgcttgtgaggcccagatcttggggtgtgcagccaggaagggctctgctagctttcccacctccctcctgacctcttctgcccctcactggacccagcccgttggcttcaggatgggccccacgggacatgctttcatggaacctgaggaaagaatgcacttacaacagcgccgggagcacagaggcttcccactaccctttccgagaagcacgtctattttctctaatttattcagtgccgctgtgcgtgtgtggcctctcaggtaaagagtgatttcagctaacatgcaccatgcctgccacctacctgtactggagatttcagactgatgcctcccttggccctactggcctcctgacctatgagtttatctgggagaagaatgttctaggcagagggaatattcagtgcaaatatcctggggtggaaatgtgcctgtcttggtccaagaacagtaaagaagccagtgtggccttagcagggtggggagtgatgattgatgatggtgatgatgatgatgatgatgatgatgatgatgatgatggtgacggtaaagatgaaaaagaagagaaaatcataaagatggcaaccattactattgttctttctcactccgctgagcactcacaatgtatcagacacagcattcagggtgcttccccattcattatcccagctaatccttgcagcaacctttatgagagcccagttctgggcatccacgcctttaaccgctaagccatgctgtctcaatgtagccaccccagcagccttggcccagtgggccggtaaggctggcttgttgagaaagggacactggtatagggcatacccttggtgtcaatggggtgagtttgagagatgggaccgttgaggactgaggaatgtgaaaggcaagactttttagcagaagctgcctctaaggagaggcctccttcatcaccctgctcagactgcactccacccttggcattccacactcccttggtactgcaagacaaggcaatgataaccactcgatttcaactgaaatcacttgttttttcccccttcccaactgggctctcccctgagacccaggtgttaatgaaatcaaacaaatgaaaatgggtaaattattgcaaagctatgaacacctccacagggccacgcctcactagtttccaataccacctcattctggaggctgccggaggagctgaagcaattttgtcccatggatgaatgggttagctttcctgttaacttctgtaattgactcattttcaggtattaaaatgtccagcctagtttctatcaaatccagtcttgcagccttttccagtcttcttccttcctcttgtctcagcttgacttgagctggaatcctggaggaggggaggttggggaactgggactgtctggcatcttcctccctccttgccctcttatctgctgctgtgggtgttctgtcccctgtgtgtgagccctgaggataccctacaactaacaggcatgatgccatcaagacatcttgagcctggctacctcccgtggcctgtattttgtccacaggaaactcgcgcagtctcactacagcaaattgaggtggtatggggtgcctgctgctgcctctctcttcacctttccacagagggctgccccagcctgactcccacttccagagtttctccagtacttcctggaatatttctcaaactgctgtacttgagtctttagcacagggtctgattccagggggaacccagcctaagacatgtgtccttaagctcccaagtacacactcccaggatggttcttatctcatctcatcctatcctagttgagggtggaatggggctcccagattccacagctcagcaagccaccagccatgggtatcaggctggtccctgaagccaatctcttgagcaacctcctatgcttggtggctgctgtgccttccatgccttgtccctttctgtacctcttcctgagtcacagtgctctctgcccagggtgacaactctcaaagctgactatctttttacttccccatatttctctcaaacatttactcctctccttatatagattggagtgggtgatggggatactcttaggtcttagtgggtgacctgttaggccacctcttaagaagtctgagggtgtgtgtcctgcagctcctctatagaatatggggcacttatcacttatcttatgacaaatttagctcagggactt

SEQ ID NO: 460935 - DNA, 1624 bp, Homo sapiens
aattttacgttatagtacattttactacagtaaaaaatgttttaaaaaagaaatcattactctcttgctaagatcttgtttcatcttaacacacacgagatgccttgtcttcatttcgtggacaggcaaggccgaattccgtttcacagatagaggactgagatctggaggcagagggcaggaattaaaaacaagacaaacaagagccttatacaggcagtgtctttctgagtctgatccctgttgtcttgagagctgcggtgagggaaagtcgtcttcagagccctcagggtcaaagcagtttgttacccttgagatagacaaagctcctaacctctccagctttttgccgacagctcgattctgatgggcactgaccttttccgaccctgttttcaggagccgactcctggcaggttggttgtaggggccctcttgagtgcttcacacacagcagtcctgttgggcttggattccagcctcaaattccgcgatttggccggcatcctaatccccgagtgactcttgccaaccactctctgtggggcctgtgtgcttcctcctgggttctggggcgctggcggcgtccgcttcaccgggaacgggagccccagcctcccgaggccttcctgcctggctctgggaatggccactgtccagaaagccccgcggccgtccatgctcgctcgctcagtcaggcccttgtggggatattgcagaacgagtccgagttactatccctttaaatacaggcgtttcggcctagctgccgccggtccaatccgcagcgcttccgtgccccactttcccgcgtcagcctggctccggcctccaccagggggtgctagtgagatcccagccagcctcagagctgagcgtccagggccttcaaatgtccccatccttgaaaaggcaactccagtggcatcttctgcggggagaccagaagcagcatctgacgaggagacagcactggcggcaattgcatcattgtgcaaacaatatagagtgtacttacccaaacctaaacagcacagcctactacacacccaggctgtaggctgtgcttctagactacaaacctgtacagtgtggtactgaacactgtaggcaactgtaacacaatggtgtacctaattcctctgcctagaaagtgtgctggaattactgcctggcttctgatgaatagggcgtattgagagtgatgctttgtgagttctgaggctaggtcatagaaaggattgaacttattcctgaatgttgctcttggatcacttgcttttttgggaaccaccagccatgtcatgaggacactcaagcaaccctgcagagaagcacatgtgtggagaggcacttcttggaaaggaggccaacttgccagaaccaactaatttgtcatgtgagtgagtcattttggaagcagatcctctaccctcagtcaggccttccgatgatttcagcccccagcctttgagtctgccccaaacaccatgagtagagacaagcccttcccactgtgtccaccctggctgaattccagaccgttaaaaaaacaagagaaaataaattattattagtgttttgagtcactaagttttggactaatttgttatgcagcaatagc

SEQ ID NO: 460936 - DNA, 491 bp, Homo sapiens
  misc_feature (17)..(17): n is a, c, g, or t
cgtttacggacaactgnttgggaaacacactcttggaggaccaacaaagctgatctagataaagtaccagcactcaagagcagaaaattgaagcaaaaataagcaggagtgggtgactattctacaccctggaaaactgcaacaggactgctgttcccaaccaagactgttatgacccaaagtaacagagctgagtggctccatgcagaagtctgtgttcaacatctgtcatgctggagatcattaatgttcaattgcttcctattgtcttcatgtcattcaacttcatttcattgtcattgcttcagctgggggattaatcaactatttatgagaagacaggacttggagtcagggcggtcacaatggggttatagtctgagcaatggtggggaaagcaagtcacggttaaaagactactagtttgtgacagtttgttgacattttaataaacatatttgagaataaaagcatgggcctcgttggcctca

SEQ ID NO: 460937 - DNA, 921 bp, Homo sapiens
ggagctacaattcaagcaccgcctccggcgtcctgccccacctttaatctcaattggctcctcagccttcaactatgaaatctacttctcctccccacacccctacacccaccttaggccataaaactttattggctggccaggaaaagagccagggaggagagatctcatggtggacaagggaccccattacccaagctgatgggaactttgggaacctaaggaggagggcccatgggggaaggggtgttgcaggaaggtccaaagaagaagaatcagaagacccgggtgtctggacacttagaataacttgtttagccaagctgctgaaattgcacaaggaaacaaaaaaggctaaaccaactaaaataaacagaaaaccacttcccacggggcagggagccgacatcagtgtctggcctgggcaagtgaagcctctgggctttaactctgagctgactcaggctggtctgaaattcctgtgctgaaatgatggtgtgagccactgcacccagcctgttttttaagaagtcattctgcattcaaaatgtgcagctagctcccgttccctacaggactgctgttcccaaccaagactgttatgacccaaagtaacagagctgagtggctccatgcagaagtctgtgttcaacatctgtcatgctggagatcattaatgttcaattgcttcctattgtcttcatgtcattcaacttcatttcattgtcattgcttcagctgggggattaatcaactatttatgagaagacaggacttggagtcagggcggtcacaatggggttatagtctgagcaatggtggggaaagcaagtcacggttaaaagactactagtttgtgacagtttgttgacattttaataaacatatttgagaataaaagcatgggcctcgttggcctca

SEQ ID NO: 460938 - DNA, 771 bp, Homo sapiens
  misc_feature (29)..(29): n is a, c, g, or t
aacttaggctaggtacgaggctgggtgtngaatcggccgaggggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaactcgagtttttttttttttttttttttttttcaaatttaaaatatcttttttcttctctttaaatcatttcgccattctccagggtatatcctacggggaagggtaggggaaccatggccagccctggctcctactgccatcctcccaaccgaagttagc

SEQ ID NO: 460939 - DNA, 598 bp, Homo sapiens
  misc_feature (29)..(29): n is a, c, g, or t
aacttaggctaggtacgaggctgggtgtngaatcggccgaggggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 460940 - DNA, 815 bp, Homo sapiens
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 460941 - DNA, 645 bp, Homo sapiens
gcggctaggtagcgaggccgggtggtcgcgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaatgtttctcttcattgagtagaagtgtggtgtcctctcccccaaagaaatatttaaagcaaattttg

SEQ ID NO: 460942 - DNA, 168 bp, Homo sapiens
gtggagtctgtagacttcgaccatggacggcatgctggtttggcccgggacgcacgttttgctaagatcgctgatggagggagcctgagctgctggaacctattccctatgaattcatggcataataggtgttaaaaaaaaaaataaaggacctctgggctacaaaaa

SEQ ID NO: 460943 - DNA, 974 bp, Homo sapiens
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaacaaaaagaaagcttatgcttggggcgcaattgaagctcataggccaatcggcctataggagtcatatacattcccgggcggcttattacacgcgtactggagaaccggtggtacacattaatacgtagacatcacctgatcacaggtaatcaaagcaaa

SEQ ID NO: 460944 - DNA, 1196 bp, Homo sapiens
  misc_feature (816)..(816): n is a, c, g, or t
  misc_feature (819)..(819): n is a, c, g, or t
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaanaanaaaaaaaaaaaaaaaaaaaaaaaaaaaaaaaaaaaaaaaaaaaaaaaaaaacaaaaaaacaaaaaaaaaaaaaaagaaaaaaaaaaaaaaaacacaagaaacaaaaacgacaacacaaaaacacaaaacacaaaaaaaagggaggaggtggcgcataacgactctcgacttcctaggtgacggagcaagcacagtcatgcaaccacgaggtcctttgatggacgactaacggtagcaagacagatgtgcacgtgtttatttagaaacgcaggtgagtccccggacgtctattatctgtcgcagtctcgtgatgatcaactacgcgtagccgaggcgcatacctcgtgctagcagcgactcgcttgttatggggtaga

SEQ ID NO: 460945 - DNA, 881 bp, Homo sapiens
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaatgtttctcttcattgagtagaagtgtggtgtcctctcccccaaagaaatatttaaagcaaattttg

SEQ ID NO: 460946 - DNA, 929 bp, Homo sapiens
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccaggtagggcctacgcgtggctcccgggcgctacgtgttcgacagacttgaaccgcgaccttgtggcctcagaggtcgttcattgggaccgtggggagactctctaacctgtttgagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 460947 - DNA, 5156 bp, Homo sapiens
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagtaagtagtgttgtagttctttgtggctaaccagtattccctcatatacccccttttcactttgccagttggacttatgtctttattggtcattcaagtggggcaaaggaaatatccttttaaaactcaggcaaactgggtgtttgtctgtatcctgtcagaggaaacaaattgaaatagatttactggaaagtcttacacagttagttactaagcggtttgtttgttttgtttcgagacggagtcttgctctgtcgccctggctggagtgcagtggtgggatctctgctctctgcaagctccacctcctgggttcacgccattctcctgcctcagcctctggggtagctaggactacaggcgcccaccaccatgcccagctaaattttttgtattcttagtagagacagggtttcactgtgtcagccaggatggtctcaatctcctgacctcgtgatctgcctgcctcggcctcccaaagtgctgggattacaggcatgagccaccgcgcctggcccagcagtttttatagaataaaaagagaagtttagtaaacttttaaattttattagcagtctggttttagattactagagtttaagagaccatcatctcatcaaagagagttaaaagtagggatgttctctgcaaggcctcttctgatatgattaattgattgtaaattaagtaatcaaggcatactttgttgatttgtcatatctgggtaaaaggtttatggtttatttaataaatgaaactgcaaaatcagttttctacatttctgttatatttttgttaaagcacttcgtattgagcacattaagcactctaagagccgagatagcttcctgaaacgtgtgaaggaaaatgatcagaaaaagaaagaagccaaagagaaaggtacctgggttcaactaaagcgccaggtaagaatttggtgtatatttcattggttctgagagcactttaaggttgagatttaacacatcacataattattttattccctttttttttcctttaatagcctgctccacccagagaagcacactttgtgagaaccaatgggaaggagcctgagctgctggaacctattccctatgaattcatggcataataggtgttaaaaaaaaaaataaaggacctctgggctacaaaaagtctagtgactccggctggctgctgcggggcgaggagactcgcagaatgcctgactagaggccactcgcgcgctctggacggtggccgtatctccagggtctgagccccggagccgcagtcctgccgcagagcgcctggagccgcgagcagctagcagcccggcgaagcgcacagcctcggcgatagtcagctccgcggcctctgctcccgcccctcccggccgctccgggaaggggcggagacgaggaggagctgggacggccgccgcgctcccgggcgcaccaagccctttaaaagccgcgggccttgacagttctgcaggcagccgccgcggtcccggacctctagtcccgcactcccagctggcgagccggctccgggtgcggcgaggcccagccctctcggattgcgcgccggaccccgggacgcgctccatgcggccgctcagcatgtccgggcactttctgctcgcacccatccccgagtcctcctcggactacctactgcccaaggacatcaaactggcggtgctgggcgccggccgcgtgggcaagagcgcaatgatcgtgcgcttcctgaccaagagattcattggagactatgaaccgaatacaggcaagctgtattcacggctggtctatgtcgagggggaccagctctccctgcagatccaggatactcccgggggcgtccagatccaagacagcctcccccaggtcgtcgattccctgtccaaatgcgtgcagtgggccgagggttttctgctggtctattccatcacagactatgacagctacttgtccatccgacccctttatcagcacatccggaaggtccaccctgactctaaagcccctgtcatcatcgtgggcaacaagggggaccttttgcatgcccggcaggtgcagacacaggacggtattcagctagccaatgagctgggcagcctgttccttgaaatttccactagcgaaaactacgaagatgtctgtgatgtgtttcagcatctctgcaaagaagtgagcaagatgcacggcctcagtggggaaagaagaagagcctccatcatccctcggccccgctctcccaacatgcaggacctgaagagacgcttcaagcaggctctgtctcccaaagtcaaagccccctctgcactggggtgaactatctcagacagatgcctctcctttttaatacgcatttgtagctatttgttactccattagaaggagtccccctcgagggcagtagctgcattttatgatcctgtcttccaatcttctagttcagtgcttccccatagagtggcgcgagtcactgtccccggcaataatataacttttaaaatggaaaatctagtttgttaagactctacttttctcaatccaaggaatagttacacatacacacacacacgcacacaatatatgtacatatatgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcatatatatgatatatgtatatacgtatatatatcatatatatgatatatgtatatatatcatatatgtgtatatatattatatatatacatacatatatatgtctagaaaccattgctatgcttactaaatgacactacatagggctggcagagcatcatcattgtccataaccagtatctgttgatcttgtgccagatgtttagcacattttctacttcattactgctcaaactctaatctttgaataatgactcaatttctctcttgcaaggggcacgcagtccctgctgcaaaggagttgcctcttctttaaaactggcgcatcatcagttggttaggttccctttgggtagtcccttcaggaaactcttggttttctttctggtttctgtgtcagggctccttgtcataaggaggtgggatagaattgggaggggaaagtctccattgcctgctgcttgggacccaggccatgagtcttgtaattgcatccgaccaatctgactccacatttatgtaacaaagttttttaaagtatattttggatgccaatccttaatcagaaatgtgttttgtagttattttctctcagtctgtggcttgtcttctcattcttctgatgttgtctttcacagagcagaagtttttaattttaatgaagttgggcttatcaattatttcctttataggttttgcctttggtgttacatctaaaaagtcatcgccaaacccaaggtcatctagattttcttctatattatcttctaggatatttatatcctagaagttttatagctttgtgctttacattttaggtctatgatctattttgagttaatttttgtgagtggcataaggtctgtgtctagattcatttttctgcatgtggatgtccagttgttccagcactgtttgttgaaaagactatctttgctgtgttgtctttcctttatttctttgtcaaagatcagttcgctgtatttatgtgagcatatttctaggctctctattctgttccattgatctatgcctgttcttcccccaataccacactatcctgattactgtagctttattaaatcttgaagtcaagtagtgtcagacctctggctttgtttttctccttcaatatcatgttggctattctggggcttttgcctctccatataaactttggaatcagtttgttgatatttataaaataactctctggaattttgactgttattgcactgagtgtaataagtatgcatttttgttgagtctttacctagtgatggaatttctggactgcagagtatgcatatgttcagcttcaattcagtttatattcagtttttcaaaatggttttgcaaatgtacaccctgccagaagcattgtgagtgttcttgtagctctgcgtcctcacaatatttggtgtttttccttttggctgctttggcatgatatgatcattatagtttgcatttccttggtgactaataaagttgagcaattaatcatatatgtgtatatgtgtatatatatatgtgtacatctatgtatatgtgtatatatatatctgtatgtgtatatgtatatacatatatgcatatattttaaagttgaatctcactctgtcacccaagttaaagtgt

SEQ ID NO: 460948 - DNA, 5094 bp, Homo sapiens
tggaaaggaacgccttagtgcaaagtttaattattgatgaagattactattactatgattaaaaaccctcctagtgaaagctgtgttcttctgtgacctggatttaaatgtatcttggcactcgagcttaatgatgactgttttttttgattgcttgaagcaatgtgaaaaacacatttcaccggctctgaaagctcttgagttgccatttgaaagaaatcttagaatactttacagttacttaaagtcagaattttaaaggaaggggaaatgctggtatataacattggtttctttaatagggaatgggtactgttcaaaaaggaatgccccacaagtgttaccatggcaaaactggaagagtctacaatgttacccagcatgctgttggcattgttgtaaacaaacaagttaagtaagtagtgttgtagttctttgtggctaaccagtattccctcatatacccccttttcactttgccagttggacttatgtctttattggtcattcaagtggggcaaaggaaatatccttttaaaactcaggcaaactgggtgtttgtctgtatcctgtcagaggaaacaaattgaaatagatttactggaaagtcttacacagttagttactaagcggtttgtttgttttgtttcgagacggagtcttgctctgtcgccctggctggagtgcagtggtgggatctctgctctctgcaagctccacctcctgggttcacgccattctcctgcctcagcctctggggtagctaggactacaggcgcccaccaccatgcccagctaaattttttgtattcttagtagagacagggtttcactgtgtcagccaggatggtctcaatctcctgacctcgtgatctgcctgcctcggcctcccaaagtgctgggattacaggcatgagccaccgcgcctggcccagcagtttttatagaataaaaagagaagtttagtaaacttttaaattttattagcagtctggttttagattactagagtttaagagaccatcatctcatcaaagagagttaaaagtagggatgttctctgcaaggcctcttctgatatgattaattgattgtaaattaagtaatcaaggcatactttgttgatttgtcatatctgggtaaaaggtttatggtttatttaataaatgaaactgcaaaatcagttttctacatttctgttatatttttgttaaagcacttaaaagaatttctgctctgtccaggggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccaggtaagaatttggtgtatatttcattggttctgagagcactttaaggttgagatttaacacatcacataattattttattccctttttttttcctttaatagcctgctccacccagagaagcacactttgtgagaaccaatgggaaggagcctgagctgctggaacctattccctatgaattcatggcataataggtgttaaaaaaaaaaataaaggacctctgggctacaaaaagtctagtgactccggctggctgctgcggggcgaggagactcgcagaatgcctgactagaggccactcgcgcgctctggacggtggccgtatctccagggtctgagccccggagccgcagtcctgccgcagagcgcctggagccgcgagcagctagcagcccggcgaagcgcacagcctcggcgatagtcagctccgcggcctctgctcccgcccctcccggccgctccgggaaggggcggagacgaggaggagctgggacggccgccgcgctcccgggcgcaccaagccctttaaaagccgcgggccttgacagttctgcaggcagccgccgcggtcccggacctctagtcccgcactcccagctggcgagccggctccgggtgcggcgaggcccagccctctcggattgcgcgccggaccccgggacgcgctccatgcggccgctcagcatgtccgggcactttctgctcgcacccatccccgagtcctcctcggactacctactgcccaaggacatcaaactggcggtgctgggcgccggccgcgtgggcaagagcgcaatgatcgtgcgcttcctgaccaagagattcattggagactatgaaccgaatacaggcaagctgtattcacggctggtctatgtcgagggggaccagctctccctgcagatccaggatactcccgggggcgtccagatccaagacagcctcccccaggtcgtcgattccctgtccaaatgcgtgcagtgggccgagggttttctgctggtctattccatcacagactatgacagctacttgtccatccgacccctttatcagcacatccggaaggtccaccctgactctaaagcccctgtcatcatcgtgggcaacaagggggaccttttgcatgcccggcaggtgcagacacaggacggtattcagctagccaatgagctgggcagcctgttccttgaaatttccactagcgaaaactacgaagatgtctgtgatgtgtttcagcatctctgcaaagaagtgagcaagatgcacggcctcagtggggaaagaagaagagcctccatcatccctcggccccgctctcccaacatgcaggacctgaagagacgcttcaagcaggctctgtctcccaaagtcaaagccccctctgcactggggtgaactatctcagacagatgcctctcctttttaatacgcatttgtagctatttgttactccattagaaggagtccccctcgagggcagtagctgcattttatgatcctgtcttccaatcttctagttcagtgcttccccatagagtggcgcgagtcactgtccccggcaataatataacttttaaaatggaaaatctagtttgttaagactctacttttctcaatccaaggaatagttacacatacacacacacacgcacacaatatatgtacatatatgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcatatatatgatatatgtatatacgtatatatatcatatatatgatatatgtatatatatcatatatgtgtatatatattatatatatacatacatatatatgtctagaaaccattgctatgcttactaaatgacactacatagggctggcagagcatcatcattgtccataaccagtatctgttgatcttgtgccagatgtttagcacattttctacttcattactgctcaaactctaatctttgaataatgactcaatttctctcttgcaaggggcacgcagtccctgctgcaaaggagttgcctcttctttaaaactggcgcatcatcagttggttaggttccctttgggtagtcccttcaggaaactcttggttttctttctggtttctgtgtcagggctccttgtcataaggaggtgggatagaattgggaggggaaagtctccattgcctgctgcttgggacccaggccatgagtcttgtaattgcatccgaccaatctgactccacatttatgtaacaaagttttttaaagtatattttggatgccaatccttaatcagaaatgtgttttgtagttattttctctcagtctgtggcttgtcttctcattcttctgatgttgtctttcacagagcagaagtttttaattttaatgaagttgggcttatcaattatttcctttataggttttgcctttggtgttacatctaaaaagtcatcgccaaacccaaggtcatctagattttcttctatattatcttctaggatatttatatcctagaagttttatagctttgtgctttacattttaggtctatgatctattttgagttaatttttgtgagtggcataaggtctgtgtctagattcatttttctgcatgtggatgtccagttgttccagcactgtttgttgaaaagactatctttgctgtgttgtctttcctttatttctttgtcaaagatcagttcgctgtatttatgtgagcatatttctaggctctctattctgttccattgatctatgcctgttcttcccccaataccacactatcctgattactgtagctttattaaatcttgaagtcaagtagtgtcagacctctggctttgtttttctccttcaatatcatgttggctattctggggcttttgcctctccatataaactttggaatcagtttgttgatatttataaaataactctctggaattttgactgttattgcactgagtgtaataagtatgcatttttgttgagtctttacctagtgatggaatttctggactgcagagtatgcatatgttcagcttcaattcagtttatattcagtttttcaaaatggttttgcaaatgtacaccctgccagaagcattgtgagtgttcttgtagctctgcgtcctcacaatatttggtgtttttccttttggctgctttggcatgatatgatcattatagtttgcatttccttggtgactaataaagttgagcaattaatcatatatgtgtatatgtgtatatatatatgtgtacatctatgtatatgtgtatatatatatctgtatgtgtatatgtatatacatatatgcatatattttaaagttgaatctcactctgtcacccaagttaaagtgt

SEQ ID NO: 460949 - DNA, 1745 bp, Homo sapiens
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagtaagtagtgttgtagttctttgtggctaaccagtattccctcatatacccccttttcactttgccagttggacttatgtctttattggtcattcaagtggggcaaaggaaatatccttttaaaactcaggcaaactgggtgtttgtctgtatcctgtcagaggaaacaaattgaaatagatttactggaaagtcttacacagttagttactaagcggtttgtttgttttgtttcgagacggagtcttgctctgtcgccctggctggagtgcagtggtgggatctctgctctctgcaagctccacctcctgggttcacgccattctcctgcctcagcctctggggtagctaggactacaggcgcccaccaccatgcccagctaaattttttgtattcttagtagagacagggtttcactgtgtcagccaggatggtctcaatctcctgacctcgtgatctgcctgcctcggcctcccaaagtgctgggattacaggcatgagccaccgcgcctggcccagcagtttttatagaataaaaagagaagtttagtaaacttttaaattttattagcagtctggttttagattactagagtttaagagaccatcatctcatcaaagagagttaaaagtagggatgttctctgcaaggcctcttctgatatgattaattgattgtaaattaagtaatcaaggcatactttgttgatttgtcatatctgggtaaaaggtttatggtttatttaataaatgaaactgcaaaatcagttttctacatttctgttatatttttgttaaagcacttaaaagaatttctgctctgtccaggggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccaggtaagaatttggtgtatatttcattggttctgagagcactttaaggttgagatttaacacatcacataattattttattccctttttttttcctttaatagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 460950 - DNA, 4265 bp, Homo sapiens
tggaaaggaacgccttagtgcaaagtttaattattgatgaagattactattactatgattaaaaaccctcctagtgaaagctgtgttcttctgtgacctggatttaaatgtatcttggcactcgagcttaatgatgactgttttttttgattgcttgaagcaatgtgaaaaacacatttcaccggctctgaaagctcttgagttgccatttgaaagaaatcttagaatactttacagttacttaaagtcagaattttaaaggaaggggaaatgctggtatataacattggtttctttaatagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccaggtaagaatttggtgtatatttcattggttctgagagcactttaaggttgagatttaacacatcacataattattttattccctttttttttcctttaatagcctgctccacccagagaagcacactttgtgagaaccaatgggaaggagcctgagctgctggaacctattccctatgaattcatggcataataggtgttaaaaaaaaaaataaaggacctctgggctacaaaaagtctagtgactccggctggctgctgcggggcgaggagactcgcagaatgcctgactagaggccactcgcgcgctctggacggtggccgtatctccagggtctgagccccggagccgcagtcctgccgcagagcgcctggagccgcgagcagctagcagcccggcgaagcgcacagcctcggcgatagtcagctccgcggcctctgctcccgcccctcccggccgctccgggaaggggcggagacgaggaggagctgggacggccgccgcgctcccgggcgcaccaagccctttaaaagccgcgggccttgacagttctgcaggcagccgccgcggtcccggacctctagtcccgcactcccagctggcgagccggctccgggtgcggcgaggcccagccctctcggattgcgcgccggaccccgggacgcgctccatgcggccgctcagcatgtccgggcactttctgctcgcacccatccccgagtcctcctcggactacctactgcccaaggacatcaaactggcggtgctgggcgccggccgcgtgggcaagagcgcaatgatcgtgcgcttcctgaccaagagattcattggagactatgaaccgaatacaggcaagctgtattcacggctggtctatgtcgagggggaccagctctccctgcagatccaggatactcccgggggcgtccagatccaagacagcctcccccaggtcgtcgattccctgtccaaatgcgtgcagtgggccgagggttttctgctggtctattccatcacagactatgacagctacttgtccatccgacccctttatcagcacatccggaaggtccaccctgactctaaagcccctgtcatcatcgtgggcaacaagggggaccttttgcatgcccggcaggtgcagacacaggacggtattcagctagccaatgagctgggcagcctgttccttgaaatttccactagcgaaaactacgaagatgtctgtgatgtgtttcagcatctctgcaaagaagtgagcaagatgcacggcctcagtggggaaagaagaagagcctccatcatccctcggccccgctctcccaacatgcaggacctgaagagacgcttcaagcaggctctgtctcccaaagtcaaagccccctctgcactggggtgaactatctcagacagatgcctctcctttttaatacgcatttgtagctatttgttactccattagaaggagtccccctcgagggcagtagctgcattttatgatcctgtcttccaatcttctagttcagtgcttccccatagagtggcgcgagtcactgtccccggcaataatataacttttaaaatggaaaatctagtttgttaagactctacttttctcaatccaaggaatagttacacatacacacacacacgcacacaatatatgtacatatatgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcatatatatgatatatgtatatacgtatatatatcatatatatgatatatgtatatatatcatatatgtgtatatatattatatatatacatacatatatatgtctagaaaccattgctatgcttactaaatgacactacatagggctggcagagcatcatcattgtccataaccagtatctgttgatcttgtgccagatgtttagcacattttctacttcattactgctcaaactctaatctttgaataatgactcaatttctctcttgcaaggggcacgcagtccctgctgcaaaggagttgcctcttctttaaaactggcgcatcatcagttggttaggttccctttgggtagtcccttcaggaaactcttggttttctttctggtttctgtgtcagggctccttgtcataaggaggtgggatagaattgggaggggaaagtctccattgcctgctgcttgggacccaggccatgagtcttgtaattgcatccgaccaatctgactccacatttatgtaacaaagttttttaaagtatattttggatgccaatccttaatcagaaatgtgttttgtagttattttctctcagtctgtggcttgtcttctcattcttctgatgttgtctttcacagagcagaagtttttaattttaatgaagttgggcttatcaattatttcctttataggttttgcctttggtgttacatctaaaaagtcatcgccaaacccaaggtcatctagattttcttctatattatcttctaggatatttatatcctagaagttttatagctttgtgctttacattttaggtctatgatctattttgagttaatttttgtgagtggcataaggtctgtgtctagattcatttttctgcatgtggatgtccagttgttccagcactgtttgttgaaaagactatctttgctgtgttgtctttcctttatttctttgtcaaagatcagttcgctgtatttatgtgagcatatttctaggctctctattctgttccattgatctatgcctgttcttcccccaataccacactatcctgattactgtagctttattaaatcttgaagtcaagtagtgtcagacctctggctttgtttttctccttcaatatcatgttggctattctggggcttttgcctctccatataaactttggaatcagtttgttgatatttataaaataactctctggaattttgactgttattgcactgagtgtaataagtatgcatttttgttgagtctttacctagtgatggaatttctggactgcagagtatgcatatgttcagcttcaattcagtttatattcagtttttcaaaatggttttgcaaatgtacaccctgccagaagcattgtgagtgttcttgtagctctgcgtcctcacaatatttggtgtttttccttttggctgctttggcatgatatgatcattatagtttgcatttccttggtgactaataaagttgagcaattaatcatatatgtgtatatgtgtatatatatatgtgtacatctatgtatatgtgtatatatatatctgtatgtgtatatgtatatacatatatgcatatattttaaagttgaatctcactctgtcacccaagttaaagtgt

SEQ ID NO: 460951 - DNA, 770 bp, Homo sapiens
gtagggcctacgcgtggctcccgggcgctacgtgttcgacagacttgaaccgcgaccttgtggcctcagaggtcgttcattgggaccgtggggagactctctaacctgtttgaggtccattggcatgggcgggttaaaccatgttctgccagacggggagcagcgtgcgccgggtcgggcctgggccgtgggctgagaaccggactgcgatgttgcggccctgcggggggacatttgcgagaaagacgagactgagtcgcttggggtgaggcgactcgagttaatctttaaaagacttcgttttatgttcccgtggctgcatctccggtactgtgggtggcccctctcacataggctgtgtgggggccgcgtggcctgatgcctttctaactcctttcagtgtggcttttttattccaaatcttgcgatgatgttgggtgaggacttaaggggtagtaggaatgggtttaaagtcaggcgtcggctttaatcttctgtgaagcctacaggtgtgaaaacccgggctctcggtcggagagtgggtcccggagtcgtcctgggtgatgaaccctcactgcccttagttaatgcataagacgatttccgactgtttttaaaattttgaccccacatggtgatcggacgaagggaaagtgttttgaggttgcaacaccaatatttgcaccaagaggagatactgttttgcgaattctagggcagcatgctttgagtgaagggaaacatttagccatagttcatcattttgtcta

SEQ ID NO: 460952 - DNA, 5210 bp, Homo sapiens
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagtaagtagtgttgtagttctttgtggctaaccagtattccctcatatacccccttttcactttgccagttggacttatgtctttattggtcattcaagtggggcaaaggaaatatccttttaaaactcaggcaaactgggtgtttgtctgtatcctgtcagaggaaacaaattgaaatagatttactggaaagtcttacacagttagttactaagcggtttgtttgttttgtttcgagacggagtcttgctctgtcgccctggctggagtgcagtggtgggatctctgctctctgcaagctccacctcctgggttcacgccattctcctgcctcagcctctggggtagctaggactacaggcgcccaccaccatgcccagctaaattttttgtattcttagtagagacagggtttcactgtgtcagccaggatggtctcaatctcctgacctcgtgatctgcctgcctcggcctcccaaagtgctgggattacaggcatgagccaccgcgcctggcccagcagtttttatagaataaaaagagaagtttagtaaacttttaaattttattagcagtctggttttagattactagagtttaagagaccatcatctcatcaaagagagttaaaagtagggatgttctctgcaaggcctcttctgatatgattaattgattgtaaattaagtaatcaaggcatactttgttgatttgtcatatctgggtaaaaggtttatggtttatttaataaatgaaactgcaaaatcagttttctacatttctgttatatttttgttaaagcacttaaaagaatttctgctctgtccaggggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccaggtaagaatttggtgtatatttcattggttctgagagcactttaaggttgagatttaacacatcacataattattttattccctttttttttcctttaatagcctgctccacccagagaagcacactttgtgagaaccaatgggaaggagcctgagctgctggaacctattccctatgaattcatggcataataggtgttaaaaaaaaaaataaaggacctctgggctacaaaaagtctagtgactccggctggctgctgcggggcgaggagactcgcagaatgcctgactagaggccactcgcgcgctctggacggtggccgtatctccagggtctgagccccggagccgcagtcctgccgcagagcgcctggagccgcgagcagctagcagcccggcgaagcgcacagcctcggcgatagtcagctccgcggcctctgctcccgcccctcccggccgctccgggaaggggcggagacgaggaggagctgggacggccgccgcgctcccgggcgcaccaagccctttaaaagccgcgggccttgacagttctgcaggcagccgccgcggtcccggacctctagtcccgcactcccagctggcgagccggctccgggtgcggcgaggcccagccctctcggattgcgcgccggaccccgggacgcgctccatgcggccgctcagcatgtccgggcactttctgctcgcacccatccccgagtcctcctcggactacctactgcccaaggacatcaaactggcggtgctgggcgccggccgcgtgggcaagagcgcaatgatcgtgcgcttcctgaccaagagattcattggagactatgaaccgaatacaggcaagctgtattcacggctggtctatgtcgagggggaccagctctccctgcagatccaggatactcccgggggcgtccagatccaagacagcctcccccaggtcgtcgattccctgtccaaatgcgtgcagtgggccgagggttttctgctggtctattccatcacagactatgacagctacttgtccatccgacccctttatcagcacatccggaaggtccaccctgactctaaagcccctgtcatcatcgtgggcaacaagggggaccttttgcatgcccggcaggtgcagacacaggacggtattcagctagccaatgagctgggcagcctgttccttgaaatttccactagcgaaaactacgaagatgtctgtgatgtgtttcagcatctctgcaaagaagtgagcaagatgcacggcctcagtggggaaagaagaagagcctccatcatccctcggccccgctctcccaacatgcaggacctgaagagacgcttcaagcaggctctgtctcccaaagtcaaagccccctctgcactggggtgaactatctcagacagatgcctctcctttttaatacgcatttgtagctatttgttactccattagaaggagtccccctcgagggcagtagctgcattttatgatcctgtcttccaatcttctagttcagtgcttccccatagagtggcgcgagtcactgtccccggcaataatataacttttaaaatggaaaatctagtttgttaagactctacttttctcaatccaaggaatagttacacatacacacacacacgcacacaatatatgtacatatatgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcacatatatgatatatgtatatacgtatatatatcatatatatgatatatgtatatacgtatatatatcatatatatgatatatgtatatatatcatatatgtgtatatatattatatatatacatacatatatatgtctagaaaccattgctatgcttactaaatgacactacatagggctggcagagcatcatcattgtccataaccagtatctgttgatcttgtgccagatgtttagcacattttctacttcattactgctcaaactctaatctttgaataatgactcaatttctctcttgcaaggggcacgcagtccctgctgcaaaggagttgcctcttctttaaaactggcgcatcatcagttggttaggttccctttgggtagtcccttcaggaaactcttggttttctttctggtttctgtgtcagggctccttgtcataaggaggtgggatagaattgggaggggaaagtctccattgcctgctgcttgggacccaggccatgagtcttgtaattgcatccgaccaatctgactccacatttatgtaacaaagttttttaaagtatattttggatgccaatccttaatcagaaatgtgttttgtagttattttctctcagtctgtggcttgtcttctcattcttctgatgttgtctttcacagagcagaagtttttaattttaatgaagttgggcttatcaattatttcctttataggttttgcctttggtgttacatctaaaaagtcatcgccaaacccaaggtcatctagattttcttctatattatcttctaggatatttatatcctagaagttttatagctttgtgctttacattttaggtctatgatctattttgagttaatttttgtgagtggcataaggtctgtgtctagattcatttttctgcatgtggatgtccagttgttccagcactgtttgttgaaaagactatctttgctgtgttgtctttcctttatttctttgtcaaagatcagttcgctgtatttatgtgagcatatttctaggctctctattctgttccattgatctatgcctgttcttcccccaataccacactatcctgattactgtagctttattaaatcttgaagtcaagtagtgtcagacctctggctttgtttttctccttcaatatcatgttggctattctggggcttttgcctctccatataaactttggaatcagtttgttgatatttataaaataactctctggaattttgactgttattgcactgagtgtaataagtatgcatttttgttgagtctttacctagtgatggaatttctggactgcagagtatgcatatgttcagcttcaattcagtttatattcagtttttcaaaatggttttgcaaatgtacaccctgccagaagcattgtgagtgttcttgtagctctgcgtcctcacaatatttggtgtttttccttttggctgctttggcatgatatgatcattatagtttgcatttccttggtgactaataaagttgagcaattaatcatatatgtgtatatgtgtatatatatatgtgtacatctatgtatatgtgtatatatatatctgtatgtgtatatgtatatacatatatgcatatattttaaagttgaatctcactctgtcacccaagttaaagtgt

SEQ ID NO: 460953 - DNA, 579 bp, Homo sapiens
gcggctaggtagcgaggccgggtggtcgcgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 460954 - DNA, 381 bp, Homo sapiens
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccagtaattcgccaaaatgacgaacacaaagggaaagaggagaggcacccgatatatgttctctaggccttttagaaaacatgtagacatcaagggaatgggtactgt

SEQ ID NO: 460955 - DNA, 1418 bp, Homo sapiens
  misc_feature (831)..(831): n is a, c, g, or t
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaacacaaaaacacacacnacacacacatacacaacaactaatcaaataacaacacataaccaacacacagcgtccatacttaataactcacactcgatgcctcccacacataaacatgattacaacaccactttatatcaaaaagacacaccctattaactattaatactaccgcacacgctgcgcgggctctatacaagaaagctcacaacgagaaagccgactcacagtgacctatgctgtaggataccccccacatggcgcgggaccactagcaggaaaaatatcagacgattacgcccacaggtaatacataactggtgagtgtaggtgaagaaggaagagagaagatctactgttagtgatcctgctagtctagaggagtagagaattcagaagggcagtagtagtgcgtcgcgagcgcggcgatgagtgtcgacgggtgatgtttgtcgcctactggctggtgggtgtctggcgtgtcagtggtgagtgcgttgagtggcgcactagtgcggagtagtcatggcggtgggtgggtaggagacggggcgggcggaaggtgtggtgtgaagcgacgtgggcagcgtacagaggtgggttgg

SEQ ID NO: 460956 - DNA, 1080 bp, Homo sapiens
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccaggtagggcctacgcgtggctcccgggcgctacgtgttcgacagacttgaaccgcgaccttgtggcctcagaggtcgttcattgggaccgtggggagactctctaacctgtttgaggtccattggcatgggcgggttaaaccatgttctgccagacggggagcagcgtgcgccgggtcgggcctgggccgtgggctgagaaccggactgcgatgttgcggccctgcggggggacatttgcgagaaagacgagactgagtcgcttgggtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 460957 - DNA, 886 bp, Homo sapiens
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccaggtagggcctacgcgtggctcccgggcgctacgtgttcgacagacttgaaccgcgaccttgtggcctcagagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 460958 - DNA, 916 bp, Homo sapiens
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccaggtaagaatttggtgtatatttcattggttctgagagcactttaaggttgagatttaacacatcacataattattttattccctttttttttcctttaatagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 460959 - DNA, 1644 bp, Homo sapiens
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagtaagtagtgttgtagttctttgtggctaaccagtattccctcatatacccccttttcactttgccagttggacttatgtctttattggtcattcaagtggggcaaaggaaatatccttttaaaactcaggcaaactgggtgtttgtctgtatcctgtcagaggaaacaaattgaaatagatttactggaaagtcttacacagttagttactaagcggtttgtttgttttgtttcgagacggagtcttgctctgtcgccctggctggagtgcagtggtgggatctctgctctctgcaagctccacctcctgggttcacgccattctcctgcctcagcctctggggtagctaggactacaggcgcccaccaccatgcccagctaaattttttgtattcttagtagagacagggtttcactgtgtcagccaggatggtctcaatctcctgacctcgtgatctgcctgcctcggcctcccaaagtgctgggattacaggcatgagccaccgcgcctggcccagcagtttttatagaataaaaagagaagtttagtaaacttttaaattttattagcagtctggttttagattactagagtttaagagaccatcatctcatcaaagagagttaaaagtagggatgttctctgcaaggcctcttctgatatgattaattgattgtaaattaagtaatcaaggcatactttgttgatttgtcatatctgggtaaaaggtttatggtttatttaataaatgaaactgcaaaatcagttttctacatttctgttatatttttgttaaagcacttaaaagaatttctgctctgtccaggggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 460960 - DNA, 1683 bp, Homo sapiens
  misc_feature (1096)..(1096): n is a, c, g, or t
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccaggtagggcctacgcgtggctcccgggcgctacgtgttcgacagacttgaaccgcgaccttgtggcctcagaggtcgttcattgggaccgtggggagactctctaacctgtttgaggtccattggcatgggcgggttaaaccatgttctgccagacggggagcagcgtgcgccgggtcgggcctgggccgtgggctgagaaccggactgcgatgttgcggccctgcggggggacatttgcgagaaagacgagactgagtcgcttgggtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaacacaaaaacacacacnacacacacatacacaacaactaatcaaataacaacacataaccaacacacagcgtccatacttaataactcacactcgatgcctcccacacataaacatgattacaacaccactttatatcaaaaagacacaccctattaactattaatactaccgcacacgctgcgcgggctctatacaagaaagctcacaacgagaaagccgactcacagtgacctatgctgtaggataccccccacatggcgcgggaccactagcaggaaaaatatcagacgattacgcccacaggtaatacataactggtgagtgtaggtgaagaaggaagagagaagatctactgttagtgatcctgctagtctagaggagtagagaattcagaagggcagtagtagtgcgtcgcgagcgcggcgatgagtgtcgacgggtgatgtttgtcgcctactggctggtgggtgtctggcgtgtcagtggtgagtgcgttgagtggcgcactagtgcggagtagtcatggcggtgggtgggtaggagacggggcgggcggaaggtgtggtgtgaagcgacgtgggcagcgtacagaggtgggttgg

SEQ ID NO: 460961 - DNA, 1637 bp, Homo sapiens
gatactacaaaagatcagtgaacagccagtaggaagagatgaatagggcaaggtatgggggaaggggcacaccaccatcccagtgtcaccagtagagtcatgattgcaagctgtccaggttcttggcgttttgaacaaagaattggacaaaactccaagcaaagaaagaatgaagcaacaaaagaacaaaagcagggatttattgaaaacaaaagtacactccacagtgtgggagctgccctagcagcactcccccccgacccccgctgctttaccgaatcttcttgggtccaaataccccctagaactttcccattggccattccatgctcacctcatgtaaatgaagaggtggcttgcaattggtctgattggttgccagacccacccccacatcagacagatcctccaaaagaagctcagtttgctcctagggagtttgatcaaccagggaagattgtctcttatcactggagaggagagtgagtacctatgaggcattttacttggtgttaggaggaatgcaaagatgactaaatgtaatttctgcccacaaaagcctggtggaagaaatcagttttatatacaaataattatgacttatagaactgaactataaagttactgttagtatctagggtatgatatatccagactgaaagctttctgtattgaatttacataaaataaatttgaattcaacatctggaaggaaattttacctggattgttcttaggcccatattcatctgctatgaaaagcaaggtatgaactttgttagattcatcaagagagacttttattaaccaacttttcttggctacctgtactacagaaacatggaataacccatataatatgcatacgacaaaatattgaagcaaactttattaaaccaaactttcagcagttatttaggaaaagttcttgtgcatggaaatgcagggatctccagaaggtatgaagttagaaataatctttctttctataacatttaattaatgggctgtattttctggttgtttttaaaattattttcccctcttcagtgcagcctttgttattgcatacattatggaaacatttggaatgaagtacagaaaacaactgctgatggtttcctgtgtgtgtcttcttttccccacctaaaatgcatcacatttagtctccctattcttggttcatatgtcatctcctcaggaagacatgatgattaatgcactcttcctttaacccctagtcatttggagttcccatagaagcacagcacttcatctgaaacttaatcacagtatctgggtttagcctgagggctaggatattttatctcattcaattgtattgatactatatttttatctttatgaattttatagtgaaacattcttcaattagaatatgccctctgaattaacattattattaccatgatataacagtcctgtagggcataagtttaaggtcatgccattgttaggcaaaaaacacagcagaccctctgctggtttaactgttccctaaagttttcctccattgagagtctaatttcttgattataacttttggggatacagagatagctttgattctatgtgggagatttctgtactagcagatgctggtatgaagaatagat

SEQ ID NO: 460962 - DNA, 1676 bp, Homo sapiens
agcggagagtcacctaagtcctcattggaagaccaggccatgcaaccagaggggttgaaatgtaggatggaggaatccaatgcagagaggggcacagccgaacccttcccgaggctccacaacttgtacagcacccctcgctgcgcgcagcaggccgccctgccccggctgagccgcaggatggcgagccagcactcctatccactgaaccgcttctcctccgtgcctttagaccccatggagcgccccatgtcccaggccgacctggagctggactacaacccgccgcgggtgcagctcagcgacgagatgttcgtgttccaggacgggcgctgggtaaatgagaactgccgcctgcagtctccctacttctccccatccgcctccttccaccacaagctgcaccacaagaggctggccaaggagtgcatgctgcaggaggagaacaagtctctgcgggaggagaacaaggccctgcgcgaggagaaccggatgctcagcaaggagaacaagatcctacaggtcttctgggaggagcacaaggcctcgctgggccgagaggagagccgggccccctcgccactgctgcacaaagacagcgcgtccctggaggtggtgaagaaggaccacgtcgccctgcaggtgccccgtggcaaggaggacagcaccctgcagctcctccgggaggagaatcgcgcgctgcagcagctgctggagcagaaacaggcctactgggcgcaggcagaggacacggccgcccctgccgaggaaagcaagcccgccccctcaccccacgaggagccctgcagccccgggctgctgcaggaccagggctccggcctctcctcccgcttcgaggagcccaaagggcctccggcccggcaggaggactccaaggagctgcgcgccctgcggaagatggtcagcaacatgtccgggccctccggggaggaggaggccaaggtgggcccgggcctgcccgacggctgccagcccctgcagctgctgagagagatgaggcaggcgctgcaggccctgctcaaggagaaccggctcctgcaggaggagaacaggaccctgcaggtgctacgggcagagcacaggggcttccaggaggagaacaaggccctgtgggagaacaacaagctgaagctgcagcagaagctggtcattgacaccgtgaccgaggtcaccgcgcgcatggaaatgctcatcgaggagctctacgccttcatgccggccaggagccaggaccccaagaagcctagcagggtctgaggcctcggccttgcaccgggacgccgagtttgggacaccgaacactgggcaaaagagaatcccctgccttcctttgtcgtcctcgccttccccagccagttcgtacctattgaaaagcagcgttagcagccttcctaaactcagagttttaataaaggtgtgaggaggctggggccagttgacaccagcatgctgcctttttctttctttctttctttctttcttttaataaaagatagacaatattttagagcagttttgggttcacagctaaactgagcagaaagtacagggagttcccatagactcccgtcccacaaatgcataatctcccgcattatcaccatccctccagagaggtctatgggggaagagatcaccctaagccagggcttttc

SEQ ID NO: 460963 - DNA, 957 bp, Homo sapiens
agcagggtagtaagaagtagagaccggatctggaaagagtaatacaaaatatctggcacatacaaatgaaagatttcacatctgtttttgtttgtttgtttgtttttgagatggagtcttgctctgtcgcccaggttgcagtgcagtggtgcgatctcagctcactgcaatcgccacttcccaggttcaagggattctcctgcctcagcttcccgagccaccttgcccagctaatttttgtatttttagtagagacagggtttcaccatgttggccagactggtttcaaacttctgacctcaggtgatccaccctcttcagcttcccaaagtgctgggattacaggtgccaaacttaaaatatgtaagaggcagctttatgctaaacttgacaaaagaaagcctcagagtgggaaagtcaacctaagagagaaaccgtttattttgtgggtaatgctgagtgcccatttgagtggagacctaaaaaccagactctgagcagtagcatgaaccaaatgttgtcctagacctgaagtttggccatatcccattgtaagcattgacatcaccacctacctctcagagacagttaacaggcctgaggtatgatgagaaaagagagcaaccagacacaacaactaaccagcattccttcctgataatagaccactgaccttggagtggctctggccagtctacaaaggatgcacactgagtaccttagtgtcctctgcttcaccttttgacatcagagggcagaaaactccacccatgcctccaggcttccatgaagaggcatgaagctcagtttccgctttcataaatatttatgactcctcctgtagctattaaataatgtatatttgaccactcagttcagcataaattcttattccttttgcccctcccttgaagtgcctctttctgacttctattcagagactgtttcccagtctgt

SEQ ID NO: 460964 - DNA, 2237 bp, Homo sapiens
tcagaagctgtcggactgtgagcgccttcgaactttggaggcttggctcgggatggaggtttttttagcatggggaccagggaggactacggtgctcgggactgggctgcggcctcctcgcggccccgagtgccctgtgaaatcagctcaggccgcgtccctctagcctgcactttccctctgttcacgctgcttccctccagggcccggcctccaagtgaaggggggcggagggcggtcacctgccagaaggtctggggcgccaaggtgtgtcccgggactcttggctccgtccaggttccaggccccgccccccagcttatccctagccggggctccccaccgtgggaacggggaccagctggccggaagcgccaaactgcgtccctgtccgagccctggggatcaatcaagccgaggagttaattatgtaatgagggggcagggggtcgaggctaatgaagcctcccggggtggggagggaggggaggaggggaccgtacccaggtatccgaccccctctcggaccccttcgaggccccaggggtctccaccccagcccaactccagggccccaaagaggggaggggctgtgatcctggatctggaaggggctgagctgtgagctataaagggggcatctcgcagcaccgggggccctaagcagcgagacctgaggccagacggaactacaacatgtaccatccacgagaattgtacccgtccctgggggccggctaccgcctggggcccgcccaacctggggccgactccagcttcccacccgccctagcggagggctaccgctaccccgaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacctgatcctgcactccatgcacaagtaccaaccccgcatacacctagttcgggcagcccagctctgcagccagcactgggggggcatggcctccttccgcttccccgagaccacattcatctccgtgacagcctaccagaacccacagatcacacaactgaagattgcagccaatccctttgccaaaggcttccgggagaacggcagaaactgtaagaggtgggagttgttcattcatttgttcatgcattcaacaaatgtttattaatcactcactgtgtgccaggcaccgtgctggacatcagaaatgcagtggtaagtgaaaacattcattcactgactcagcaaatacttatatagtacctgctatgtgccagggacagttccaggcactggagataaaacaaacaaagcaaaccaaagccccggccctcatgcagctgatttctagtggggagagtagacaagcagacaagagaaataaataaaatgtcatctgttaggaagccattctaaagagaagagagaccaggtgtggtggctcacgcatgtaatcccagcactctgggaggctgaggcgggcagatcacctgaggccaggagttcgagaccagcctgccaacatggtgaaaccctgtctctgctaaaaatacaaaaattagccaggcatggtggcaaacgcctgtaatcccaactacttgggaggctgaggcaggagaatctcttgaacccaggaggtggaggttgcagtgagtcgagatcatgccattgcattccagcctaggcaacacgagcaaaacttcctctcaaaaaaaaaaaaaaaaagaaagaaaagaaaactctgtctcaaaaaaaaaaaaaaaaagaaaaaaaagaaaaaggagaagagaaataaaccaggaaaagataggaaggactggg

SEQ ID NO: 460965 - DNA, 370 bp, Homo sapiens
gcctcccggggtggggagggaggggaggaggggaccgtacccaggtatccgaccccctctcggaccccttcgaggccccaggggtctccaccccagcccaactccagggccccaaagaggggaggggctgtgatcctggatctggaaggggctgagctgtgagctataaagggggcatctcgcagcaccgggggccctaagcagcgagacctgaggccagacggaactacaacatgtaccatccacgagaattgtacccgtccctgggggccggctaccgcctggggcccgcccaacctggggccgactccagcttcccacccgccctagcggagggctaccgctaccccggtgagcgttgggaccagct

SEQ ID NO: 460966 - DNA, 1753 bp, Homo sapiens
caaagtctacatcttggcactttattagggggacagagcagcaccctcactgcagccaccaccaccgcagcaccacaccgtcatcggggaactgatggaggagccctctaggattctgatacagcatggaggagacccccagtgggaagggcaaaaggagggcgatgagcttcctaggagcccagaagacaaggtccaggacctcaggcccctgcagcagccctggactctccaaactccagccctgctggagacagtgtcttcccagtctgtgtctgagccttctctcccgcccctccctccctccctcccacacccacagaaagctggtctctagcaggtgctagcgccggaggtggaggcggctgcagagagagagaagcccaggagggaggggcacagccctggctgaacccacaggattggtcaatctgcatcctctcagccagcacctgactaaagattcctcaaagcgacagtgacctcagcctctgctctgagctctgttggtcccagccaggagagcccgagtcatgaggtgggcacccagtgggcagggtgggcagcaggggccctcttggaggcagcagtgagttgggaagaggaggccgggccccacagcgggcatgatggacaagttccggatgatcttccagttcctgcagtccaaccaggagtccttcatgaatggcatctgtggcatcatggccctggccagtgcccagatgtactcggccttcgacttcaactgcccctgcctgccgggctacaatgcagcctacagcgcgggcatcctgctggcgccacccctggtgctctttctgcttggcctggtcatgaacaacaacgtgtccatgctggccgaagagtggaagcggccgctgggccgccgggccaaggaccccgctgtgttgcgctacatgttctgctccatggcccagcgcgccctcatcgcgcctgtcgtctgggtggccgtcacgctactcgacggcaaatgcttcctctgtgccttctgcactgccgtgcccgtgagcgcactgggcaacggcagcctggcacccggccttcctgcccccgagctcgcccgcctgctggcccgggtgccctgccctgagatctacgatggcgactggctgttggcccgagaggtggccgtgcgttacctccgctgcatctcccaggcgctgggctggtccttcgtgctgctgaccactctgctggcattcgtggtgcgctctgtgcggccctgcttcacgcaggccgccttcctcaagagcaagtactggtcccactatatcgacatcgagcgcaagctcttcgacgagacgtgcacggagcacgccaaagcctttgccaaggtctgcatccagcagttcttcgaggccatgaaccatgacctggagctgggtcacacccacgggacactggccacggcccctgcttccgcagctgcccccacgacccccgatggtgcggaggaggaaagggagaagctgcgtggcatcacggatcaaggcaccatgaacaggctgctcacgagctggcacaaatgcaaaccgcctctgcggctgggccaggaggagccaccgctgatgggcaacggctgggctgggggtgggccccggcctccgcgcgtctcatgaagtgggagccctctgatttgggcaagcgtgtcgtaggtggactgcatgtttatttagcacaaaccaagcacaaaagtcctcctgtagaggggtctttgaaaaaccacctt

SEQ ID NO: 460967 - DNA, 4492 bp, Homo sapiens
gcgctgtccctgatgaatccaagctgtcagcttctgtcagcttggctgggaagtcatgctgaccgtaaggggaatggtgcagcctgagttgggggctgagtgggaatgggcctggtgtggggtgggggaggtggggctctggtgccctgcagggtctcccttggagcacctggagcccaagaagctgtccctcacctttgcaatcccagggactcgccccctgatcatgatgaaggtggacccaaacccgctgaggggcctgaaggagcaaagacaggccatgctagccccagggcctccgttccctgttacccagcccccacccccagaagtacagaggaacctggtgccggccgccgtcaacccctatgtgatgatctttctacccgccctctttcgtgtcttggtgctggctgctgtctttggccagctaaaagaatatcagcaaaggaagagccctggtattccagcaggagcaaagacaaaaaagaaaaaaactgacagtagccctgagacaaccacttccggtggtggccactcacctggggatattcaggacattctgaaggtgcgggtgtccaaccttaaccactccaatgggagccagtaccaagaactagcagtagccctggagtcaagctcagtgacaatcagtcaactcaatgaaaacatagaatcattggcaaagaaaacaaacaatgaaatacacaaagcacaaatggagcggttagagacaatcaacatcctcacattggaaaaggcagacttgaagaccaccctttaccatactaaacgtgctgcccgacacttcgaagaagagtccaaggatctggctggccgcctgcaatactccttacagcgtattcaagaattggagcgggctctctgtgctgtgtctacacagcagcaggaagaggacagggggcactgcctgagctccccagatcaaaacttctcactcttcaccatccagtcctcgagctgcagagaagcggtcctccaccggcggttacagcagaccataaaggagcgggcgctgctgaacgcacacgtgacacaggtgacagagtcactaaaacaagtccagctagagcgagacgaatatgctaaacacataaaaggagagagggcccggtggcaggagaggatgtggaaaatgtcggtggaggctcgaacattgaaggaagagaagaagcgtgacatacatcggatacaggagctggagaggagcttgtccgaactcaaaaaccagatggctaagcccccatccctggcgcccccagcagtgacctctgtggtggaacagctacaagatgaggccaaacacctgaggcaggaggtggaaggtctggagggaaagctccaatcccaggtggaaaacaatcaggccttgagtctccttagcaaggaacaaaagcagagactccaggagcaggaggagatgctccgagagcaggaggtgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctgaacaacgagaaaaagagcgcactgcagttggagcagcaagtaaaggagctgcaggagaagctagacgaggtgaaggagatgcagtacgtggccacctatcagcagctgacctctgagaaggaggcgctgcacaggcagttactgctgcagacccagctcgtggaccagctgcagcagcaggaagcttggggcaaagcggagcacctagaagctgccagccagcagaaccaacagctagagacccagctaagcctcgtggctctcccgggagaaggagatggaggacaacatctggacagtgaggaggaggaggcgcctcggcccacgccaaacatcccagaggacctggagagccgggaggccacggagccagaggcagaggccccagccccagggagtgggggtgagtttgtgtgtggggagagctaccgggccctgaaggaggccatggtgaagctgaaagggagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgccacattagttactctgacgtaggaatttacttcttttctttgaatggaaaacactttaaaaataataacaaccattattataaaccaatatatgtgagagtacttagttgaaacaaaaaggagttttagtagacagtattatactacacatgaaaatcaaggcgaagtttatgcaacttaaaatgtttacaagctgcagtgcaatctaatgtttgcgaatgtccaagtattatgagaaaaagtgtctatacaatgacagacttacgtttcctcacaaagttcttcacaaagagtgaaatatgtttttatacctctcagtttcagttagaggcatattttgtgccatatttatgttaatgtgcctatacgtgatgagtgaattatttcagtcatacattgcctaaatcataactttaagatgcttgggaaagaatcaacagctaaaagttcatgaagttctaatgtctgtgttccaaaatacgtcacagtattaggatgcagggagagatgtgtgtgcgctccctggggtgggcatttctagttactagaccatctccatttttagcatttggcatcctcatgatacttttatacatatgacgttaataggagagcaataatacgattttacagatggaataacagatgtgcctgcattcagtgaaagagtgcaaatattaagtccttgtgacttcaactgactcttccaaattgtatgaatttatcaatgtattagataaactcagttccagaattataaagaaaaactgttagaccaacgaatgtggctaattaacagtaggacgatttctagcccgagggtttaaaatggacttcaagtcctgttcttgccttttattttctgaacttgccacttttgcattctttgagttcagtttaaagacagtttgagtccaatttagaccctcgggctagaaatcataccactgttaattagccaccttatttggtctaacagtttttctttataattctgaaactgggtttacctaatacattgataaattatttcaaaggtatttttatagttcaaatcacttcacttttaccctgataaatataaatgactaggaatgatcttcagctagcctttagcacctgcaaccaatcggacaataatgtgttcatcaggtacctgtggattaaatcacacaccggcatatttaagctgaatgtcagtctggaaaatgaatgtactatattaactgaaataccactctttgtgtaggtattctgtcatatatttaagaaaaattaaatagcatgtaaatcatataacaacaacttaagtctttcttcaaagtgcatgtggtcctttgcaatacctcattcagccaagtatttgttctcttcctcattcagtttaaggcagctttcaatttgcttagaaggcaacattagaagggtagagtttaatcagaaacatagaattttaaagtgtgggttcaactgaataaatttgaatttctgtaggaagtaaagaattaaaaatctatttaaagattgcaatatataatcatttttaaagtatttgtttaacctgatgggttttccagaaatgaaaacaagtcagttctaaaaccaaagctgatatttagaaaatgtgaaaatgtaaatcagccctatccataatatagtttctctaaaactttatcttaaagagtcattttaaaagaatataactattcataagtgtaactgctatcttaatgttttgaaataagttaaaacactttaaaatatgaatactgtagtttgaaagaaagaaactgggggaaggaaaagtagagaaagaaatgccaattccaatgcaaggctttatttgccaagttttcttagaatgacttttaccagtttatgaattcttgtaaacagaatgtataatagaaatactgaaacactgttgcctaaagtggcattgttgactgctactgtgatgctactgtaatgtaataaattattaaatggttgcaaagtgctg

SEQ ID NO: 460968 - DNA, 1492 bp, Homo sapiens
gctggtgctgctgtgagggttgcctgctgacagctcacaactgccctcccctctccagaaaattgtccttggctgataagacctaactgacccagttatgcaccatgacctgcatccagaggacagatcacagccaccaactgaccgattctatccaaaaggccagcctggagagccctcccactgtctactactcaacaggatattcttcaaggaaaatgaaccccacactaggcctggccatttttctggctgttctcctcacggtgaaaggtcttctaaagccgagcttctcaccaaggaattataaagctttgagcgaggtccaaggatggaagcaaaggatggcagccaaggagcttgcaaggcagaacatggacttaggctttaagctgctcaagaagctggccttttacaaccctggcaggaacatcttcctatcccccttgagcatctctacagctttctccatgctgtgcctgggtgcccaggacagcaccctggacgagatcaagcaggggttcaacttcagaaagatgccagaaaaagatcttcatgagggcttccattacatcatccacgagctgacccagaagacccaggacctcaaactgagcattgggaacacgctgttcattgaccagaggctgcagccacagcgtaagtttttggaagatgccaagaacttttacagtgccgaaaccatccttaccaactttcagaatttggaaatggctcagaagcagatcaatgactttatcagtcaaaaaacccatgggaaaattaacaacctgatcgagaatatagaccccggcactgtgatgcttcttgcaaattatattttctttcgagccaggtggaaacatgagtttgatccaaatgtaactaaagaggaagatttctttctggagaaaaacagttcagtcaaggtgcccatgatgttccgtagtggcatataccaagttggctatgacgataagctctcttgcaccatcctggaaataccctaccagaaaaatatcacagccatcttcatccttcctgatgagggcaagctgaagcacttggagaagggattgcaggtggacactttctccagatggaaaacattactgtcacgcagggtcgtagacgtgtctgtacccagactccacatgacgggcaccttcgacctgaagaagactctctcctacataggtgtctccaaaatctttgaggaacatggtgatctcaccaagatcgcccctcatcgcagcctgaaagtgggcgaggctgtgcacaaggctgagctgaagatggatgagaggggtacggaaggggccgctggcaccggagcacagactctgcccatggagacaccactcgtcgtcaagatagacaaaccctatctgctgctgatttacagcgagaaaataccttccgtgctcttcctgggaaagattgttaaccctattggaaaataaaggagaattcctgcttgccacagaccccg

SEQ ID NO: 460969 - DNA, 1356 bp, Homo sapiens
cagaagtgtgctgataaattagcttagtcctgattggtaatcatggccgatttcacgctgccgataagagaaaggtttggggacttccagattgcttcagtttacacaattctaattttctggccggtatcagaccatttttctttcatttggcagagaagagagaagggtatgagttgccaggtagtggatgcagatggaagcgctggctcgcaccagaagctgacactgaaggtttattttaatgtagcacaaatcagagcgaacgacgtgaaaagagttctgtttctcctggaaggatgccacttgtttctactccaggggaaatgtcttccaagctctttaccaaatctgcaagctgaaccaactcaactgtggctgccttgcccacctgaagacctcaggatccaccagcagcccaagacacctcggaagctgtttcaaggacaagcgtcgcctgcacacgtcagcacaaatgggaacatgatgagtgatgctgcctggagttaaaggaggccaggagcaccagaagctggaggaggccggggtggattctcgcctggaggcttcagtgggagcacgagctcccgacacttcggttccatctcttgtttaaaggcacccagtttctcatcatttgttacagcaccatggaaaacccacacacaagtgaagccccgacccacctcccaagtgcccatctgagcacccctcgtggactctgagcagggggttgccatcaccaactccaagtcttgcagcccctcttcccttcagtctggctgccaccttcttcattgccctggaaaaaaataatgaagtttcaccatttaaagggtttcagtgcagcttgctatgggaacactggagagtaacacaaatggccaattgtcctaatagccaccatggattggatggatgctaacaacaggctcacagttctccttctgttgcctccttttatccacatgagaatcaaacaaaaccacggtcagtgaccaaggccctgcttagaactttctgaaggttgcagctggccttctacctggagttttgacttcctttccgagaaaggaacttgaatggcaatcacaagaaagttgagaacttctctttcatattttaagcattcatttttttttatatttattttaatttacaaatactaattgtatatatgtataaggtaagatatgatagtttgatatggctaccttgtaataaaatgagcctcattaccaagtctggcacttcacatgtgtatttttttgtttggtaaaacattgaaaatctatccttttagcaattttgaaatgtacaatgcatttttaaaaattatagtcatcattctgtgca

SEQ ID NO: 460970 - DNA, 1497 bp, Homo sapiens
cagaagtgtgctgataaattagcttagtcctgattggtaatcatggccgatttcacgctgccgataagagaaaggtttggggacttccagattgcttcagtttacacaattctaattttctggccggtatcagaccatttttctttcatttggcagagaagagagaagggtatgagttgccaggtagtggatgcagatggaagcgctggctcgcaccagaagctgacactgaaggtttattttaatgtagcacaaatcagagcgaacgacgtgaaaagagttctgtttctcctggaaggatgccacttgtttctactccaggggaaatgtcttccaagctctttaccaaatctgcaagctgaaccaactcaactgtggctgccttgcccacctgaagacctcaggatccaccagcagcccaagacacctcggaagctgtttcaaggacaagcgtcgcctgcacacgtcagcacaaatgggaacatgatgagtgatgctgcctggagttaaaggaggccaggagcaccagaagctggaggaggccggggtggattctcgcctggaggcttcagtgggagcacgagctcccgacacttcggttccatctcttgtttaaaggcacccagtttctcatcatttgttacagcaccatggaaaacccacacacaagtgaagccccgacccacctcccaagtgcccatctgagcacccctcgtggactctgagcagggggttgccatcaccaactccaagtcttgcagcccctcttcccttcagtctggctgccaccttcttcattgccctggaaaaaaataatgaagtttcaccatttaaagggtttcagtgcagcttgctatgggaacactggagagtaacacaaatggccaattgtcctaatagccaccatggattggatggatgctaacaacaggctcacagttctccttctgttgcctccttttatccacatgagaatcaaacaagtaggtgctgctggtattactgtatttttctcattttaaagatcaggatggggagggttgaggaggttaaggaagttgttagaagttacactgaagttaagaaaggaaaaaggacttagaaacttattcttacaactgcagaaccacggtcagtgaccaaggccctgcttagaactttctgaaggttgcagctggccttctacctggagttttgacttcctttccgagaaaggaacttgaatggcaatcacaagaaagttgagaacttctctttcatattttaagcattcatttttttttatatttattttaatttacaaatactaattgtatatatgtataaggtaagatatgatagtttgatatggctaccttgtaataaaatgagcctcattaccaagtctggcacttcacatgtgtatttttttgtttggtaaaacattgaaaatctatccttttagcaattttgaaatgtacaatgcatttttaaaaattatagtcatcattctgtgca

SEQ ID NO: 460971 - DNA, 1219 bp, Homo sapiens
ctcccccaccaccttcggggaggcgttggctcgagacctccagaagtttcccaccggagacctaggctgcgcattgctccgctaggttgatgagcttttgctgggacaccccacagcagtcgggtgcgccaagggaagggattgccctacgctgacacctggaggactgtgggtataagttgtccaagaaaaaagctcagatctgccgacagcaggaaaacgttactgctaatgtcacagggcgtgtagaccctgttataaaattcctaatatcccagcgggagttcactactaattgcacaatgcgtgtagaccctttgatattattcgtattgtcctgaagagatgttactactgacgtcccaatgcagcctttttcgacccacactgcaaaaggaatggaacagataagaaggtattgagattagaacgtgctgccgtgcggccgccgcaggacacttttcatatccctgtttctcggactgtagatgaaggggttcatcatgggggtgaccactgcgtacatcactgaggccactgcagtctttctcggggaagatgacacatctgaactgaggagtatgtctgtcttccatgcctccaaaaatggcaaagagagacatctgagtcaggcagcctgcataggagatgactctgctgtgagattggatgtccacagtcatcttggggactgtggtggaggtgaaactgatgtcaggcaaggacaggttggagaggaagaagtacatgggggtgtggaggtgggagtcagggctgatggccaggatgatgagcaggttccccagcgccatgaccaggcacgtggacaggaacagcccagaaagccaggaacaggggcaagggagagatgcatcccgaatgatcctgtgccaattctttctggaatctttgatgtgatctccgctgccctttccatacttgacacagtgattgtggcacccactggtctagctgtggtctacaaggaacccccaaagggaagggcacagtgagcaggggcatcggcctgagtgacaaggattggagggggcagaagtgaggatatgaaatatttgtcattctgtgcctggcttatttcatttaatatacagacctgcaatctcatccattttgtctgcagcggagaggattttcttcctttttaggctgaataatacttcattgtgtgtgtataccacagttactcaattgaaacaaa

SEQ ID NO: 460972 - DNA, 2334 bp, Homo sapiens
cagtcctccgcgagccgacactggaggcagcagcagcggcggctgcagcggccccgactcgaagcaccgcactctccccgcgccgcccgccccgacggcatggcccgcggccggcgctccgggcgcccccaaccccgctgagagccgccgcggccccggacccgcgcaagggcccccgagccgccgggatgagccgcgccgagtggtgatcgccgctcgggaatgcgggcgtgaagggtccgagttgccgcccagcggggaggagaccccaggacgccggaaatcaccatcccaaagctgcaagaaggggggagaaagcattcttcattcagttgtgtgccttgtgggggatttttaaaaagtcgtttttttttttaaagaaacatttccgtgctactgtctgtcatcgtctctggggaaatcagccagaaccaccggaacgtaactgaaaccagacaagagaggcaggagcccaggcagtacctgcagcgtccgggcaccagagccaccttggaacaggaacgcgtctccggccgcggggctgcggctccgccaaactttggggcgggcggggcgggctggggcgcccagggggctctgtagaccgagggcggccccctaaccatgatgtttcgcgaccaggtcggggtgctggcgggctggtttaagggctggaacgagtgcgagcagactgttgcgctgctgtcgctgctcaagcgcgtgagccagacccaggcccgcttcctccagctctgcctggagcactcgctggccgactgcgccgagctgcacgtcctcgaacgcgaggccaacagccccggtaagtgtgcggcggccgccgccgccgtcccgcctgcccaacccccgctcctccctccgcttctctgcctcgggccaggccgaggccagtccctgccagccgcgccgggacctggacggcgtggccccgaggccctcggaatccaccccctccgggtgtccccccactaccgccccccacctacttacctccgccggccgctttgggattttgcccactgtgaactccgtcagccctttccgtgtggtagctacggtagcatgaatgattgatttttctctcatgcagtttcctgggaaataacaacacatgatagatgcccgggactgcccttcagaagccaagcttggataaggctgtgagagcagtttggaaatctgtgaccaagggcagtggtctttctcaggctctgagaaaagacattggtcgacaaagctatggccagcagatctgggatcagaatctgactctcctcactgttattcagtccttgaacagagcagatatgtttgtgcgaggacaaagaagatgcctcaaagacaaagaagaagatgcctcgtcgtcccctgagctcccacacggcatctgcacatcaccagctcagcatttagcacactggattgacactgccatgttagcaacagcaataacaagaatgagcatattccctctttcccccaccagtggccttcacagcttgacagagcgcttcattctgctgaatgagcaacactcaggacaccagtggccttccgagtgggcagaaattccttgggcagctccagatcccagcaaaccacttaatcagcctttacataaaaatcgtagcctagagaaggcatttgaggaaactcttccttatgctagccttttcccctccattgtggcctctggaatcaaaggtgggaggactgaggccgaagactgctctgtgtcccttcctggggctgcatgtgaagtgacaggcgctttgcccggacggtctaggtggtgctgcttggagactccgccggccttcatgagcatcactgccatgtcacagaggggtctgcaccaaggaagggaattgaataatggcatggatgaagaatatttactgcagcagtataactctgcatcagatgaaattgctgatgctctgaaagtcaagcatgagactattggggaagcagctatggaaataggccttcagccttcagctgattgggtaaggcccacccacattatggatggcaccctgctttactcaggccactgatataaatgttaatctcatcccaaaacacccatataaaaacgttcagaataacatatggccaaatatctgggcacctcatagctcagtaaagttgacacataaaactaacaatcacacagcactaacaaatgatgctgtcctcctctgcctctgctaattagtttgaagatgaagaacattctcagggtcttcattttcctataggttttgtggctcaagtctgttattgagctcattccttttcatgtgaaggtat

SEQ ID NO: 460973 - DNA, 2522 bp, Homo sapiens
cgaagtccagggcaacatagcacagcttctctgtgatgtcacgcacgatttcccgctcggccatggtggtgaacctatagccacgctcggtgaggatcttcatgaggtagtcagtcagttcccggccagccaggtctaggcgcagggtggcatgggggagggcattcccctcatagatgggcacagtgtgggtgaccccgtcaccagagtccatcacaatgccagtagtacggccagaggtgtacaaggacagcacggcttggatggccacgtacatggctggggatggggtgctcctcgggagccacacgcagctcattgtagaaggtgtggtgccagatcttctccatgtcgtcccagttggtgatgatgccgtgctccatggggtacttcagggtcaggatgcctctcttgctctgggcctcattgcccacataggactccatctgacgcatgccccccatcatgttctggtgcctggggcaccccacgatggaagggaagacagcccggggggcatcgtcacctgcaaagccggccttgcacatgccagagccgttgtcaatgacgagcacggcagtatcatcatccatgctggctctgatgtttcattacgtctagttccagtcttagcatgacaatttcttcctgcaacgtactattttcatgcaagaggtctttttctttcttataactaagagaaagctaaaaaggggattttaagtaaaaaactgaagtaatggaaacagtaagctagaagaatatctggggaaaaagcattccagacacggggaactgctaagtgcagaggtgtgactggagtttttaagcactagagatagatcagtgataacattagaaactcattggagcacgaaccctgttgtgaactgcctatccgaaggatctaggttgtgtgcttcgtatgagaatctaatgccagatgatctatcattgtctcactttgcccccagataagaccatctagttgcagaaaaataagctcagagcttccactgattctacattatggatatgtgccgccgaagcaagcacaaagccctacttttacacatgcctagtgatgcttcatggacaaggcttggctctgttgagtccaactaacctacctgagattctgagatttctcttcaatggcttcctgtgagctagagtttgaaaatatcttaaaatcttgagctagagatggaagtagcttggacgattttcattatcatgtaaatcgggtcactcaaggggccaaccacagctgggagccactgctcaggggaaggttcatatgggactttctactgcccaaggttctatacaggatataaaggtgcctcacagtatagatctggtagcaaagaagaagaaacaaacactgatctctttctgccacccctctgaccctttggaactcctctgaccctttaggacaagcctacctaatatctgctagagaaaagaccaacaacggcctcaaaggatctcttaccatgaaggtctcagctaattcttggctaagatgtgggttccacattaggttctgaatatggggggaagggtcaatttgctcattttgtgtgtggataaagtcaggatgcccaggggccagagcagggggctgctgctttgggaacaatggctgagcatataaccataggtatgggaacaaaaaacatcaaagtcactgtatcaattgccatgaagacttgagggacctgaatctaccgattcatcttaaggcagcaggaccagtttgagtggcaacaatgcagcagcagaatcaatggaaacaacagaatgattgcaatgtccttttttttctcctccttctgacttgataaaagggaccgtcttccttggatttagtgaacccctttggttcctgaaaaattcaaggagtatctaggacatagtccccagaagacagtacaagactttctgataaactggacatttcaagacccaaataactaatcagaaaaatcaaagatgtgatactattttttatcccatgcataggtgctacacttggatcaaatgaacaatgttgggatctctatggataaaggtcttaaaagtcctgagataaagaatcctgcacccactggtacttctaacttgtcttgttttttgtctgatttctggctgatgcaggggactaactcactgccacgcgaaaactacctgaactgaactatgacatctcacctgatatgtaagatgtaactgttataattattttaaacctcaatttagcattaactagccttttaatgtaaacacttacacattatgatgactagaaacagcatactctctggccgtctgtccagatagatcttgagaagatacatcaatgttttgctcaagtagaaggctgactatacttgccgatccacaacatacagcaagtatgagagcagttctaaaatgacagagataggaacagtaataaagttattttaaaagctaatttgatatactttaccaatttaacatcttgcctgtcc

SEQ ID NO: 460974 - DNA, 2116 bp, Homo sapiens
cgaagtccagggcaacatagcacagcttctctgtgatgtcacgcacgatttcccgctcggccatggtggtgaacctatagccacgctcggtgaggatcttcatgaggtagtcagtcagttcccggccagccaggtctaggcgcagggtggcatgggggagggcattcccctcatagatgggcacagtgtgggtgaccccgtcaccagagtccatcacaatgccagtagtacggccagaggtgtacaaggacagcacggcttggatggccacgtacatggctggggatggggtgctcctcgggagccacacgcagctcattgtagaaggtgtggtgccagatcttctccatgtcgtcccagttggtgatgatgccgtgctccatggggtacttcagggtcaggatgcctctcttgctctgggcctcattgcccacataggactccatctgacgcatgccccccatcatgttctggtgcctggggcaccccacgatggaagggaagacagcccggggggcatcgtcacctgcaaagccggccttgcacatgccagagccgttgtcaatgacgagcacggcagtatcatcatccatgctggctctgatgtttcattacgtctagttccagtcttagcatgacaatttcttcctgcaacgtactattttcatgcaagaggtctttttctttcttataactaagagaaagctaaaaaggggattttaagtaaaaaactgaagtaatggaaacagtaagctagaagaatatctggggaaaaagcattccagacacggggaactgctaagtgcagaggtgtgactggagtttttaagcactagagatagatcagtgataacattagaaactcattggagcacgaaccctgttgtgaactgcctatccgaaggatctaggttgtgtgcttcgtatgagaatctaatgccagatgatctatcattgtctcactttgcccccagataagaccatctagttgcagaaaaataagctcagagcttccactgattctacattatggatatgtgccgccgaagcaagcacaaagccctacttttacacatgcctagtgatgcttcatggacaaggcttggctctgttgagtccaactaacctacctgagattctgagatttctcttcaatggcttcctgtgagctagagtttgaaaatatcttaaaatcttgagctagagatggaagtagcttggacgattttcattatcatgtaaatcgggtcactcaaggggccaaccacagctgggagccactgctcaggggaaggttcatatgggactttctactgcccaaggttctatacaggatataaaggtgcctcacagtatagatctggtagcaaagaagaagaaacaaacactgatctctttctgccacccctctgaccctttggaactcctctgaccctttaggacaagcctacctaatatctgctagagaaaagaccaacaacggcctcaaaggatctcttaccatgaaggtctcagctaattcttggctaagatgtgggttccacattaggttctgaatatggggggaagggtcaatttgctcattttgtgtgtggataaagtcaggatgcccaggggccagagcagggggctgctgctttgggaacaatggctgagcatataaccataggtatgggaacaaaaaacatcaaagtcactgtatcaattgccatgaagacttgagggacctgaatctaccgattcatcttaaggcagcaggaccagtttgagtggcaacaatgcagcagcagaatcaatggaaacaacagaatgattgcaatgtccttttttttctcctccttctgacttgataaaagggaccgtcttccttggatttagtgaacccctttggttcctgaaaaattcaaggagtatctaggacatagtccccagaagacagtacaagactttctgataaactggacatttcaagacccaaataactaatcagaaaaatcaaagatgtgatactattttttatcccatgcataggtgctacacttggatcaaatgaacaatgttgggatctctatggataaaggtcttaaaagtcctgagataaagaatcctgcaccca

SEQ ID NO: 460975 - DNA, 1365 bp, Homo sapiens
cagccatctgaggtactttcaaagcattggtgtgcaggccccctgcactgatcctgagtggccacctagaccagggtgtccagaggctcgactatagggttccttcttctccaccatggcacttcaggctcccttggcacttctcttttgggaaaataaattgcttctggattagacatctttctgttgctgttgcttgagacagggtctcactctgtcacccaggctggagtgcaatggcacaatcatgattcactgcagcctcgacttactggactcaagtgatcttcccgccgcagcccccgaggtagctgggactacagggtcttactctgtcacccaggctggagtgcagtggcataatcttggctcactgcagccccaacatccccggctcaagcaatcctcccgcctcagcctcctaagtagctgggaccacagaaacccaaactgcagaacatgttcagtgaagcaaccagagctaaatcatttgaaatgcattagccagtactcgccgcaaattaatttaacaccagtcacatgtgtctgggtgattttcccctgaaaggtggcgtgagttgattggaccccaggaggaacgctgcgctgaatggctcaagatttactactaaccacacactgcacagagaaggctgcgtgttaccaaggcctccatggaattagggggaactgccaacaaaccagtgcagagcctgcaaatgtcagatagaaggaggatgagacatgatttggatatttttccaagaaggaaagactcagttcatttagaagagtttccttaaggataaaggaagtatccagaacctactctaagaaagggaaatggcttcatgctttcctctcccattcccatacctgcaggaaaatcagatttcctcatggtcctgctgacctgtgagcccctttgggctgctgatggacctgtgctcccaccctggctcaaaaagcaaagaaaagggagtggctatcagaaaatggaagaagagagtaaagaagacagtgctggcttgagagaagcagtggcttcagaacagtgcagcagagagaactcgagaggaattcagccagggtggtcagagaggagtttggctgctggacagcccactccaagggaagatcatcttcctactccatctcccctccttccagctccctatccatcctgccgagagccacctccaccgtgcattaaaacctcgcattcatccttcaagcctgtgtgtgacccgatgcttccgggacgctgggcaagagctcaggatacagaaagctgtcacactggccctctgcccttgagaaaaggcagagggtccattgagctgtttaacacttaaagccatctgc

SEQ ID NO: 460976 - DNA, 775 bp, Homo sapiens
atcccagttctttcatgttacaaaattcacaaaatggctgtgtgtacatgaattttggtggaaacagtgaagaaactgagcttcatgctgacattgacacagatggtctggaagacatcctgggaattgtctggaaaggaggcattggacctctagctgtgatgagatataggaataaggagtggtgggctaagtgtgcatctagtatgcaaaatagagagaacagtaagtgtgatgagaataagaagataagaattgaaagagaatcgaaaggcagtgacttcatcacggtaagacattgtttaatcccttgttcatgtgctacctacagagatcccagaccaccacccatgatcccaggctggaggaagcagcaggctagcggaattcaggaccaatgagccaggaaagaggacccaatgcagagctcacatcccaccctccttcccccatgacaaagcactggcaaaccctgccaaagaagaagcttggctgcaaagcagtctggaactggacccgggatagattcaccaggagctcaccaccacagggaatgctgcactttgactggacagaatgcatcctccatgcccacagagcatgtgcccaggatgaatctcactgtatcccagttcctcatgcttggccccaaacctctttttcacagtaataaagaaaacacactttacaaaaaggcagttcatctatgaacatattggctaggataacacatcttagagctaaatgtgtcactgtaaatggactcattttatat

SEQ ID NO: 460977 - DNA, 4127 bp, Homo sapiens
  misc_feature (1)..(1): n is a, c, g, or t
  misc_feature (5)..(5): n is a, c, g, or t
ntccngcaggtggagctgaagagccaagagtctcagagtctgcagcagcagcaagactagtacctgggtcacctgcagcagtacatggccacctatcagcagctgacctctgagaaggaggcgctgcacaggcagttactgctgcagacccagttcgtggaccagctgcagcagcaggaagcttggggcaaagcggagcacctagaagctgccagccaccagaaccaacagctagagacccagctaagcctcgtggctctccctggagaaggagatggaggacaacatctggacagtgaggaggaggaggcgcctcggcccacgccaaacatcccagaggacctggagagccgggaggccacggagccagaggcagaggccccagccccagggactgggggtgagtttgtgtgtggggagagctaccgggccctgaaggaggccatggtgaagctgaaagggagagagtccttcaccgtatatgaaagccagggggcagtgccaaacacgcggcaccaggagatggaggatgtcatcaggctggcccagaaggaggaggagatgaagcacccctcccttcaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgttttttatgaagtgagcctggacaacaacgtggagcctgcaccaggagcggccagggagggttctccccatgacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctattacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgtactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacgagtatatgtcccagtacacaaaagggcactggttggcattcttcttaaggtatttagtgaagatcataagaaatcctttaagagtttaaatgtccctggaagaggcatacaggctctagtcaagaatgaattcgagtgaaggaaagctgtgtgacacctggccttcctctatgttcatggagcttctttgaggctagaagattgattttatcatctagacctctctggctaatacctattcttcagccacattagttactctgacataggaatttacttcttttctttgaatggaaaacactttaaaaataataacaaccattattataaaccaatatatgtgagagtacttagttgaaacaaaaaggagttttagtagacagtattatactacacatgaaaatcaaggcgaagtttatgcaacttaaaatgtttacaagctgcagtgcaatctaatgtttgtgaatgtccaagtattatgagaaaaagtgtctatacaatgacagacttatgtttcctcacaaagttcttcacaaagagtgaaatatgtttttatacctctcagtttcagttagaggcatattttgtgccatatttatgttaatgtgcctatacgtgatgagtgaattatttcagtcatacattgcctaaatcataactttaagatgcttgggaaagaatcaacagctaaaagttcatgaagttctaatgtctgtgttccaaaatacgtcacagtattaggatgcagggagagatgtgtgtgcgctccctggggtgggcatttctagttactagaccatctccatttttagcatttggcatcctcatgatacttttatacatatgacattaataggagagcaataatacgattttacagatggaataacagatgtgcctgcattcagtgaaagagtgcaaatattaagtccttgtgacttcaactgactcttccaaattgtatgaatttatcaatgtattagataaactcagttccagaattataaagaaaaactgttagaccaacgaatgtggctaattaacagtaggacgatttctagcccgagggtttaaaatggacttcaagtcctgttcttgccttttattttctgaacttgccacttttgcattctttgagttcagtttaaagacagtttgagtccaatttagaccctcgggctagaaatcataccactgttaattagccaccttatttggtctaacagtttttctttataattctgaaactgggtttacctaatacattgataaattatttcaaaggtatttttatagttcaaatcacttcacttttaccctgataaatataaatgactaggaatgatcttcagctagcctttagcacctgcaaccaatctgacaataatgtgttcatcaggtacctgtggattaaatcacacaccggcatatttaagctgaatgtcagtctggaaaatgaatgtactatattaactgaaataccactctttgtgtaggtattctgtcatatatttaagaaaaattaaatagcatgtaaatcatatgacaacaacttaagtctttcttcaaagtgcatgtggtcctttgcaatacctcattcagccaagtatttgttctcttcctcattcagtttaaggcagctttcaatttgcttagaaggcaacattagaagggtagagtttaatcagaaacatagaattttaaagtgtgggttcaactgaataaatttgaatttctgtaggaagtaaagaattaaaaatctatttaaagattgcaatatataatcatttttaaagtatttgtttaacctgatgggttttccagaaatgaaaacaagtcagttctaaaaccaaagctgatatttagaaaatgtgaaaatataaatcagccctatccataatatagtttctctaaaactttatcttaaagagtcattttaaaagaatataactattcaaaaatgtaactgctatcttaatgttttgaaataagttaaaacactttaaaatatgaatactgtagtttgaaagaaagaaactgggggaaggaaaagtagagaaagaaatgccaattccaatgcaaggctttatttgccaagttttcttagaatgacttttaccagtttatgaattcttgtaaacagaatgtataatagaaatactgaaacactgttgcctaaagtggcattgttgactgctactgtgatgctactgtaatgtaataaattattaaattgttgcaaagtgctgtt

SEQ ID NO: 460978 - DNA, 666 bp, Homo sapiens
ggtgcatagacatgatttgtgattatttatgtctttttgatgaaatgactccttatcattatgaaatgacatttttcatcccagatctgcctcccagcatctctcgaatcagcccatgcctctccttcaccgttgccgctgcaccagttcaagccaccttgactcttgctgggaaaacacagcagcccctcacctggtcccacgtggctgagcatctcctccaattgacagctgaatctcatcaggctgccattccacccagatcccttctgtggggcccactacatgtagtaaattacagtgccagagaagatggcaagatgcagagaggaggagtcacgcctgaagccacacagctgacatcagagccaaagcatgagcctcagtctctctgacccagagctaccacccttgctgccttgggaagaaggaagccccctcctattctatccttgagctgccttggcaaggaggggccccttgctgccgccatcctcacaggacaccatccacatgaggggatgaatctcagttgcactcagttgttgcccccctcgaacctcccttgagcctcaggagaaaccaccctgattcagaggtccagagaagacctgactagcccaaggtaattccgtccccttgccagagtggcttgggcagggacac

SEQ ID NO: 460979 - DNA, 1065 bp, Homo sapiens
agtcacaggcctcatccagctcccatgcaaactgaagggccagtctcactcccaccatgccccaccctaacagccccaagtctgtttccaggcagaggacaagaggggcttgaaaacttgcccaaggctatccgtctcccagctgcgaaagaaaagggctttagttctccctctgcctgtgaagtctgcaggcctggtttgcaccctcctcttagttttgaccaggagacttctcactttgttataaattgtcatgaagttcaggagagaattttttctccctgtggagttttatcccctgctcctctggccaccctcctgaaggatccctgcagtgctaggcaggaatggggtgcttggggacccagcgagctcccagggtgtttctgctgcttcctctcccctgtatttctcttggctctctaatttgactcagttccagtgaataagtctcatgagatctgatggtttttataaaggggagtttccctgcacaagctcttttctcttgtctgtcaccatgtgagacatggctttcaccttccatcatgattgtgaggcctccccagccacatagaattgtgtcatgagagccacccttcccaaagtagcacttgtgagcagaggtgatcagagggctttctgaagagtgaggagtgacttcagagggccaaaaagaagaaaagggagtgagacagtcgttaagactcctaatcccggcttatttttactgcttctcaacacagcattgcaagtggctgatttgatggatgtggcacgtgaccaagttctggctaatgagatgtctgaaacttaaagtggaagagatgtatcatctccttttccttgctccatcctgctacctgaaaaatggatgtggtgacaagccctggaaaaccacaaggatgagaacagcactggagagatggtgcagcgcatgatgcaattgcctaggtatctgatggctgagtagaatttctctcctccgacttttacatgggaaggaaataaaactctattttgtttgaaactctgttattttaggtcaatgttttaagtagctgt

SEQ ID NO: 460980 - DNA, 1310 bp, Homo sapiens
gggagtggaaccttgaaggtgatgagaagtaagtttacgaaggaatgcacaaggagactggaacctactgaacgacctcttcagatcgtttatgattacttatccaggctgggatttgatgatcctgtgcgcatacaggaggaggctacaaatcctgacctcggctgtatgattcgattttatggtgaaaaaccatgccacatggatcgtttggatcgaatcctattgtctggcatctataatgtacgcaagggaaagacccagctgcataagtgggctgagcgcctagttgtcctctgtggtacctgccttatcgtttcctcagtgaaggattgtcaaactggaaagatgcacattttgcctctggttggtggaaagatagaagaagtgaagcgacggcaatactcccttgctttcagctcagcaggagcccaagctcagacctatcatgtcagcttcgagactttggccgagtaccagcgatggcaacggcaagcatccaaggtggtgtcccagcgaatcagtaccgtggatctctcgtgttacagcctcgaggaggttcctgagcatctcttctatagtcaagatattacctacctcaacttgcgacacaacttcatgcagttagaaagacccggaggcctcgatacactctacaaattttctcaactgaagggcctgaacttgtcccataataaacttgggttgtttcctatattgttatgcgagatctctaccctgactgagctcaacctttcctgtaatggatttcatgacctaccaagtcaaattggcaatctgctaaatcttcaaaccctctgtcttgatggcaactttctgactactttacctgaagaattgggaaatctacaacagctttcctccttgggaatttccttcaacaactttagtcaaattcctgaggtttatgagaaactcactatgttagatagagtggttatggcaggaaattgcctggaagtcctgaacttaggggtgctgaataggatgaaccatatcaagcatgtggatttaaggatgaaccatttgaaaaccatggttattgaaaatctggagggaaataaacacatcacccacgtggatctgcgggacaaccgactgactgacttggatcttagctccttatgcagcttggaacagctgcactgtgggcggaatcagctgagggagctaacactcagtggcttttcccttcggaccctctatgccagttccaacagtgagagcagtgaacgtctatccagtacccagcctgtcactttcttggatctctcccgaaactgctagag

SEQ ID NO: 460981 - DNA, 1366 bp, Homo sapiens
gggagtggaaccttgaaggtgatgagaagtaagtttacgaaggaatgcacaaggagactggaacctactgaacgacctcttcagatcgtttatgattacttatccaggctgggatttgatgatcctgtgcgcatacaggaggaggctacaaatcctgacctcggctgtatgattcgattttatggtgaaaaaccatgccacatggatcgtttggatcgaatcctattgtctggcatctataatgtacgcaagggaaagacccagctgcataagtgggctgagcgcctagttgtcctctgtggtacctgccttatcgtttcctcagtgaaggattgtcaaactggaaagatgcacattttgcctctggttggtggaaagatagaagaagtgaagcgacggcaatactcccttgctttcagctcagcaggagcccaagctcagacctatcatgtcagcttcgagactttggccgagtaccagcgatggcaacggcaagcatccaaggtggtgtcccagcgaatcagtaccgtggatctctcgtgttacagcctcgaggaggttcctgagcatctcttctatagtcaagatattacctacctcaacttgcgacacaacttcatgcagttagaaagacccggaggcctcgatacactctacaaattttctcaactgaagggcctgaacttgtcccataataaacttgggttgtttcctatattgttatgcgagatctctaccctgactgagctcaacctttcctgtaatggatttcatgacctaccaagtcaaattggcaatctgctaaatcttcaaaccctctgtcttgatggcaactttctgactactttacctgaagaattgggaaatctacaacagctttcctccttgggaatttccttcaacaactttagtcaaattcctgaggtttatgagaaactcactatgttagatagagtggttatggcaggaaattgcctggaagtcctgaacttaggggtgctgaataggatgaaccatatcaagcatgtggatttaaggtaaggttattctttaccacaccttcctttaaattgactctggtggacctttatgtcttctgtttatgaagatttgtttaaaacattagggtttttaaaattttgttgttgttttgagacaaggtctcactttgtcacccaagctggcatacagtggcacgatctcggcccactgcagtcttgacctcccgttctcaggcgattctcccacctcagcctcccgagtagttgggacttcaggtgcgcaccacgaggcctggctaatttttttctacttttagtagagatgaggtttcaccatgttgtgcaggcaggtctcgaactcctgg

SEQ ID NO: 460982 - DNA, 2127 bp, Homo sapiens
gacaccagtcctgttccaagtgtgctgtccaccggcaggcgagtcgaggcacgttctcacactgtggcagagccgagcgagcaagccccgtttgccagcacttttcagacctctgcttgtatcccacttgctgacatcacttggccaaagcaagttacatgactgacgctgggtcaaaaaaaaagaaggccctgcaaggggactcgtgatggacgtagattcagggagggaattttccatccactgcccctaccctgatctttggctgtcagttcccccttgcccgaaccgtattcagagccgacccaatctcccctccccactgtataagcccgtcgcagcagtccctgtagctatcctgatggtcctgaatagcctgtgggacaccaggatttgttgtaagacgctgtcctgcatcctctcccacccacctctgttggcagtgccctggagtcacgtgacaaccgaaagcgccccccacaaaggtctgaatgctccctgggtggcagtgcccactggcaagcccgtttgtgccctgctccgcactgggggcctggcagagaagaggggctggagcccagtggggtttaccagcatcttcaccaagcgctgtgcccaggaatgaggtgctgttcctggccgcacgtctgggggacgctgccttcgaatccactcacaggctccggatcaggctgccaatctgtaaatgatgttttaggtttttctttgttgttgttttggtgctgtgaagcctgccttgttaacaccaggtgctgaaagattaaaacttatcaatcaccatcatcaagaggaaccaggatatcacttagtggtgactgctttgtgtattactttggatagtaaaagtacctgatatggtttggctgtgtccacaccaaaatctcatcttgaattgtaactcccacaattcccacatgtcatgggaggaacccagtgggaggtgattgaatcatggaggcaggtctttcccatgctactcttgtgataatgactacatctcacgagatctgattatataagggggagttgccgggcacaagttctcttctcttgtctgctgccatgtgagacatacctttcaccttccgccatgattgtgaggcctctccagccacgtggaactcaggtttcagtccttgaggagcgctcactaggatggtaattgtttgatcgatagattaagtgagttggaagactctccaagtgaaaatttaaaattactgcagttttggcctgatgatgttaaccagcaagaacagaatctgaaaccagatgagctgttagtactgctttcatctgttttacagccacagcgacagcagttccctggcttctggaaggagtgtcggtctatccaaaaaatgtactaacagatatgtaaagtctgtcatccatttgcagcaaattttgcctacggtatgaaataggagttcaatttgacattgaatattgatatcttagcaatattatctcccaatctgtgaacacgaaatttctttatatttattcaaattatctttggtttttaatgatgttaaatccaagtattctttgtgatgctgttgtaaatggaattttttgtgttgttcattgctaatgtataaaaaccaatgatgtttgtatattaatcttgtatcctgcaacctcattgaactagtttattagctctagtaatatgttggtgtgaatcccttaatattttctacatacaagatcatgtcatctgcaaattgttttacttcttcctttccaatttggatgctttttatttcatcttgcctactgctttggctacaacctccagtacaagattgaatagaagtgatgagacagaacatccttgtcttatttgtgatctctgggggggaaggcttacagtattttgcatcaacatatcagctacgggtttttcatagatgtcctttctcaggatgaaaaagtccatgtttggctttttgaatgttttcatctaagagttttggattttgccaaatgttaaatgcttcttctgtatgcattgagatgatcttgttgtttttgtcctttattctaataatatggtgtactacattgatttctgtatgttgaagtttgtattcctaagat

SEQ ID NO: 460983 - DNA, 1277 bp, Homo sapiens
tatctctggaacagtccccaaacgtcttgccaagggcacaggttttcagctttaaaggccatttcaatttaagaaaacaaaagatgatcctgtgaacactgtatcaggcatcattactggactgaaaaaaggatcacttgatggacatgcctggcgttttgtttagaagtatttcttctctggccttagaagattagttttcaaagcgatggtaaaatcattgatgtatgtcttttcaagaaaaagaaaaaaaaaagactcctaaatgccaaacatttgctctttggagcatagcaagaagaaagggagaggaccagacggccacatcctaagaacagagtattgtccaggtagctgtcgccccaaatgggatctctttccaggtctttttgttaaagcttttctttcctaaataaaacttaattttctctcgctaatctttccagtgggtgtctgccgcttcctcatgccttgctataagaaagctcgtaaaaaggaagaaatctaaaactagaacaattctatattcacagtttctctgacattaaaaagtactcaagagaagagttttttttttaatttaaagaaacatctgtccaacatggatgattttgaagaagagcactcccctttgtccagagccatagaaagataatttaattacacttatcattacaccctccccaaattagactacaaatggatcttgatttctcatgattttttcactttacaaaataatcttaaagtttaggaggaagaaaagatgcttaagaataatcaagaatgcttggaaaagaggaagaaaaagggaaatttctcctactgaaccggtagtgctgggaagggaagagcgtggtccctttaatgacagggaagtggggcagggaagtgctgggtagagaaaggcgaggtctctgtctagggctccacccccagggacctagaagacacaagcagctggtagtggagagcacacggcggaatgacgcagagttttactggagcaggccgccaaaggacccgactccaggggaaaaccatctcccttcttgctcccccatagcgagcgacagagtgcgcgcgagccagaccgcgacaccttgcaaaattaacaccccaacaacacccacaccccaacatccccacaacctcacaacacacacaccccatcacaccacacccatacacccctcaccaataaccctcaaccaacacaatcataccacacaaccacaccaccaatacaccccccactacacaaccacttaaccata

SEQ ID NO: 460984 - DNA, 1181 bp, Homo sapiens
tatctctggaacagtccccaaacgtcttgccaagggcacaggttttcagctttaaaggccatttcaatttaagaaaacaaaagatgatcctgtgaacactgtatcaggcatcattactggactgaaaaaaggatcacttgatggacatgcctggcgttttgtttagaagtatttcttctctggccttagaagattagttttcaaagcgatggtaaaatcattgatgtatgtcttttcaagaaaaagaaaaaaaaaagactcctaaatgccaaacatttgctctttggagcatagcaagaagaaagggagaggaccagacggccacatcctaagaacagagtattgtccagtgggtgtctgccgcttcctcatgccttgctataagaaagctcgtaaaaaggaagaaatctaaaactagaacaattctatattcacagtttctctgacattaaaaagtactcaagagaagagttttttttttaatttaaagaaacatctgtccaacatggatgattttgaagaagagcactcccctttgtccagagccatagaaagataatttaattacacttatcattacaccctccccaaattagactacaaatggatcttgatttctcatgattttttcactttacaaaataatcttaaagtttaggaggaagaaaagatgcttaagaataatcaagaatgcttggaaaagaggaagaaaaagggaaatttctcctactgaaccggtagtgctgggaagggaagagcgtggtccctttaatgacagggaagtggggcagggaagtgctgggtagagaaaggcgaggtctctgtctagggctccacccccagggacctagaagacacaagcagctggtagtggagagcacacggcggaatgacgcagagttttactggagcaggccgccaaaggacccgactccaggggaaaaccatctcccttcttgctcccccatagcgagcgacagagtgcgcgcgagccagaccgcgacaccttgcaaaattaacaccccaacaacacccacaccccaacatccccacaacctcacaacacacacaccccatcacaccacacccatacacccctcaccaataaccctcaaccaacacaatcataccacacaaccacaccaccaatacaccccccactacacaaccacttaaccata

SEQ ID NO: 460985 - DNA, 1645 bp, Homo sapiens
gctaggattgtgccactgcaccccagcctgggcaacagagtgagaccctgtctctaaaaaaataattttttttaaagataattcttcaaaggagatccgctcttcctttcctacacccattccctttcctccctttcctgaacaatgctgtcttacagcctctaggggcaggcagagccaaagaggcctctgccgggtgtggggagtgagacgcagcaggccagagcatgtatcagagctccagcaggtgggggagggtgtccacacgagaaggtggcctggcttggcatggcagaacctgataggattaggaaggcatcagccacgggaaggagatggcgagagagataagaaactgcttccaccagctattggtcaaataagtacacatttgaaagataacagccaggtttctcagtgtcagagaaaaccgagacacagctcgggaaagggagaaaatgtgggtggggagacccttgtggtgtcgaattggaactggaggtataggagtagactcaggattttcagaaagtgtttagatagacatagaaattagtatgggtgtgtatatgtgtatgtgcacgcagatgtgtgtaaatgtccatatattccctagctctggaaagccctggagcagtgccatcccaataacaaaaagctttttatggttttttgagatagggtctctccctcacccaggctggggtgcagtggtgcgaccacagcccactgcagcctcgacttcctgggctcaggtgatcctcctgtgtcagcctcccaagtagctgggactacaggcatatgccaccacacccagctaatttttaattttttttttttgtagggacgggtcttgctacgttgcccaggatggtcctgaactcctgggctcaagcaatcctcccacctcagtctcccaaagtgctgggactacaggtgtaacagttttaaggtaatcagaatcaagaaatgattgaggtgatgctctggaataatggggactagagagtcgtgacaactaaatgcaatgtgtggtgtggtagcatttttctgggctgtagtccctagatgggtagagaagaaagccccggagagggtgaagaggtggggatgtggaagacgtcagagagagcacagggcagagcgcagagaactgcatccacaggcctcgccatgcccccagcatggctgcaccacaccagcagatgccttcgcttcccagcagtggacacaggtcactggatcctcacaaatgagcagccaggagaatgtttgcagcctggagattcggggctttgtcagcaccttgggaaggttttgttcttgggttttgggtttttggtttttggatttttttggtaacaatatcgctatatttattctcctgcagtacacttttaaattgcttcaacattttccccttaaaataaaaaagaacaacaacaaaaaaattccaaaccttagaattgaaatatttggccttttctctctctcttttttttttttttttttttttttgagatggaatctcgctctgtcgcctaggctggagagcagtggcgcgatctcagctcactgcaacttctacctcctgggatcaagcgattctcctgccttaccctcctgagtagctgggaccacaggc

SEQ ID NO: 460986 - DNA, 1314 bp, Homo sapiens
tcccttcacaggcctagggagtgatggggttaatcacacctagaacaacagctacctcttcccagaggaatgggaccagaaatcaggcaagcccctcccttcaaaagtcctctcagcacgtgagaactatcattatggatgatgctagggtggtgggggccccagaacagacctgtatgttgagttcaggggttgctttgttgcatttctgggcaggggcaagaggcccagggtttgtcatctgccccttcccctgccttatccccttcccttccaagttccccaggctccttttctgccagtctgtcaagagagggaagagtggcgaagagtcctttgtgcctggacattggggactgaacatggcccttttgcctgggcattgcccaaacatatatttctactggcataactttgtggagtcagtgatgaggtatggggttcttgacatcttcctcacccaggacccttcagagagtcctttttacactgcttactagtggcctttaagcctcagtttcctcacagttgccttgattaaaaaattttgtatcatgaaagggtaaatgaattaattagtgaatctggtttctaagccaatggcttactagaaatattatagtaatcagaatcaagaaatgattgaggtgatgctctggaataatggggactagagagtcgtgacaactaaatgcaatgtgtggtgtggtagcatttttctgggctgtagtccctagatgggtagagaagaaagccccggagagggtgaagaggtggggatgtggaagacgtcagagagagcacagggcagagcgcagagaactgcatccacaggcctcgccatgcccccagcatggctgcaccacaccagcagatgccttcgcttcccagcagtggacacaggtcactggatcctcacaaatgagcagccaggagaatgtttgcagcctggagattcggggctttgtcagcaccttgggaaggttttgttcttgggttttgggtttttggtttttggatttttttggtaacaatatcgctatatttattctcctgcagtacacttttaaattgcttcaacattttccccttaaaataaaaaagaacaacaacaaaaaaattccaaaccttagaattgaaatatttggccttttctctctctcttttttttttttttttttttttttgagatggaatctcgctctgtcgcctaggctggagagcagtggcgcgatctcagctcactgcaacttctacctcctgggatcaagcgattctcctgccttaccctcctgagtagctgggaccacaggc

SEQ ID NO: 460987 - DNA, 1032 bp, Homo sapiens
tggggtggggggagcgcggtggtgatcaatgggcctagtccagaagactctgtctgtatgtcccatagggaggtcacaaagaagtccttattgagggcagatatctggactcaccacattcagtaactgggagagagctgagaactggaaatttggttggcagagattcagacagagtatccatcttgacaagtcctttcagaaacagtagcagggagaaagtggatatagagaatcatgcactaagcttcgaaagtttataagcaaaagtgccatgggtttcttctactcagactccaatgtccaggggctttatgatagctgacaagaagcactttgtactcaactcctccactagaagcaccaaaattatgaatagattatcacacctcaaatcgatgaaacaagagaaaatggaaattcaatggaaaagtgacagacaataattaaagcaaaggagaaggaagcaaggcagcttgcaaggccagcagtggctgagagctgagagatactccccagtatggagaaagagtaagcgaaataccctcagaggtttacgtttgcatcatgtactctggcaatcctagccataggaaagacccttaacccttggaggaccctgaaactaacataaagagctagaaggaaattgtgtgaaggcactgcaccaatgaggaaggtagcactgagtcccacacattctctgagaccacagcagctacagcaaggcaccattttagagccccgtcttcaacagactgctcactgtgctagagtccaacatcactggcgctgaggcacaagagacgtgacagctgctgccaccaggccttaggtgcaagcaaccatggttgaccacacctgagactgagcagcaagcaaggctccccaataactgcacttcacctgtaaagacatataaagtctgaaaataaaggaatgacaaaagatatttcacgtaaatgcaagctagcaggactagctctagttagagtagataaaacagactccaagttaaaagcagttaagaaa

SEQ ID NO: 460988 - DNA, 1760 bp, Homo sapiens
tggggtggggggagcgcggtggtgatcaatgggcctagtccagaagactctgtctgtatgtcccatagggaggtcacaaagaagtccttattgagggcagatatctggactcaccacattcagtaactgggagagagctgagaactggaaatttgaggtggagttttcccatgttgcccatgctggtctggaactcctgagcacaggtgatccacccgcttctgcctcccaaagtgctggaattacaggcatgagtgactgcgcctgacccatttccttgtttctcttttctttgtttttcccacctcccgtagaaacaactgaagaacagcagaatacaactattcgttccctagggcgcctaaatttcccagtgttcctttagaatctgatgagatgaggtttagatctgatgaccatcaaaagtgcacggtgcaagctgtcagtgcatctaccattctggggtctggaggatgatgaccctcttctcacagcttcagtaaccagtgccccagtggaagttcccaaacttcaattactgacttctgtgcacctgcaggcccaaaaccacatgcaagccaccaaggcttggggcttgcaccctctgaagcaatggcctgatctgtacattagcccatttttgccatggctggcatgcagggaaccagatctcatgagacttatgcactatcatgagaacagcacaggaaaatccacccccattattcaattacctctgaccaggtccctcctacaacacatggagattatgcgagttacaattccagatgagattttgatgaggagacagccaaacagtatcaaaaggtttgtcgaagatcagatagttgcagatgtgcggttttatttctgggttctctattctgttccactggtctatgtgtctgtttttaacttccaatactatgttgaatatgagtggtgagagtgggcatccttgtcttgtgttggttttaaagggaatgatttcagcttttgcccattcagtactataccattaaatgacactaaagtatttcatttttttgtgtttagactttatataaatagctacttacaagccttgtggatttgcaatagtatttacaaagccgccattctgaaatagctaatctaacccatttgaattggaaatgtttcctaaaacaccaaaagcatacattgggtcatttgtgaaatctgctgatatatgtttttcattttaacatgcatatctaaatttctcaatgaatatacaattaatgttgctaacttttatgttgtgaagtgtagtatagtttctcaaataaaatattatgagtacaactaacaagatgtcatcaaagtttttatccaagattttatttaattttacgaaaatgaagattttatttaattttacaaaaaacaaatcctaacgggcttcttgagaacctggaaggttagaaaaagcctattttttgccattggatatagtaattggacaatgtatttaaaaagtagaaatatattacttttttactatggaaaaataaataaatttgattctgtttctagatctatgtcaaaatggattctaggaatgaccttgctgattaaaataatttaaaagttaggtagttttaaaatcttattcaatataaaaaagaaagtattttcacttgttacaaataaagtgacagcactaatcctgaaggtaactgtattttactctgtttctgccaagtcattgagacattgacaacacctataaatttttc

SEQ ID NO: 460989 - DNA, 2218 bp, Homo sapiens
  misc_feature (1146)..(1146): n is a, c, g, or t
gcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaatttatcgcgcttactatggagcatttaaggatgtcaaggagaaaaacaggacctctgaagaagcagaagacctccgagccttgcgatttctatctgtgatttcaattgtggacccttggatttttatcattttcagatctccagtatttcggatattttttcacaagattttcattagacctcttaggtacaggagccggtgcagcaattccactaacatggaatccagtctgtgacagtgtttttcactctgtggtaagctgaggaatatgtcacattttcagtcaaagaaccatgattaaaaaaaaaaagacaacttacaatttaaatccttaaaagttacctcccataacaaaagcatgtatatgtattttcaaaagtatttgatatcttaacaatgtgttaccattctatagtcatgaaccccttcagtgcattttcatttttttattaacagcaactaaaattttatatattgtaaccagtgttaaaagtcttaaaaaacaatggtattaattgtccctacatttgtgcttggtggccctattttttttttttagagaggccttgagacatacaggtcttttaaaatacagtagaaacaccactgtttacgattatacgatggacattcataaaaagcataatttcttaccctattcattttttggtgaaacctgattcattgattttatatcattgccgatgtttagttcatttctttgccaattgatctaagcatagcctgaattatgatgttcctcagagaagtgaggtgggaaatatgaccaggtcaggcagttggaggggcttccccagccaccatcggggagtacttgctgcctcaggtggagacctgaagctgtaactagatgcagagcaagatatgactatagcccacaacccaaagaagcaaaaattcntttttatcttttgaaatccagtttcttttgtattgagtcaagggtgtcagtaggaatcaaaagttgggggtgggttgcaaaatgttctttcagtttttagaacctccattttataaaagaattatcctatcaatggattctttagtggaaggatttatgcttctttgaaaaccagtgtgtgactcactgtagagccatgtttactgtttgactgtgtggcacaggggggcatttggcacagcaaaaagcccacccaggacttagcctcagttgacgatagtaacaatggccttaacatctaccttaacagctacctattacagccgtattctgctgtccgtggagacggtaagatcttaggttccaagattttacttcaaattacaccttcaaaactggagcagcatatagccgaaaaggagcacaactgagcactttaatagtaatttaaaagttttcaagggtcagcaatatgatgactgaaagggaaaagtggaggaaacgcagctgcaactgaagcggagactctaaacccagcttgcaggtaagagctttcacctttggtaaaagaacagctggggaggttcaaggggtttcagcatctctggagttcctttgtatctgacaatctcaggactccaaggtgcaaagcctgctgcatttgcgtgatctcaagacctccagccagaagtcccttccaaatataagagtactcatgtttatttatttccaactgagcagcaacctcctttgtttcacttatgttttttccagtatctgagataatataaagctgggtaattttttatgtaattttttggtatagcaaaactgtgaaaaagccaaattaggcatacaaggagtatgatttaacagtatgacatgatgaaaaaaatacagttgtttttgaaatttaacttttgtttgtaccttcaatgtgtaagtacatgcatgttttattgtcagaggaagaacatgttttttgtattctttttttggagaggtgtgttaggataattgtccagttaatttgaaaaggccccagatgaatcaataaatataattttatagt

SEQ ID NO: 460990 - DNA, 881 bp, Homo sapiens
caggtcttttttctatatcctttccaccactatttgtagaaaaatgctacatcgccacatgcttatatttcgactgcctaacttacagatgttagatggaagtcctgtgaattcagatgatagggcaaaagctgaatttcacctcgctgaactacaagcaaagaaaaactcggtaataattatattatttacaattttccttttgaagcacattaatggtgaagcagcaagtgctgatgtagaagctgctgcaagttatccagaagatctagctaggatcattgatgaaagtcgctacactaaaaaagagattttcaatgtagatgcaacagccttatatcagaagaagatgccatctaggaccttcatagctagagaggagaagtcaatgactggcttcaaagcttcaaaggacaacaaaaaaaacaagaatgctgggattctgacaaataatcctcggagcatccatgcagaaatagcttttcggcaactcagagggataagtatctctccatctcttttatcacatcagaatattgcatctcctactgcacaaatataccagagcaaccaagataagagaagaatttttgggagcaactttccaagatcaaatcgaatgtaactgcctaaagagaaatgagcatacaccaagaaactcacctgtttagtagttgtacaaaaactagcggacagtggtcagttaaaaaaaaaaaaaaaagataatcatgttacttaagttactgaagcacttcagttccatatgaagataatctattacccttcatgaacttgatttaatatcacctctcttaaactttctttatggttatctttagttatttgtttgaatttctatatcataaaaatcatcaactatt

SEQ ID NO: 460991 - DNA, 1057 bp, Homo sapiens
ttcaggatgtctctgaagtctctcttcagccaggaggcttttcctattgaagcactctggggcacattgatttctcctatgttttaacttcaaacatggcatcatctgaaacctatattttgattatgggtttgtctgcaaggtttttttcaaattggcacaaatttccaaaaaggtttctgaaatatttattgaaaaaaaatccacatatcattggagccacaccaatcaaacctgtgttgttcaagggtcaactgtattctctaaagtctcaattcatgaactcaatgctttcatttgcagtagtttatctactttgtaaaatatatctttttgaggaaataaacatgtatacttaaattcatctcaccaatatggcgcacctgcaagtgttgttatgtatacttacgttgccaacaattttatccactgaattacttaccatcaatattggatttctatcatatccttttagggtctttttccttctgatagaagtacaccttttctatggtttgaatgtatgtgttctccaaaattcatatgtcgaaaccaaggtgatggtatcagaaggacctattcatactctaattaccgagagcgatgggtacttcaatcgacagcaagccagcttgcctacagaaccatctctctcgggcaccagtctgcatgcaggatggctggggcaagcaggtatgaaacaggtgagagcaaagttgagattcaatggaagaatccaaggtgtcaagtccataggggcatatgtgttgagtggcaagaaaccaaccaacatcaaaggctttgcaatggcaggctggcaggaaaaagctagtatgttcagttggcagaacatcaagaggcttctataaacaacagtagaaacagagacagagcttatggttgctttgattttgggaaggtaactgttatagcctgcattatctccagcctgaatcatttctcctttttatgatacttgagtagaaatgtctttcaaacttttttcttaaaattcttgcatcttatctattaaaacttcccaccttcaactttcttc

SEQ ID NO: 460992 - DNA, 2838 bp, Homo sapiens
agagcctccatctcactccctcctgatgaaggctagtaggctgcaagagccaccagcatgggccacacctgccccaagggcatgtttctagccccagctaaggtcccgatagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggctacgaggagtgtgtggggccaggggccactcagctgtatgtccccacggacgcaccaccaccctactcgctgactgattcctgccccacgctggatggcacctccgactcaggcagcggccacagccctggccgacaccagcaggagcagaggaccccggcccaaggtggccttcacacggtctccatggacacccttcccccctacgaggctgtgtgcggggctggccccccatcaggcctgctgccactgccgggcccagacccagggccaaggggctcccagggctcacccaccccaacccgggccccagcctctggcccagagaggattgtgtgagggacccagccagccgggtcctgctggtccctacaggctgaaccacattctttaggcacacaaaggcgtgcacacacacacagagatgcacacgtgactcataacacacacatagaccaaacttgtatacacacagacatctacactgacataccccatgtacacacacagatctagacgtgctccacatatgtgtgaatatgcgcacatacaggcctaccacaaacacaaaacccacctgcaaaggtttcacggaacgtggagctctcctggcctcccgtccctcctcccggcctgtttgttgtgcctctgtagagagcgcttcggagagagaggcgaagtaggaagtgggattttctcttccctctcctgggcccgtttgcccctaccctcgcccagcaagctgcgcccaaattctattctgcctctggaaactgctggaccatccaaggtcagctgcctgccctgacccctaccccagggccagcttgtcctcctgggaggcgggacaggccccagtgaggttccgttgtgcgctgtgcctatctctcgattccagggcagatgagccacaacatcaccaccctgccacttacaaggtgggggacctgggtctggggtctcaggcgcaaactggaggccctcacagcccactaggccccctcccaaccccagtaccctcagtccctcagtcaggtggtgctagtagagctatctctgacgctgcaggccccaggtagatgggcagggccctccgtgggtgtgcagcggcggttccctcatcagtccagccactgcccaggactaagggtcttcaaggaagatgaggccattgcccttctccaggtggcttcaccacagtgctgcctgggcacctctctgaggcagagaagtggcccctccctcagtccctgcctggccgaccactgtggcctgcacgcgaatgggtcagagccagaccccggagctggtgctgtccttctaggtggctgctcatagctggggatggtgagtggctgtgttctggccttgcccacgtgggtgtttgcagagacaaaatgaaggggatatgctccccataaataccaccttgccaccacaagaggaccagaaggctactcagccttgctgccacagaaggggatttgtagggtcagcctggctgcagaaaggctggctcagatcttgaccaagaaaccccagcgatttccatcaaagaccacgcaggtaacagaggtgattcctgaagacccagcccacagagggtggcagccaagcatctctgagcagtgtccctgctagcatcgccagcggccatcactctgcctccctcccacctcttgtccctcgtcgttaaaaaacagcaccctatcctgcttccccacatttctgttcctccaatgaagggctaagactatttagtaatctctttcttaagcagaggagtggcaaggatggcaatcttgaattttattttctgtagagatagcatttcttctggtgcggagctgaaaggaatccacccagaagttctgtagcatcctgcgtgcagcctcctggagccccagactccatctgggggagggacttgtttacaagcagttctgaccaccttagtggtgtactgttttctaggcaaaaaatatctgtctgttgtactgtatagcctttaaaatgcagtccaggaatgagactcttttaagaaacacatcctgcttctgcaattccagagagtgctgggggaaaaaaagggataaaaattcctacctactcatcagtgtttgaaagatggagctgaatagcttttcttgttcctggactaggcaatgaataagcaacaatgtatcttttctgtgttcaaaataaatacataatatcaataaaatgtagcaagaagtaacactttcagagagtgcataaggttcctttttttcttttctttttttcttcagacagggtctcactcagtcgcct

SEQ ID NO: 460993 - DNA, 2771 bp, Homo sapiens
agagcctccatctcactccctcctgatgaaggctagtaggctgcaagagccaccagcatgggccacacctgccccaagggcatgtttctagccccagctaaggtcccgatagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggctacgaggagtgtgtggggccaggggccactcagctgtatgtccccacggacgcaccaccaccctactcgctgactgattcctgccccacgctggatggcacctccgactcaggcagcggccacagccctggccgacaccagcaggagcagaggaccccggcccaaggtggccttcacacggtctccatggacacccttcccccctacgaggctgtgtgcggggctggccccccatcaggcctgctgccactgccgggcccagacccagggccaaggggctcccagggctcacccaccccaacccgggccccagcctctggcccagagaggattgtgtgagggacccagccagccgggtcctgctggtccctacaggctgaaccacattctttaggcacacaaaggcgtgcacacacacacagagatgcacacgtgactcataacacacacatagaccaaacttgtatacacacagacatctacactgacataccccatgtacacacacagatctagacgtgctccacatatgtgtgaatatgcgcacatacaggcctaccacaaacacaaaacccacctgcaaaggtttcacggaacgtggagctctcctggcctcccgtccctcctcccggcctgtttgttgtgcctctgtagagagcgcttcggagagagaggcgaagtaggaagtgggattttctcttccctctcctgggcccgtttgcccctaccctcgcccagcaagctgcgcccaaattctattctgcctctggaaactgctggaccatccaaggtcagctgcctgccctgacccctaccccagggccagcttgtcctcctgggaggcgggacaggccccagtgaggttccgttgtgcgctgtgcctatctctcgattccagggcagatgagccacaacatcaccaccctgccacttacaaggtgggggacctgggtctggggtctcaggcgcaaactggaggccctcacagcccactaggccccctcccaaccccagtaccctcagtccctcagtcaggtggtgctagtagagctatctctgacgctgcaggccccaggtagatgggcagggccctccgtgggtgtgcagcggcggttccctcatcagtccagccactgcccaggactaagggtcttcaaggaagatgaggccattgcccttctccaggtggcttcaccacagtgctgcctgggcacctctctgaggcagagaagtggcccctccctcagtccctgcctggccgaccactgtggcctgcacgcgaatgggtcagagccagaccccggagctggtgctgtccttctaggtggctgctcatagctggggatggtgagtggctgtgttctggccttgcccacgtgggtgtttgcagagacaaaatgaaggggatatgctccccataaataccaccttgccaccacaagaggaccagaaggctactcagccttgctgccacagaaggggatttgtagggtcagcctggctgcagaaaggctggctcagatcttgaccaagaaaccccagcgatttccatcaaagaccacgcaggtaacagaggtgattcctgaagacccagcccacagagggtggcagccaagcatctctgagcagtgtccctgctagcatcgccagcggccatcactctgcctccctcccacctcttgtccctcgtcgttaaaaaacagcaccctatcctgcttccccacatttctgttcctccaatgaagggctaagactatttagtaatctctttcttaagcagaggagtggcaaggatggcaatcttgaattttattttctgtagagatagcatttcttctggtgcggagctgaaaggaatccacccagaagttctgtagcatcctgcgtgcagcctcctggagccccagactccatctgggggagggacttgtttacaagcagttctgaccaccttagtggtgtactgttttctaggcaaaaaatatctgtctgttgtactgtatagcctttaaaatgcagtccaggaatgagactcttttaagaaacacatcctgcttctgcaattccagagagtgctgggggaaaaaaagggataaaaattcctacctactcatcagtgtttgaaagatggagctgaatagcttttcttgttcctggactaggcaatgaataagcaacaatgtatcttttctgtgttcaaaataaatacataatatcaataaaatgtagcaagaagtaacactttc

SEQ ID NO: 460994 - DNA, 835 bp, Homo sapiens
acatgctcccaccccacccccaagtacccgcagtgcctggcaaagcatctggctcttaacagatgttcaagcaaaaacctgtgccttccaggcccctggtgctttctgccctcagacccccagcctgccctcactggcccttgctctttcatagcacactccacacccactcacctccaggcctttgcccggagcctttgctggggcctccccccaggacaggggagccttggagcagggctggccccctcactgtgctgagctcacacagggtccatgggacatacacctcggcaagtagaggccacgtcaatgcggccagctcagctgtcaggcaacttttattcctctcagacaggagctggccagtctcacctcccacttatgtggagctgagtgagcttcgaagtccactgactactgtcctccctctggcccacaacgtaaaggtggtgagcatccccagctaagaccctgcaggaaaggggagaccacccccaccccacaggagagctcactggcttcagtgagttccagtccctgctctgccaccaaccaattgaatggccttgagcaagtcactcaacccacacaatcttcatgggaataactgcagagtgcctttcgaagcatcctacagggagaatgtctggaaatggtttagcataaaaccaggcataggggaataataatagccaacacttactggcgctcatcacaggctggacacttctctctgtattttccattcgttaccttggatagtcctcgcaaatgcttctgtggttggctctaatgctcccatccctgctttgcagatgaggaaactgagacg

SEQ ID NO: 460995 - DNA, 582 bp, Homo sapiens
cctaacaggctgagcgttatcaatcagacgaattcctgggaactgcggatatagctcgccacagtatcttatcagttaactgcattcttggatgtgctgggagtcagcttgcacaagttaagtccttgaggaaggggctgccagggaaagagccaagatggagtctgtctggctctctcagctaagggagagtccattcaggtggaaatgaggctaggtgagtaaaggaaaggggagaccacccccaccccacaggagagctcactggcttcagtgagttccagtccctgctctgccaccaaccaattgaatggccttgagcaagtcactcaacccacacaatcttcatgggaataactgcagagtgcctttcgaagcatcctacagggagaatgtctggaaatggtttagcataaaaccaggcataggggaataataatagccaacacttactggcgctcatcacaggctggacacttctctctgtattttccattcgttaccttggatagtcctcgcaaatgcttctgtggttggctctaatgctcccatccctgctttgcagatgaggaaactgagacg

SEQ ID NO: 460996 - DNA, 988 bp, Homo sapiens
gcaacattgtcgatgcagcagattatttttaatgtacagattttaaaacaatgttctcgagtaatgagagataataaatcgtgtgcttttttcatgggaaagttaaatgtttgttttgaaggcacagtaatagcaggctattcagtgtttgtgattatgtgtgtcattgatatggctgtagctagtgcactacaatttcctaaaaagtcttctcaccctcataggactgctctacatctggcctctgccaatggaaattcagaagtagtaaaactcctgctggacagacgatgtcaacttaatatccttgacaacaaaaagaggacagctctgacaaaggccgtacaatgccgggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagattgagtctcactctgtttcccaggctggagtgcagtggtgtgatcacagctcactgcaacctcgacctcccgaagctcagatggtcctccaacctcaacctcagttgtttttttctttctttctttttatttttatttttatttttatttttttttagtagagatgaggtttttgccatgtttctcaggctggtcttgaactcctgggctcaagcaattcatccccctcagcctcccaaagtgctaggattacaggtgtgagccaccattcctggcctagtctgacttttatctctgtggttgagacattaaaatgaatattattggtagtatctatcaggttacagaataatatattttcctttctaccatcagttattcactgccattcagaaggtctttagtagtttgctgtgagcagtctttcaataagtagaggatggccctctcaggattttgtgtctctttgttcag

SEQ ID NO: 460997 - DNA, 2345 bp, Homo sapiens
aggattgaagagagctcgagccttgctctggattaggctttggcttaagagaacttcgtgtatgttcgttctggtgcccatgctgaaaggatggcagctatggagcagaaactctttacatggcaaacaaaaggtaaagcccaaccatccaagcatatttcaagtctttgcttgtgccatttctgctgacatcccattggccaaagcaacgcacaagaccaacctccaagttaaaggtggtaaagcacatttggtcagcagtggaataacttccaattacaaagcaaagggcatggatataaggagaggtgaagaattagtggtgtcttctttaaagaatagagtgaatgttggtggccaaaagaatgagagttatgatcaactcagtataccactggaggctacaggagcaaacagcaaactgtttctcatgaaagcaggatgttcaaagcaggatgttggcaaaatgacaaactgcatctgccacccagaaggaatgctgagggcagtcatgccccaagtgcagtgtttttgtgattaggcacaactgaagcttgttagcaataatatgaccctgtgattaattgagcggctgaccaatcattacctcctcctccctgctctttctacccaataaatacaaagggctgtggaagctcaatgggctgcctttgctcattagaagcagggagctctcttcttcttcccctggatccttcctttaaaatagtttcttttgtcttaagttttcatttctacgtttgtcccttcattcagtctcttaaatgacggtctcaagcagtaacagtagtaattgctgtaatgacggtctcaagtagtaaccagggcactctgccacaagtggcacctgaacagggactaacagggactatcaagaacaaacggagacctgaagagacctgaagggaactgaagaggtctgcagggacaaatagagataagtagggataaatagagataaatagagacaaatagagataggtaaggaatgacagggacttgcaggaagtaacagggaccatagggacagatagggatagataaagactagcaaagactagccgagattagcaaagaccagcaaggactagcagagactagcaaagactagcagaaacttgcagggacaggcagagacagatagggacagatagggtcctacagggacttgaacgaggaagatctgctggaaaagaaaagaactacaaccaaccagatgaacaagaaaccctgttacaagtctgctggcagcaacataaggaaatgaacaaaaagtgtgggtgcccccaaggtgtgtactaccatggaatgggagattggagggacacatggatcccaaccgtgggcctggttcccccagtatgagctgaatacgaagacagaacaaaccaccaaccggcaattgaagtgacacaaagtgaaccgggttctataaattaccatggaaagtggtgagccaacgatttggcagaacaaaaccctgaggatatgcaaacaaaagggactatggaatttgcaattgcagattaaaattgaagaagaaaacatttgagttgcaaataccgtattaaaagtggacactgcttatgactgctgtatgcaacagtttttcaggcccgaggtgataaataaaaaattgtttgctctatttaaccattgaatgcttggactacttttgtatccttaagatgtgaagtgttcttcactagaagtaaacattaaggtcatttaccattgattgcttaaggctagtaaatacgtttaaggagttttaaagctttactttgggagaagtcaggaccagacagcttaataaagccactctgtgtgggaccatgactaagttttgttgtgtttacagacattttgtcacagaatcaaagttaacttttttttttaattctctttgccacagaggaacccagacatgctctatttgcaaaccgactgcatgaaacaaaaagcacggtaattctgaagctgttggcttggatgaaatgagaatgtaattaaaaagaaaaaggttagcaaaagaacatgctgggaattgaaaataaaaatctgaaatgatgtcccagcctgcccttaaggtcttttccaccatgtagagagctacctcaaatgctctacttgtcccagagtctatgttctttcactactattgcctatatctgtgttttctgctttcaataatctattgaaataatcaaaattaattacattcagcattttttctgtattactctgattctaataattacctcaaatttatttgtgcatttctatactagaaagaaaaaataatttttagagttttactatat

SEQ ID NO: 460998 - DNA, 1146 bp, Homo sapiens
ggtatgcttgtttttgcaggaaatgaacaaaaagtgtgggtgcccccaaggtgtgtactaccatggaatgggagattggagggacacatggatcccaaccgtgggcctggttcccccagtatgagctgaatacgaagacagaacaaaccaccaaccggcaattgaaggaaatgatagctccttacaaatacagaggacaaaataaaagtgacttaattataaaaacacagtgacacaaagtgaaccgggttctataaattaccatggaaagtggtgagccaacgatttggcagaacaaaaccctgaggatatgcaaacaaaagggactatggaatttgcaattgcagattaaaattgaagaagaaaacatttgagttgcaaataccgtattaaaagtggacactgcttatgactgctgtatgcaacagtttttcaggcccgaggtgataaataaaaaattgtttgctctatttaaccattgaatgcttggactacttttgtatccttaagatgtgaagtgttcttcactagaagtaaacattaaggtcatttaccattgattgcttaaggctagtaaatacgtttaaggagttttaaagctttactttgggagaagtcaggaccagacagcttaataaagccactctgtgtgggaccatgactaagttttgttgtgtttacagacattttgtcacagaatcaaagttaacttttttttttaattctctttgccacagaggaacccagacatgctctatttgcaaaccgactgcatgaaacaaaaagcacggtaattctgaagctgttggcttggatgaaatgagaatgtaattaaaaagaaaaaggttagcaaaagaacatgctgggaattgaaaataaaaatctgaaatgatgtcccagcctgcccttaaggtcttttccaccatgtagagagctacctcaaatgctctacttgtcccagagtctatgttctttcactactattgcctatatctgtgttttctgctttcaataatctattgaaataatcaaaattaattacattcagcattttttctgtattactctgattctaataattacctcaaatttatttgtgcatttctatactagaaagaaaaaataatttttagagttttactatat

SEQ ID NO: 460999 - DNA, 2252 bp, Homo sapiens
aggattgaagagagctcgagccttgctctggattaggctttggcttaagagaacttcgtgtatgttcgttctggtgcccatgctgaaaggatggcagctatggagcagaaactctttacatggcaaacaaaaggtaaagcccaaccatccaagcatatttcaagtctttgcttgtgccatttctgctgacatcccattggccaaagcaacgcacaagaccaacctccaagttaaaggtggtaaagcacatttggtcagcagtggaataacttccaattacaaagcaaagggcatggatataaggagaggtgaagaattagtggtgtcttctttaaagaatagagtgaatgttggtggccaaaagaatgagagttatgatcaactcagtataccactggaggctacaggagcaaacagcaaactgtttctcatgaaagcaggatgttcaaagcaggatgttggcaaaatgacaaactgcatctgccacccagaaggaatgctgagggcagtcatgccccaagtgcagtgtttttgtgattaggcacaactgaagcttgttagcaataatatgaccctgtgattaattgagcggctgaccaatcattacctcctcctccctgctctttctacccaataaatacaaagggctgtggaagctcaatgggctgcctttgctcattagaagcagggagctctcttcttcttcccctggatccttcctttaaaatagtttcttttgtcttaagttttcatttctacgtttgtcccttcattcagtctcttaaatgacggtctcaagcagtaacagtagtaattgctgtaatgacggtctcaagtagtaaccagggcactctgccacaagtggcacctgaacagggactaacagggactatcaagaacaaacggagacctgaagagacctgaagggaactgaagaggtctgcagggacaaatagagataagtagggataaatagagataaatagagacaaatagagataggtaaggaatgacagggacttgcaggaagtaacagggaccatagggacagatagggatagataaagactagcaaagactagccgagattagcaaagaccagcaaggactagcagagactagcaaagactagcagaaacttgcagggacaggcagagacagatagggacagatagggtcctacagggacttgaacgaggaagatctgctggaaaagaaaagaactacaaccaaccagatgaacaagaaaccctgttacaagtctgctggcagcaacataaggatgatgcccattctatttcctaggaagggataagttttaaggccttataaaaagtgacacaaagtgaaccgggttctataaattaccatggaaagtggtgagccaacgatttggcagaacaaaaccctgaggatatgcaaacaaaagggactatggaatttgcaattgcagattaaaattgaagaagaaaacatttgagttgcaaataccgtattaaaagtggacactgcttatgactgctgtatgcaacagtttttcaggcccgaggtgataaataaaaaattgtttgctctatttaaccattgaatgcttggactacttttgtatccttaagatgtgaagtgttcttcactagaagtaaacattaaggtcatttaccattgattgcttaaggctagtaaatacgtttaaggagttttaaagctttactttgggagaagtcaggaccagacagcttaataaagccactctgtgtgggaccatgactaagttttgttgtgtttacagacattttgtcacagaatcaaagttaacttttttttttaattctctttgccacagaggaacccagacatgctctatttgcaaaccgactgcatgaaacaaaaagcacggtaattctgaagctgttggcttggatgaaatgagaatgtaattaaaaagaaaaaggttagcaaaagaacatgctgggaattgaaaataaaaatctgaaatgatgtcccagcctgcccttaaggtcttttccaccatgtagagagctacctcaaatgctctacttgtcccagagtctatgttctttcactactattgcctatatctgtgttttctgctttcaataatctattgaaataatcaaaattaattacattcagcattttttctgtattactctgattctaataattacctcaaatttatttgtgcatttctatactagaaagaaaaaataatttttagagttttactatat

SEQ ID NO: 461000 - DNA, 2197 bp, Homo sapiens
aggattgaagagagctcgagccttgctctggattaggctttggcttaagagaacttcgtgtatgttcgttctggtgcccatgctgaaaggatggcagctatggagcagaaactctttacatggcaaacaaaaggtaaagcccaaccatccaagcatatttcaagtctttgcttgtgccatttctgctgacatcccattggccaaagcaacgcacaagaccaacctccaagttaaaggtggtaaagcacatttggtcagcagtggaataacttccaattacaaagcaaagggcatggatataaggagaggtgaagaattagtggtgtcttctttaaagaatagagtgaatgttggtggccaaaagaatgagagttatgatcaactcagtataccactggaggctacaggagcaaacagcaaactgtttctcatgaaagcaggatgttcaaagcaggatgttggcaaaatgacaaactgcatctgccacccagaaggaatgctgagggcagtcatgccccaagtgcagtgtttttgtgattaggcacaactgaagcttgttagcaataatatgaccctgtgattaattgagcggctgaccaatcattacctcctcctccctgctctttctacccaataaatacaaagggctgtggaagctcaatgggctgcctttgctcattagaagcagggagctctcttcttcttcccctggatccttcctttaaaatagtttcttttgtcttaagttttcatttctacgtttgtcccttcattcagtctcttaaatgacggtctcaagcagtaacagtagtaattgctgtaatgacggtctcaagtagtaaccagggcactctgccacaagtggcacctgaacagggactaacagggactatcaagaacaaacggagacctgaagagacctgaagggaactgaagaggtctgcagggacaaatagagataagtagggataaatagagataaatagagacaaatagagataggtaaggaatgacagggacttgcaggaagtaacagggaccatagggacagatagggatagataaagactagcaaagactagccgagattagcaaagaccagcaaggactagcagagactagcaaagactagcagaaacttgcagggacaggcagagacagatagggacagatagggtcctacagggacttgaacgaggaagatctgctggaaaagaaaagaactacaaccaaccagatgaacaagaaaccctgttacaagtctgctggcagcaacataagtgacacaaagtgaaccgggttctataaattaccatggaaagtggtgagccaacgatttggcagaacaaaaccctgaggatatgcaaacaaaagggactatggaatttgcaattgcagattaaaattgaagaagaaaacatttgagttgcaaataccgtattaaaagtggacactgcttatgactgctgtatgcaacagtttttcaggcccgaggtgataaataaaaaattgtttgctctatttaaccattgaatgcttggactacttttgtatccttaagatgtgaagtgttcttcactagaagtaaacattaaggtcatttaccattgattgcttaaggctagtaaatacgtttaaggagttttaaagctttactttgggagaagtcaggaccagacagcttaataaagccactctgtgtgggaccatgactaagttttgttgtgtttacagacattttgtcacagaatcaaagttaacttttttttttaattctctttgccacagaggaacccagacatgctctatttgcaaaccgactgcatgaaacaaaaagcacggtaattctgaagctgttggcttggatgaaatgagaatgtaattaaaaagaaaaaggttagcaaaagaacatgctgggaattgaaaataaaaatctgaaatgatgtcccagcctgcccttaaggtcttttccaccatgtagagagctacctcaaatgctctacttgtcccagagtctatgttctttcactactattgcctatatctgtgttttctgctttcaataatctattgaaataatcaaaattaattacattcagcattttttctgtattactctgattctaataattacctcaaatttatttgtgcatttctatactagaaagaaaaaataatttttagagttttactatat

SEQ ID NO: 461001 - DNA, 5115 bp, Homo sapiens
cagagaggcagctgaggcagggacaatggggctaactgtagagcaggctctggcggtggccatccagcttggtggccatctggctgatccactcctccaggtggaccctctgtcctcatgtggtgcaggtcccattgtgccacctccagacaggccatgctagccccagggcctccgttccctgttacccagcccccacccccagaagtacagaggaacctggtgccggccgcagtcaacccctatgtgatgatctttctacccgccctctttcgtgtcttggtgctggctgctgtctttggccagctaaaagaatatcagcaaaggaagagccctggtattccagcaggagcaaagacaaaaaagaaaaaaactgacagtagccctgagacaaccacttccggtggtggccactcacctggggatattcaggacattctgaaggtgcgggtgtccaaccttaaccactccaatgggagccagtaccaagaactagcagtagccctggagtcaagctcagtgacaatcaatcagctcaatgaaaacatagaatcattggcaaagaaaacaaacaatgaaatacacaaagcacaaatggagcagttagagacaatcaacatcctcacattggaaaaggcagacttgaagaccaccctttaccatactaaacgtgctgcccgacacttcgaagaagagtccaaggatctggctggccgcctgcaatactccttacagcgtattcaagaattggagcgggctctctctgctgtgtctacacagcagcaggaagaggacagggggcactgcccgggctccccagatcaaaacttctcactcttcaccatccagtcctcgagctgcagagaagcggtcctccagcggcggttacagcagaccataaaggagcgggcgctgctgaacgcacacgtgacacaggtgacagagtcactaaaacaagtccagctagagcgggacgaatatgctaaacacataaaaggagagagggcccggtggcaggagaggatgtggaaaatgtcggtggaggctcgaacattgaaggaagagaagaagcgtgacatacatcggatacaggagctggagaggagcttgtccgaactcaaaaaccagatggctgagcccccatccctggcacccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctgaacaacgagaaaaagagcgcactgcagttggagcagcaagtaaaggagctgcaggagaagctagacgaggtgaaggagatgcagtacatggccacctatcagcagctgacctctgagaaggaggcgctgcacaggcagttactgctgcagacccagttcgtggaccagctgcagcagcaggaagcttggggcaaagcggagcacctagaagctgccagccagcggaaccaacagctagagacccagctaagcctcgtggctctccctggagaaggagatggaggacaacatctggacagtgaggaggaggaggcgcctcggcccacgccaaacatcccagaggacctggagagccgggaggccacggaggagcaggcacggctatgtgggcagcggaaggtgcgaaggctgtgccgcctgcacctggctcatctggtggccttggcctggaaggagccagaggcagaggccccagccccagggaggactggagatgagtttgtgtgtggggagagctaccgggccctgaaggaggccatggtgaagctgaaagggagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacgagtatatgtcccagtacacaaaagggcactggttggcattcttcttaagccacattagttactctgacataggaatttacttcttttctttgaatggaaaacactttaaaaataataacaaccattattataaaccaatatatgtgagagtacttagttgaaacaaaaaggagttttagtagacagtattatactacacatgaaaatcaaggcgaagtttatgcaacttaaaatgtttacaagctgcagtgcaatctaatgtttgtgaatgtccaagtattatgagaaaaagtgtctatacaatgacagacttatgtttcctcacaaagttcttcacaaagagtgaaatatgtttttatacctctcagtttcagttagaggcatattttgtgccatatttatgttaatgtgcctatacgtgatgagtgaattatttcagtcatacattgcctaaatcataactttaagatgcttgggaaagaatcaacagctaaaagttcatgaagttctaatgtctgtgttccaaaatacgtcacagtattaggatgcagggagagatgtgtgtgcgctccctggggtgggcatttctagttactagaccatctccatttttagcatttggcatcctcatgatacttttatacatatgacattaataggagagcaataatacgattttacagatggaataacagatgtgcctgcattcagtgaaagagtgcaaatattaagtccttgtgacttcaactgactcttccaaattgtatgaatttatcaatgtattagataaactcagttccagaattataaagaaaaactgttagaccaacgaatgtggctaattaacagtaggacgatttctagcccgagggtttaaaatggacttcaagtcctgttcttgccttttattttctgaacttgccacttttgcattctttgagttcagtttaaagacagtttgagtccaatttagaccctcgggctagaaatcataccactgttaattagccaccttatttggtctaacagtttttctttataattctgaaactgggtttacctaatacattgataaattatttcaaaggtatttttatagttcaatcacttcacttttaccctgataaatataaatgactaggaatgatcttcagctagcctttagcacctgcaaccaatctgacaataatgtgttcatcaggtacctgtggattaaatcacacaccggcatatttaagctgaatgtcagtctggaaaatgaatgtactatattaactgaaataccactctttgtgtaggtattctgtcatatatttaagaaaaattaaatagcatgtaaatcatatgacaacaacttaagtctttcttcaaagtgcatgtggtcctttgcaatacctcattcagccaagtatttgttctcttcctcattcagtataaggcagcgttcaatttgcttagaaggcaacattagaagggtagagtttaatcagaaacatagaattttaaagtgtgggttcaactgaataaatttgaatttctgtaggaagtaaagaattaaaaaccgatttaaagattgcaatatataatcatttttaaagtatttgattaaatctgataggttttccagaaatgaaaaaaagtcagttctaaaaccaaagctgatatttagaaaatgtgaaaatgtaaatcagtcctatccataatagtttctctaaaactttatcttaaagagtcattttaaaagaatataactattcaaaaatgtaactgctatcttaagttttaaaataagttaagacattttaaaatatgaatactgtagtttaaaagaaagaaactgggggaaggaaaagtagagaaagaaatgccaattccaatgcaaagctttatttgccaagttttcttagaatgacttttaccaatttatgaattcttgtaaacagaatgtataatggaaatactgaaacactgttgcctaaagtggcattattcactgctactgtgatgctactgtaatgtaataaattattaaattgttgcaaagtgctgtttttgccttaaaattttgtgtgtcttgaaaactgtggtgttaaaggtattgagactgtgcaaatgctgggcacgcttggcatgagataaccggtttttatttttataaaattttaatgtaaccatgaagtgtgtttatttgaagaacacaaaccaaagttatgggataaaaaaggttgtgggatgaaaaagttacaggataaaaaatgttgtggaaaggttgtggcaaaaaaagttgtggaaaaaacgtaaaagttttatgaaaagcttaaaaaaagggccgggcttgcttgtcacgcctgtaatcccagcactttgggaggccgaggcgggtggatcacaaggtcaggagatcgagaccatcctggctaacatggtgaaaccccatctctactaaaaataca

SEQ ID NO: 461002 - DNA, 1125 bp, Homo sapiens
ctctgcatgcatttgagccagctatgcctgacagggtcttccaacagagagaacctctgggcatcttcttttggtgcagcctcagttgcctgcacaggggccttcctgacacttcccaaaggacagaacgggcaactgcaaatgacagaaaggccaacaccacttggctcaggcaggaaggccaagagcttgcaaaaccaggaattgctgggggtggctccaactctgaacacaacacggcacctccagggccctgggcatttccagggtccagggccctgggcgtcttcaggctgccttctctctcccagcagatcctcgttgcacaaggctgtctagtgctccatggtgaccagaagaagggcagcacctccagctcactaaagcacctgtgcagctctcaaggctccagagaaacttgcccctcattggttgggatccagattggcaatgacaacatcactcactcaaaacagccaaatcagtatgttatgggagaaccaaatgatgatatctgtaaatacacaagtacagcagccatggcttgggaagggcatagtgaacaggagctcgtactgctcagaaataaggatctggatcacagcatcagcaaggactaagagacacccctaaggaagaaaagtagtagtagtggcttggaaccaggacccacaatatctccaaggatgccggtatatcccacttcatttcaatgacccacttactgagttacattccatactacattatcaatgcctccaagtcagagactatgtcttacttttgtttgtatgtctagttgctagaatagttctgagtgcacagtaggtgatgaggtttattttgatgttgaacaaatatgtacaacctgcaaagatatttttactcagtgctttatccattcagattttgccctcatgaatcaaaactgtagttataaatataaataaatgtataaatgcatatatatgtgtgtgcatacaatcagttggccctccatatctgtggattccacatcctctgattcaacaaactggataaaaagtatttttaaaaatcaataaaaaatacaagctaataaaaaatacagtataacatctatttacatagcatttgcattgtatt

SEQ ID NO: 461003 - DNA, 818 bp, Homo sapiens
tcagtgctgtgtgggaggggtttgtgccttccttgtgatgccatggggctcctgcagagctgtgaccctcaatctgcccaacccatgaccatagccatggagaatcccaaggagttaatgacttccctgattgagttgcttcctttggaagcctcctgtgccagctctgcccagcccccgccttcagtggccactgcggggctgcccagccagaaaccaggtctccccaggcaggacctctcgctcccatcagctgcaaagtcactgtcttccagggccacctgcctcatgactggctctcctcaggtcacaggaagctgggagcgggaccctgaaagaactcgagttctgtccttagatgttgggcatgcagcaggcaaagggagaatgagaggagacaaggacctggcttcccatctacagactgttcagccaaggccatgcctagagtgggatctgctaaatgggcacagcagaacattggaagaagcacctttgagccagtgctgctggggtctccgtggattagagccaggagccctgatgaggcctgtgggcggggcttcactttcgaccctgagaagccaactccacatctccttccctctcacccttgagccgtgggtagttcagggaggccacagccttctttctgtgccatggcctatcccaaagtcacctccactcacaacgtcgtgaccttaggtaagttcttgtacttttgtgaacatcatttctcacccagaataatgtccttactgcaatatgctcgttccattccctgctggctttgtggccacaaatggaggggcagctac

SEQ ID NO: 461004 - DNA, 1184 bp, Homo sapiens
tgagggacctggagatgttcttttccaatttctggattgggaaatggaggcaaattctgggtactagagtcagaactaagacgaggctgaatcgggagagtctggggtcctgagaggcagagacctgaaaccctctagattgtgtggggagctgggtgtgtgttctggccagttgtttctccctgtgcctcaatgttccaggtacccttggagggggctgagatcctggggatgcctggagcctggctgcatggcctggccgccctgatgccttcgtgctctccacagcaggccagcaaggccgaggagaatggttccaacagcttcatgcactccatggtcccacagctggagtggcagatggagaccacccagagcctggtggactcctatgtggccattgtcaacaagaccgtgtgggacctcatggttggtctcacacccaagaccatcatgcacctcatgatcaacaacaacaaggagtttatcttctcggagctgctggccaacctgtacttgcatggggacaagaacatgctgatggaggagtcggcagagcaggcacagcggtcatgaacacaatcagcacgcccacgggggcccatggacaactcctgactgcaggtgcagagcatcctactggatgcaggtaccagggctggcccccacggccccaaagccccccagcctccatggctaagactgtgggctcttggaacagcctccatgcccaagttggcagatgtgggtgctctctagagtcctcggagagggcagagaactcatggtttatggtgtaggggctgggaatgtggagggcgttgtgtgtggggctggactctgaggcggccagaggcctaggaatgtcacctgggcacaacataactgtcgtgcagtctgagtcatgctgccagggcagggtatccagttcccagtctgggagtgccgagagccaaatccactgcagagcagggttgatagtcagggtcccacctcctctatatgttggcaatccagtggtgatctaggataaaatcttgagagtcccatacacatggtcatcccacaacacacctcacaggccaggcaggaacacacagcccccttccctccctcccagataccatcatacctgctagcgtgtgactgaaggcagggtccctggcccctgctgaaacactacc

SEQ ID NO: 461005 - DNA, 1035 bp, Homo sapiens
taagggaagagcgcctcaagtgagcatgcctacaacgccagtaagcacactgcgcatgcccatcttccaagtactagcaggtgctgcgcatgcggacagcggatcgcaaggggaaaagaccccggaagtacgccaaagtataaaacctcaggttaaaaggtcaaaactagtacttgtccttcaagtcgcccacttggccctcttccagttaaggtggcaggagtggaatcttggattcaccacaccagagttaaattttggacaccccctgaggaacctgtgggaccatcagctcaggagtcccaagatcagccagaccagcctcgatacacctgcgaacagttggaagacttgcatctcctatgtgggaaggaaacatcccagattaaaaaggctcctaccactgatcctgaagaaaaaccccttcctccttaaaaaagataagtgaaaaccacataatctttaacacctctccttacccctttaatggaatcattttactatttcatcatattattaagcagcatactaaccatactctttgtgatagggctataaactgtagctcctgctgggtcgaacatcctaatcacatcagccttctttctgtcttccttccttctgacagcaatttactcctacctttaactcagcctggataaaatgatctcgtgttccagagcacctctttaccttcctatttactctttgcctatctatccctcctgcttccttggatacgtcatacaatcacctatccccttccactagctcctaattacctctacaagactctcaacttaacccactctctgttaaaccagtccaatccttccctggcaaataactgttggctttgtatctctctatcaacctcggcttacgttgccactcccattcccgcaaaaaattgggtctttaccgacttaacctaccaccctcattatgaaggaaaagcccctttctgacttctaaatatgcaatcattagccgacttccccatctctgataggaccaagaataccctaacaggac

SEQ ID NO: 461006 - DNA, 734 bp, Homo sapiens
tctctctacagatatgttgctagaaacatatctatgttcaccaaccacacttctggatggccaccaggacaattgtcccctgcttaccatcactgtaatacttcacagccacttcaaacacaaagctatcccagagagaaccctcttttccacaaatctacatctcttcctaaattcctggtgtgccctccgtgctctgctgctctactctagtttgggtcctggacagccattagaagccaaggatgactggggagatagcaagaagctgaacagggatttggacttagatttgtctccaaaatgtgtggctccttcactaacacactgttctaccttactattttcttctttgcttgctttgaaaacatttggttttatgttcacctacatgaaatgcactaaatctctggtgatggcagtgttttacatttctaaccagatgcagctgagcagatcaatgcatgaagtaaatcacaaaatagagattgaacttaacaggagcacactggaatctacaatctcaaggtattagggaaaaatttttctgaccatacaacctacccaaaggatgaaaatctagctcagtttcagcctttttagttgttatttccatacctgctttacaaaattctacactttttctcctgcaattggcaacagtcatgcatgtgtgtatggagatggcatcctctttagggaacatattaaattgattatgcacatctgaatat

SEQ ID NO: 461007 - DNA, 1274 bp, Homo sapiens
tagctcttcttactgggtcctagctaaaaactggacatgtgattttgggacctgatcatgaactgggtgtgcaccccacttcccccctggctcttagggcccccatcgcaggggggggaggcacccccggcgaggcggggactgagagccagcccctcatcccccccggcttaggacccccatcgcagatcctaagaaccttaggacccacctgggggactgtgggtattaggtgtccaagaagaaagctcaaatctgccgagggcaggtaccttacttgggatttactatccgacaggggtccaaacgcagcccgggaacagaaagaaagcaggtcatttgcagtctaccggagcctaagggcagaaggcaggtgagggaattcttaggggctgtggggttttgtagactgtgcatcccaaactttgcagtattagccaagcctttgtatgaggtcacaaagggggcggggaccgggaacctttgaaatggggatcccaacaacagcaagtctttcatgagttaaaggaaaaacttctggcagccccagccctggggctacccgatctgaccaagccttttccattgaatgcgtcagatagagaaaagatggcagctggacttttaaccgaaactctgggaccctggctgtggccggtggcctacgtgtctaaacaactagagagggtttctaaaggatggcccctcatgtttgagggctgtggtatcaactgccctgatagacccccatcgcggatcctaagatctttaggactcacctggaggactgtgggtattaggtgtccaagaagaaagctcaaatctgccgatggcaggacaccaatcgcaggggtgggaggcacccccaacgaggcagggactgagagccagcccctcgtcccccccggcataggacccccatcgcggatcctaagaaccttaggacccacttggaggactgtgggtattaggtgtccaagaagaaagctcaaatctgccgatggcagatatgttttggttcacaacttgaaggagatagatgatgcagtgactgatgtgtttgcctatggtgataaacaccagccacactcactagcctatttcctactgacactcacccctacagacccttaaccccacccacagctgtcagctctgcctggcccttgaggggtgggtttatgagagaccttctgcttactgctagtctcagaatctatggtattcatggaatgctgatgctatggtttgaatgtatgtatttctccaaactt

SEQ ID NO: 461008 - DNA, 2029 bp, Homo sapiens
gattattgcagggagtggggcagggggattccctgccccaggtgactggcagggccgtgtctgttttgctctctccgctcatgttgcaacagcgtggctgccacacggcaacgccgacagctgctcaggaagatgcggcgtcaggctgcccgacacaggtggccaagagagggacggaccaccctagccaagcgcagtgtggagtccggcctcaaggccagggcggcgtgactgccccgctgggggaccgtcacctccccgctcccagccatctccatgggccccgcgggagaggagcagcagcatgtgttatgccgttggcgccggccctgccccaggtgctctccgtgctctgcgtccttgccagcccacgccaggggcttctctcattcccggtctccactgcaggcccagatggacctgctgatcccagtagaccacaaagtggagctaaagtgtacaacctaagagcacaggggacctgcattcgacccaagaaagagatttttaaccatgagaaaaacatcagaaaagcccaaactgagggatcttctacaaaatattctacccgagcagtcctcaaaaccatcagcgtcatcacagacaggcaaagtcccagaaactgtcagccaagaggagcccacggaaacccaatgactgtcacgtggaatcctggatgggatcctgggacagaaacagccacgaggggaaatctgaggaaattggaattaaagcagtgtgtcaggctaatccacagctgccctttggtggacggctgccgaatcttgaccaacgtcaaggtcagtgttgtcctgtaagagcaataagttctgcagtgagcgtagcgtcgaggaatgatggttacgcgcaggagccctggacttggactatgctggcttttaatctttcagatgattggccacaaatttcagtgtttaaaagcaggttaccaagagaaaaatgctgagagcccttgctctcagtccccttccaacccgtacactctcagacactagataggccatcaaaacaactgaacaaagatatctggggggtgaactacgggccactttcatttactcagtcagtgtccatcgttacgctgtaggggctgtttgtcactaatgcgggcaccccagcctaagagcccctctgctgtttacaggatttcccctcccgtgagaagggagtaggacatgccagacactcattctcccagcctcctttgcagctagagtgcagccacgtgactgaggttccccagggtccccaaagtgcttggggcagagtacagctcccctttgagaaagtcggtgctctggactgatgaaaaggacaaaagagaagccagttttgagaagtcaaagtgtgggcagaacggttcctttctggaggctttaggggagaatctgtttcctcgcttctccagcctttagaggccacctgcagtccctggctcacggccatcttcaaagccagcggtcgcatcgccctgacctccgcctccatcaaccatctccttgctgaccctgaccctcctgcctccctctcacaacgactcctgcgatgacgtggggctgtgaaaggaaaaatctcttgggtcccttcaagctgggaactgctcagggcaaaactccctcccattctattcaaactcatccctctgctcactgagatagatgcatattctgattgcctcgcttaccagaaactcaaaagaatgcaaccggttgtctctaaactcaaaagaatgcaaccagttgtctcacctacctgtgacctggaaacccctttcctgcttggagctgtccccgtctttctggatggaaccagtgtacttcttacatgtattgattgatgtctcatgtctccctaaaatgtataaaaccaggctgtgccccgaccaccttgggcacatgtcgtcaggacttcccgaggtcgtgtcacggatgcgcatccttaactttgtcgaataaacctcataaagtgacggacacgtgtcatttttctcgattgacagggccaaccc

SEQ ID NO: 461009 - DNA, 955 bp, Homo sapiens
gactataatgaacgcatatgaatatgatggattgaacgctacttcaagtaggcttcaatgcagcttggaacatgaatgcaaagctgctcagcctgactggggggttgtccctgctgcgggtggcccacagggctgtttttcaggcacaggacatgggctctcagctgctcagccagtgtgggggctggcccattgggggcagcctgtgctcagcctctagcccagctggattctccgggaaaaggcagagacagtttggcgaaaaagacacagggaaggagggggcggtgaaaggagaaagcagccttccagttaaagatcagccctcagttaaaggtcagcttctggcaggctggcctcaggcggagtctgggtcacagggaggagcagcagcagggtgggactggggcattctacatctcattcaggtcaagcagagtctggtccagcatcctttgtgtacagaggtgctcctctttggtgcatttcagtttatcttccaagtcatcaattgtcttttccagcttggctaccgatcgctcagcaaactcagcacaggtctctgcctccttgggtttatcagtaaaaatcttgatttcttcctcatatttgtcttctttttgagagtacttttcttcagcagcactcagacacttcaggttctggtccatcagtctaatctgctcatccatctctcggcaacgggactctgtcagctcagctcgttcctctgtgcgttccaagtctccttcaatggtcaccaacttacgagccacctcttcatacttcctatctgcctcttctgcaatgtgcttagcttctttgagttggagttcttggagttccatcttttcttcatcttttaaagcccggttttcaataaccttcatacctctctcactctcaccagcagctttttctgcttcttccagcttttgcagggcagtggccaggc

SEQ ID NO: 461010 - DNA, 299 bp, Homo sapiens
tcgcctgtgtcgactctagcaggctccccttgcttgtccgggtgtccgggactctgtcagctcagctcgttcctctgtgcgttccaagtctccttcaatggtcaccaacttacgagccacctcttcatacttcctatctgcctcttctgcaatgtgcttagcttctttgagttggagttcttggagttccatcttttcttcatcttttaaagcccggttttcaataaccttcatacctctctcactctcaccagcagctttttctgcttcttccagcttttgcagggcagtggccaggc

SEQ ID NO: 461011 - DNA, 1399 bp, Homo sapiens
tgcatcgtcaaaggacactcgaggacgtctaaaagaaactcagcgggaaagctgagcactcggaagaaccagggtaacaatgagacaaataacccgcggatggcccaaatgcattccatcggtagcggcaactgctttgctaacagaagaaagtagaaaaataacctttagaggactcacccctgagcacaaaggcaatgttgggcacactggtaaaggaccactagaatccagcagcccggacccttttctttgtggtcaagaaaggggaaaacaggtgcaggactgctacatcgatgggaaatgttccccccaaggcaaaaacgcccttaagatgtattctggagaattcgacccagtcagagtgtgtgtacctttttccctctcagatttgaagcaacttaaaatagacctaggtagattctcagataaccctgatggctatattgatgttttacaagggttaggacaatcctttgatctgacatggagagatataatgttactgctagatcagacactaaccccaaatgagagaaatgccaccataactgcagcccgagagtttggtgatctctggtgtctcagtcaggtcaatgataggatgacaacagagcaaagagaacgattccccacaggccagcaggcagttcccagtgtagaccctcgctgggacacagagtcagaacatggagatggaaataagccgccccctcatccatgccccttatgtcaagggaattactggaaggcctactgctccaggggacgaaggtcctctgagtcagaagctgatccagcagcaggactgagggtgcccagggcaagcaccagcccatgccatcaccctcactgagccccaggttatttttcttgagaaatactatacaggataaatctttcttcctagaaataaggaaaaaaacaacggactggattttcctagtttctacagatgcaagagccaaatgacttttgagtgtttcctgcctggatgttgacttttgaaactcagatattagatcaagcttctcaatacaaagcccagatcaagcttttcaacacaaaaagccatcagcctcaacaaaatcctaggaagcagaattcaagcagtgaaggataatgttttgtttaagttgtcagtgttcacccttcaaaaatgtaaaatataattccaaatcaaaatccaagttgcttttctttttggtattttgcgatttattgtagcattacctttatttgtgaggaaaatatattgaaggtttttttctcattaaatatgtaactatgaaatatttaggtctacaaaatgaatttctctatattttatgaacaaaatatcctagaaaagagagactttttaaataaatgaagattagtgaggataattatttcatat

SEQ ID NO: 461012 - DNA, 1274 bp, Homo sapiens
gcaaatcaagttttattgaggctgagtgcagtggctcatgcctgcaatcccagcgctttgggaggccaagtaattatggttctcattcactaactcatctgcacaaagcaccgagcatggtgtcggtcacaaaagaatggttcgcgggcactgctcaggggattgtgtttgaccggcacgttgttgatgactcccggccctcagagccagcagacatgctgcccagggaatgcagccgtgacctgcggaagtggtggcagcagccgggcacactgaggtgcctctcggggagagggagagccaggagcgccaggagctccaggagaggcggctttgatgccaggagcccaccccgactctcaggcaagcgtcacatcccccttcctgaatggcctcctgtcctgctgtccgctcagcactgccagggcagtctcccccagacctggggctccccagggacagagactgcaccttgcaacccgaaggacctagatggggctctggcacagaggagctcaatcaatatttgtccaatgaacaaatgccactccctggagctcgttgttctgggtgaaccagaggccaagccttcatgtccttcccatcgccagctggtagcccgaagaaaaggccacctgtgtccaggtcgcaggggtgttgtcatggaaagcctcaccctggccctctggtctcctcttagatttgacttttcctaattttccagccttgactttggctgttcctctatgtccatgaccctctgctccttccagatgtcagaaggggccttgcaagtgaggagcccccgagctcaagttcttctggcctcgcagaaaactcactgccccggatctctgagccaaagagctgtgtgaactgtgaaaactgtctaccccgtgtgggaggcggagatggtttcctattttaatcctctctaagactccaaaggaggacctcaggaacccaggatctgatcactccagctcctggtttatgccgctcgctcacaactggtccagtgtgttaattttatgtgcgtgtgtgtataataaatcatgtgagcccgccaccaacacgagaatcagagcatcgtccataacttgcttctactgagggcctgtgctctccctcccccaggtgaccacactcctgaatcctgcatttaaactaaaaagacaactatatagtttttcatatgtacgtatttgaaaaggtatgatgtttagttttactgttttttaaatttcatttttcaaaaggtttctctttccatc
